US011230589B2

(12) United States Patent
Lipson et al.

(10) Patent No.: US 11,230,589 B2
(45) Date of Patent: Jan. 25, 2022

(54) FUSION MOLECULES AND USES THEREOF

(71) Applicant: FOUNDATION MEDICINE, INC., Cambridge, MA (US)

(72) Inventors: Doron Lipson, Chestnut Hill, MA (US); Roman Yelensky, Newton, MA (US); Joel Robert Greenbowe, Cambridge, MA (US); Jie He, Newton, MA (US)

(73) Assignee: FOUNDATION MEDICINE, INC., Cambridge, MA (US)

( * ) Notice: Subject to any disclaimer, the term of this patent is extended or adjusted under 35 U.S.C. 154(b) by 259 days.

(21) Appl. No.: 14/440,569

(22) PCT Filed: Nov. 5, 2013

(86) PCT No.: PCT/US2013/068604
§ 371 (c)(1),
(2) Date: May 4, 2015

(87) PCT Pub. No.: WO2014/071419
PCT Pub. Date: May 8, 2014

(65) Prior Publication Data
US 2016/0009785 A1 Jan. 14, 2016

Related U.S. Application Data

(60) Provisional application No. 61/763,442, filed on Feb. 11, 2013, provisional application No. 61/722,533, filed on Nov. 5, 2012.

(51) Int. Cl.
| *C07K 14/71* | (2006.01) |
| *C12N 15/62* | (2006.01) |
| *C07K 14/47* | (2006.01) |
| *C07K 16/18* | (2006.01) |
| *C07K 16/28* | (2006.01) |
| *C07K 16/40* | (2006.01) |
| *C12N 9/96* | (2006.01) |

(52) U.S. Cl.
CPC .............. *C07K 14/71* (2013.01); *C07K 14/47* (2013.01); *C07K 16/18* (2013.01); *C07K 16/2863* (2013.01); *C07K 16/40* (2013.01); *C12N 9/96* (2013.01); *C12N 15/62* (2013.01)

(58) Field of Classification Search
None
See application file for complete search history.

(56) References Cited

U.S. PATENT DOCUMENTS

| 8,377,921 B2 | 2/2013 | Michellys et al. |
| 10,000,814 B2 | 6/2018 | Cronin et al. |
| 2002/0197679 A1 | 12/2002 | Tang et al. |
| 2005/0287541 A1 | 12/2005 | Nakagawara et al. |
| 2007/0010657 A1 | 1/2007 | Klocke et al. |
| 2007/0059710 A1 | 3/2007 | Luke et al. |
| 2007/0248605 A1 | 10/2007 | Hestir et al. |
| 2008/0051462 A1 | 2/2008 | Fritz et al. |
| 2008/0131375 A1 | 6/2008 | Gordon et al. |
| 2008/0171689 A1* | 7/2008 | Williams ............... C07K 14/71 424/178.1 |
| 2008/0226664 A1 | 9/2008 | Old et al. |
| 2009/0130101 A1 | 5/2009 | Cohen |
| 2009/0156475 A1 | 6/2009 | Rikova et al. |
| 2009/0209496 A1 | 8/2009 | Chaplin et al. |
| 2011/0118298 A1 | 5/2011 | Fritz et al. |
| 2011/0150893 A1 | 6/2011 | Cho et al. |
| 2012/0039805 A1 | 2/2012 | Lisanti et al. |
| 2012/0208706 A1 | 8/2012 | Downing et al. |
| 2013/0096021 A1 | 4/2013 | Chinnaiyan et al. |
| 2014/0336236 A1 | 11/2014 | Cronin et al. |
| 2015/0073036 A1 | 3/2015 | Hawryluk et al. |
| 2015/0366866 A1 | 12/2015 | Ali et al. |
| 2016/0009785 A1 | 1/2016 | Lipson et al. |
| 2016/0010068 A1 | 1/2016 | Bastian et al. |
| 2018/0346992 A1 | 12/2018 | Cronin et al. |
| 2020/0299775 A1 | 9/2020 | Hawryluk et al. |

FOREIGN PATENT DOCUMENTS

| CA | 2880013 A1 | 1/2014 |
| EP | 0698096 A1 | 2/1996 |
| EP | 0698096 B1 | 3/1997 |
| EP | 2057465 A2 | 5/2009 |
| WO | 9426889 A2 | 11/1994 |
| WO | 01027081 A1 | 4/2001 |
| WO | 03031568 A2 | 4/2003 |
| WO | 200413099 A1 | 2/2004 |
| WO | 2007060402 A1 | 5/2007 |
| WO | 2008021290 A2 | 2/2008 |
| WO | 2010081817 A1 | 7/2010 |
| WO | 2012092426 A1 | 7/2012 |
| WO | 2013059740 A1 | 4/2013 |
| WO | 2013076186 A1 | 5/2013 |
| WO | 2013087716 A2 | 6/2013 |

(Continued)

OTHER PUBLICATIONS

Singh et al. (Sciencexpress, http://www.sciencemag.org/content/early/recent/ Jul. 26, 2012 / 10.1126/science. 1220834, 7 pages) (Year: 2012).*
Capallen et al. (Nature Genetics, 1999, vol. 23, pp. 18-20) (Year: 1999).*
Kang et al. (Experimental and Therapeutic Medicine 3: 149-153, 2012) (Year: 2012).*
Lam et al. (Proc Amer Assoc Cancer Res, vol. 46, 2005, Abstract #883; two pages) (Year: 2005).*
Woenckhaus et al.Human Pathology (2008) 39, 126-136 (Year: 2008).*
Brambilla et al. (Eur Respir J 2001; 18: 1059-1068) (Year: 2001).*
Richelda et al. "A Novel Chromosomal Translocation t(4; 14)p16.3; q32) in Multiple Myeloma Involves the Fibroblast Growth Factor Receptor 3 Gene" Blood (1997) vol. 90, No. 10, pp. 4062-4070.

(Continued)

*Primary Examiner* — Juliet C Switzer
(74) *Attorney, Agent, or Firm* — Morrison & Foerster LLP

(57) ABSTRACT

Novel fusion molecules and uses are disclosed.

26 Claims, 261 Drawing Sheets
Specification includes a Sequence Listing.

(56) References Cited

FOREIGN PATENT DOCUMENTS

| WO | WO-2014018673 A2 * | 1/2014 | ........... C12Q 1/6886 |
|---|---|---|---|
| WO | 2014036387 A2 | 3/2014 | |
| WO | 2014071358 A2 | 5/2014 | |
| WO | 2014071419 A2 | 5/2014 | |
| WO | 2014113729 A2 | 7/2014 | |
| WO | 2014130975 A1 | 8/2014 | |

OTHER PUBLICATIONS

Santra et al. "A sibset of multiple myeloma harboring the t(4;14)(p16;q32) translocation lacks FGFR3 expression but maintains an IGH/MMSET fusion transcript" Blood (2003) vol. 101, No. 6, pp. 2374-2376.
Sartore-Bianchi et al. "Sensitivity to Entrectinib Associated With a Novel LMNA-NTRK1 Gene Fusion in Metastatic Colorectal Cancer" J Natl Cancer Inst (2016) vol. 108, No. 1, djv306, pp. 1-4.
Singh et al. "Transforming Fusions of FGFR and TACC Genes in Human Glioblastoma" Science (2012) vol. 337(6099) pp. 1231-1235.
Stewart et al. "Correlation of TACC3, FGFR3, Mmset and p21 expression with the t(4;14)(p16.3;q32) in multiple myeloma" British Journal of Haematology (2004) vol. 126, pp. 72-76.
Toyokawa et al. "Co-expression of keratinocyte growth factor and K-sam is an independent prognostic factor in gastric carcinoma" Oncology Reports (2009) vol. 21 pp. 875-880.
Turner and Grose "Fibroblast growth factor signalling: from development to cancer" Nat Rev Cancer (2010) vol. 10 No. 2 pp. 116-129.
Turner et al. "Fibroblast growth factor signalling: from development to cancer" Nature (2010) vol. 10, pp. 116-129.
Turner et al. "Integrative molecular profiling of triple negative breast cancers identifies amplicon drivers and potential therapeutic targets" Oncogene (2010) vol. 8 No. 29 pp. 2013-2023.
Wang et al. "Mutations in Isocitrate Dehydrogenase 1 and 2 Occur Frequently in Intrahepatic Cholangiocarcinomas and Share Hypermethylation Targets with Glioblastomas" Oncogene (2013) vol. 32 No. 25.
Ware et al. "Rapidly Acquired Resistance to EGFR Tyrosine Kinase Inhibitors in NSCLC Cell Lines through De-Repression of FGFR2 and FGFR3 Expression" PLOS One (2010) vol. 5, No. 11, pp. e14117.
Wong et al. "Evaluation of a Congenital Infantile Fibrosarcoma by Comprehensive Genomic Profiling Reveals an LMNA NTRK1 Gene Fusion Responsive to Crizotinib" J Natl Cancer Inst (2016) vol. 108, No. 1, djv307, pp. 1-3.
Wu et al. "Identification of Targetable FGFR Gene Fusions in Diverse Cancers" Cancer Discovery (Jun. 2013) pp. 636-647.
Yoon et al. "Enhanced epidermal growth factor receptor activation in human cholangiocarcinoma cells" Journal of Hepatology (2004) pp. 808-814.
Altorki et al. "Phase II Proof-of-Concept Study of Pazopanib Monotherapy in Treatment-Naive Patience With State I/II Resectable Non-Small-Cell Lung Cancer" Journal of Clinical Oncology (2010) vol. 28, No. 19, pp. 3131-3137.
Amatu et al. "NTRK gene fusions as novel targets of cancer therapy across multiple tumour types" ESMO Open (2016) vol. 1, e000023, pp. 1-9.
Avet-Loiseau et al. "High Incidence of Translocations t(11;14)(q13;q32) and t(4;14)p16,q32) in Patients with Plasma Cell Malignancies" Cancer Research (1998) vol. 58, pp. 5640-5645.
Bai et al. "GP369, an FGFR2-IIIb-Specific Antibody, Exhibits Potent antitumor Activity against Human Cancers Driven by Activated FGFR2 Signaling" Cancer Research (2010) vol. 70 No 19.
Brave et al. "Assessing the Activity of Cediranib, a VEGFR-2/3 Tyrosine Kinase Inhibitor, against VEGFR-1 and Members of the Structurally Related PDGFR Family" Molecular Cancer Therapeutics (2011) vol. 10 No. 5 pp. 861-873.
Byron et al. "Inhibition of Activated Fibroblast Growth Factor Receptor 2 in Endometrial Cancer Cells Induces Cell Death Despite PTEN Abrogation" Cancer Research (2008) vol. 68 No. 17.
Chen et al. "FGFR3 as a therapeutic target of the small molecule inhibitor PKC412 in hematopoietic malignancies" Oncogene (2005) vol. 24, pp. 8259-8267.
Chiorean et al., "Imatinib Mesylate (STI-571), a c-Abl Kinase Inhibitor, Indirectly Blocks Receptor Tyrosine Kinase Activation and Induces Apoptosis in a Human Cholangiocarcinoma Cell Line" Gastroenterology (2003) vol. 124 No. 4.
Cho et al. "Enhanced Expression of Keratinocyte Growth Factor and Its Receptor Correlates with Venous Invasion in Pancreatic Cancer" The American Journal of Pathology (2007) vol. 170 No. 6.
ClinicalTrials.Gov Identifier No. NCT02568267, "Basket Study of Entrectinib (RXDX-101) for the Treatment of Patients With Solid Tumors Harboring NTRK 1/2/3/ (Trk A/B/C), ROS1, or ALK Gene Rearrangements (Fusions) (STARTRK-2)" First Received: Oct. 2, 2016; Last Updated : Jan. 3, 2017; https://clinicaltrials.gov/ct2/show/NCT02568267?term=NTRK1+fusion+lung&rank=1; Retrieved Jan. 4, 2017.
ClinicalTrials.Gov Identifier No. NCT0257643.1, "Study of LOXO-101 in Subjects With NTRK Fusion Positive Solid Tumors (NAVIGATE)" First Received: Oct. 12, 2015; Last Updated: Nov. 16, 2016; https://clinicaltrials.gov/ct2/show/NCT02576431?term=NTRK1+fusion+lung&rank=2; Retrieved Jan. 4, 2017.
Cole et al. "Inhibition of FGFR2 and FGFR1 increases cisplatin sensitivity in ovarian cancer" Cancer Biology & Therapy (2010) vol. 10 No. 5 pp. 495-504.
Cortes et al. "A Pivotal PhaM 2 Trial of Ponatinib in Patients with Chronic Myeloid Leukemia (CML) and Philadelphia Chromosome-Positive Acute Lymphoblastic Leukemia (Ph+ALL) Resllltllnt or Intole111nt to Dasatlnlb or Nilotinib, or with the T315I BCR-ABL Mutation: 1Z-Month Follow-up of the PACE Trial" ASH Annual Meeting and Exposition (Dec. 9, 2012) Abstract No. 163.
Doebele et al. "An Oncogenic NTRK Fusion in a Patient with Soft-Tissue Sarcoma with Response to the Tropomyosin-Related Kinase Inhibitor LOXO-101" Cancer Discovery (2015) vol. 5, pp. 1049-1057.
Garcia-Mayoral et al. "The Structure of the C-Terminal KH Domains of KSRP Reveals a Noncanonical Motif Important for mRNA Degradation" Structure (2007) vol. 15 pp. 485-498.
Gartside et al. "Loss-of-Function Fibroblast Growth Factor Receptor-2 Mutations in Melanoma" Molecular Cancer Research (2009) vol. 7 No. 1 pp. 41-54.
GenBank Accession No. NM_000141 accessed Nov. 19, 2015 from http://www.ncbi.nlm.nih.gov/nuccore/189083823.
GenBank Accession No. NM_001012331 accessed Nov. 19, 2015 from <http://www.ncbi.nlm.nih.gov/nuccore/NM_001012331.1>.
Genbank Accession No. NM_001080512 accessed Nov. 19, 2015 from http://www.ncbi.nlm.nih.gov/nuccore/NM_001080512.2.
GenBank Accession No. NM_001127211 accessed Nov. 19, 2015 from http://www.ncbi.nlm.nih.gov/nuccore/385198090.
GenBank Accession No. NM_001144915 accessed on Nov. 17, 2015 from http://www.ncbi.nlm.nih.gov/nuccore/NM_001144915.1.
GenBank Accession No. NM_003787 accessed Nov. 19, 2015 from http://www.ncbi.nlm.nih.gov/nuccore/NM_003787.
GenBank Accession No. NM_004562 accessed Nov. 19, 2015 from http://www.ncbi.nlm.nih.gov/nuccore/NM_004562.2.
GenBank Accession No. NM_006342 accessed Nov. 19, 2015 from http://www.ncbi.nlm.nih.gov/nuccore/NM_006342.
GenBank Accession No. NM_022494 accessed Nov. 19, 2015 from http://www.ncbi.nlm.nih.gov/nuccore/NM_022494.2.
GenBank Accession No. NP_001012331 accessed Nov. 19, 2015 from http://www.ncbi.nlm.nih.gov/protein/59889558.
Gozgit et al. "Ponatinib (AB24534), a Multitargeted Pan-FGFR Inhibitor with Activity in Multiple FGFR-Amplified or Mutated Cancer Models" Molecular Cancer Therapeutics (2012) vol. 11 No 3 pp. 690-699.
Gozgit et al. "Ponatinib (AP24534), a Multitargeted Pan-FGFR Inhibitor with Activity in Multiple FGFR-Amplified or Mutated Cancer Models" Molecular Cancer Therapeutics (2012) vol. 11, No. 3, pp. 690-699.

(56) References Cited

OTHER PUBLICATIONS

Huether et al.: "Sorafenib alone or as combination therapy for growth control of cholangiocarcinoma", Biochemical Pharmacology, Elsevier, US, vol. 73, No. 9, Mar. 24, 2007 (Mar. 24, 2007), pp. 1308-1317.
International Preliminary Report on Patentability and Written Opinion for International Application No. PCT/US2012/061211 dated Apr. 22, 2014.
International Preliminary Report on Patentability from PCT/US14/12136 dated Mar. 18, 2015.
International Search Report and Written Opinion for International Application No. PCT/US2013/068457 dated Jul. 11, 2014.
International Search Report and Written Opinion for PCT/US2014/012136 dated Jul. 16, 2014.
International Search Report for International Application No. PCT/US2012/061211 dated Feb. 5, 2013.
Keats et al. "In multiple myeloma, t(4;14)(p16;q32) is an adverse prognostic factor irrespective of FGFR3 expression" Blood (2003) vol. 101, No. 4, pp. 1520-1529.
Ko et al. "Phase II study of telatinib (T) in combination with capecitabine (X) and cisplatin (P) as first-line treatment in patients (pts) with advanced cancer of the stomach (G) or gastro-esophageal junction (GEJ)." Journal of Clinical Oncology ASCO Annual Meeting Abstracts, vol. 28 No. 15; May 20 supplement (2010).
Landis et al. "Cancer Statistics, 1998" Ca Cancer J Clin (1998) vol. 48 No. 1 pp. 6-29.
Lih et al. "N of 2 Responders With LMNA-NTRK1" J Natl Cancer Inst (2016) vol. 108, No. 1, djv376, pp. 1-2.
Lin et al., "Exon Array Profiling Detects EML4-ALK Fusion in Breast, Colorectal, and Non-Small Cell Lung Cancers" Mol Cancer Research (2009) vol. 7, No. 9, pp. 1466-1476.
Lorenzi et al. "FRAG1, a gene that potently activates fibroblast growth factor receptor by C-terminal fusion through chromosomal rearrangement" Proc. Natl. Acad. Sci. USA (1996) vol. 93 pp. 8956-8961.
Lorenzi et al. "Ligand-independent activation of fibroblast growth factor receptor-2 by carboxl terminal alterations" Oncogene (1997) vol. 15 pp. 817-826.
Marchetti et al., "Frequent Mutations in the Neurotrophic Tyrosine Receptor Kinase Gene Family in Large Cell Neuroendocrine Carcinoma of the Lung" Human Mutation (2008) vol. 29, No. 5, pp. 609-616.
Matsumoto et al. "FGFR2 gene amplification and clinicopathological features in gastric cancer" British Journal of Dancer (2012) vol. 106 No. 4 pp. 727-732.
McKay et al. "PP58 Novel potential therapeutic targets for cholangiocarcinoma identified by array comparitive hybridization" European Journal of Cancer (2009) vol. 7 No 4.
Monk et al. "Phase II, Open-Label Study of Pazopanib or Lapatinib Monotherapy Compared With Pazopanib Plus Lapatinib Combination Therapy in Patients With Advanced and Recurrent Cervical Cancer" Journal of Clinical Oncology (2010) vol. 28, No. 22, pp. 3562-3569.
Narong and Leelawat "Basic fibroblast growth factor induces cholangiocarcinoma cell migration via activation of the MEK1/2 pathway" Oncology Letters (2011) pp. 821-825.
Patel et al "Cholangiocarcinoma—controversies and challenges" Nat Rev Gastroenterol Hepatol (2011) vol. 8 No 4.
Patel et al. "Worldwide trends in mortality from biliary tract malignancies" BMC Cancer (2002) vol. 2 No. 10.
Powers et al. "Fibroblast growth factors, their receptors and signaling" Endocrine-Related Cancer (2000) vol. 7 pp. 165-197.
Reck et al. "A phase II double-blind study to investigate efficacy and safety of two doses of the triple angiokinase inhibitor BIBF 1120 in patients with relapsed advanced non-small-cell lung cancer" Annals of Oncology (2011) vol. 22, pp. 1374-1381.
International Preliminary Report on Patentability for International Application No. PCT/US2013/068604 dated May 5, 2015.
International Search Report for International Application No. PCT/US2013/068604 dated Nov. 7, 2014.
Meulenbeld, Hielke J. et al., "Danusertib, an aurora kinase inhibitor," Expert Opinion Investigative Drugs. Mar. 2012, 21(3), pp. 383-393.
Written Opinion for International Application No. PCT/US2013/068604 dated May 5, 2015.
Albanese, C. et al., "Dual targeting of CDKand tropomyosin receptor kinase families by the oral inhibitor PHA-848125, an agent with broad-spectrum antitumor efficacy", Mol Cancer Ther9(8):2243-54, Aug. 3, 2010.
Camidge et al. Optimizing the detection of lung cancer patients harboring anaplastic lymphoma kinase (ALK) gene Yearrangements potentially suitable for ALK inhibitor treatment. Clin Cancer Res Nov. 14, 2010 vol. 16 No. 22 pp. 5581-5590. Especially p. 5586 col 2 para 2-3.
Cohen, Roger B. et al., "A phase I dose-escalation study of danusertib (PHA-739358) administered as a 24-hour infusion with and without granulocyte colony-stimulating factor in a 14-day cycle in patients with advanced solid tumors", Clin Cancer Res 15(21):6694-701, ePub Oct. 13, 2009, Nov. 1, 2009.
Degrassi, A. et al., "Efficacy of PHA-848125, a cyclin-dependent kinase inhibitor, on the K-Ras(G12D) LA2 lung adenocarcinoma transgenic mouse model: evaluation by multimodality imaging", Mol Cancer Ther 9(3):673-81, Mar. 9, 2010.
Doebele et al., "NTRK1 Gene Fusions as a Novel Oncogene Target in Lung Cancer", 2013 ASCO Annual Meeting Abstract No. 8023; Abstract only (May 31-Jun. 4, 2013).
Doebele et al., "NTRK1 Gene Fusions as a Novel Oncogene Target in Lung Cancer", 2013 ASCO Annual Meeting Abstract No. 8023; Poster (May 31-Jun. 4, 2013).
Greco A, et al. "Characterization of the NTRK1 genomic region involved in chromosomal rearrangements generating TRK oncogenes." Genomics (1993) 18(2):397-400.
Greco A, et al. "TRK-T1 is a novel oncogene formed by the fusion of TPR and TRK genes in human papillary thyroid carcinomas." Oncogene (1992) 7(2):237-42.
Greco et al. Rearrangements of NTRK1 gene in papillary thyroid carcinoma. Mol Cell Endrocrinol May 28, 2010 vol. 321 No. 1 pp. 44-49. Especially p. 46 col. 2 para 3.
Greco, A. et al., "The DNA rearrangement that generates the TRK-T3 oncogene involves a novel gene on chromosome 3 whose product has a potential coiled-coil domain", Mol Cell Biol 15(11):6118-27, Nov. 1995.
Han, SY et al., "Evaluation of a multi-kinase inhibitor KRC-108 as an anti-tumor agent in vitro and in vivo", Invest New Drugs 30(2):518-23, ePub Nov. 16, 2010, Apr. 2012.
Huehne K, et al. "Novel missense, insertion and deletion mutations in the neurotrophic tyrosine kinase receptor type 1 gene (NTRK1) associated with congenital insensitivity to pain with anhidrosis." Neuromuscul Disord (2008) 18 (2): 159-66.
Indo Y, et al. "Structure and organization of the human TRKA gene encoding a high affinity receptor for nerve growth factor." Jpn J Hum Genet (1997) 42(2):343-51.
International Search Report for International Application No. PCT/US2012/061211 dated May 2, 2013.
Iyer, R. et al., "Lestaurtinib enhances the antitumor efficacy of chemotherapy in murine xenograft models of neuroblastoma", Clin Cancer Res 16(5):1478-85, ePub Feb. 23, 2010, Mar. 1, 2010.
Kelleher et al. The emerging pathogenic and therapeutic importance of the anaplastic lymphoma kinase gene. Eur J Cancer Sep. 2010 vol. 46 No. 13 pp. 2357-2368. Especially p. 2365 table 6.
Mardy et al., Congenital insensitivity to pain with anhidrosis: Novel mutations in the TRKA (NTRK1) gene encoding a high-affinity receptor for nerve growth factor, 1999, Am. J. Hum. Genet., 64, pp. 1570-1579.
Martin-Zanca D, et al. "A human oncogene formed by the fusion of truncated tropomyosin and protein tyrosine kinase sequences." Nature (1986) 319(6056)743-8.
Miura Y, et al. "Mutation and polymorphism analysis of the TRKA (NTRKl)gene encoding a high-affinity receptor for nerve growth factor in congenital insensitivity to pain with anhidrosis (CIPA) families." Hum Genet (2000) 106 (1):116-24.

(56) References Cited

OTHER PUBLICATIONS

Muller-Tidow et al., Identification of Metastasis-Associated Receptor Tyrosine Kinases in Non-Small Cell Lung Cancer, 2005, Cancer Res., vol. 65, No. 5 pp. 1778-1782.
Notification of Transmittal of the International Search Report and Written Opinion of the International Searching Authority from corresponding PCT/US2013/068457 dated Jul. 11, 2014.
Notification of Transmittal of the International Search Report and Written Opinion of the International Searching Authority from corresponding PCT/US2013/068604 dated Jul. 11, 2014.
Perez-Pinera P, et al. "The Trk tyrosine kinase inhibitor K252a regulates growth of lung adenocarcinomas." Mol Cell Biochem (2007) 295(1-2):19-26.
Rao, R. et al., "Heat shock protein 90 inhibition depletes TrkA levels and signaling in human acute leukemia cells", Mol Cancer Ther 9(8):2232-42, ePub Jul. 27, 2010, Aug. 2010.
Schneider et al., "The transforming acidic coiled coil 3 protein is essential for spindle-dependent chromosome alignment and mitotic survival" The Journal of Biological Chemistry, 282(40):29273-29283 (2007).
Singh et al., "Transforming Fusions of FGFR and TACC Genes in Human Glioblastoma" Science, 337:1231-1235 (2012).
Tacconelli, A. et al., "TrkA alternative splicing: a regulated tumor-promoting switch in human neuroblastoma", Cancer Cell 6(4):347-60, Oct. 2004.
Takeuchi et al. Multiplex reverse transcription-PCR screening for EML4-ALK fusion transcripts. Clin Cancer Res Oct. 15, 2008 vol. 14 No. 20 pp. 6618-6624. Especially p. 6619 col. 1 para.
Teixeira et al., "Recurrent Fusion Oncogenes in Carcinomas" Critical Reviews in Oncogenesis, 12(3-4):257-271 (2006).
Thress et al., Identification and preclinical characterization of AZ-23, a novel, selective, and orally bioavailable inhibitor of the Trk kinase pathway, 2009, Mol. Cancer Ther., vol. 8, No. 7, pp. 1818-1827.
Thress, K. et al., "Identification and preclinical characterization of AZ-23, a novel, selective, and orally bioavailable inhibitor of the Trk kinase pathway", Mol Cancer Ther 8(7):1818-27, ePub Jun. 9, 2009, Jul. 2009.
Undevia, SD et al., "Phase I clinical trial of CEP-2563 dihydrochloride, a receptor tyrosine kinase inhibitor, in patients with refractory solid tumors", Invest New Drugs 22(4):449-58, Nov. 2004.
University of Colorado Denver; "NTRK1: A new oncogene and target in lung cancer". Press Release, Public release date: Jun. 3, 2013.
Vaishnavi, Aria et al., "Oncogenic and drug-sensitive NTRK1 rearrangements in lung cancer", Nature Medicine, vol. 19, No. 11, pp. 1469-1472, ePub Oct. 27, 2013, Nov. 2013.
Wang et al. Fusion of dynactin 1 to anaplastic lymphoma kinase in inflammatory myofibroblastic tumor. Hum Pathol ePub Jun. 1, 2012 vol. 43 No. 11 pp. 2047-2052. Especially abstract.
Weiss, GJ et al., "Phase I study of the safety, tolerability and pharmacokinetics of PHA-848125AC, a dual tropomyosin receptor kinase A and cyclin-dependent kinase inhibitor, in patients with advanced solid malignancies", Invest New Drugs, 30(6):2334-2343 ePub Dec. 2011, Dec. 2012.
Williams et al., "Oncogenic FGFR3 gene fusions in bladder cancer" Human Molecular Genetics, 22(4)795-803 (2013).
Caneiro et al. "FGFR3-TACC3: A novel gene fusion in cervical cancer" Gynecologic Oncology Reports (2015), vol. 13, pp. 53-56.
Capelletti et al. "Identification of Recurrent FGFR3-TACC3 Fusion Oncogenes from Lung Adenocarcinoma" Clin Cancer Res (2014) vol. 20, pp. 6551-6558.
Costa et al. "FGFR3-TACC3 fusion in solid tumors: mini review" Oncotarget (2016) vol. 7, No. 34, pp. 55924-55938.
Gergely et al. "The TACC domain identifies a family of centrosomal proteins that can interact with microtubules" Proc Natl Acad Sci (2000) vol. 97, pp. 14352-14357.
Keegan et al. "Isolation of an additional member of the fibroblast growth factor receptor family, FGFR-3" Proc Natl Acad Sci (1991) vol. 88, No. 4, pp. 1095-1099.

Hyman et al. "The efficacy of larotrectinib (LOXO-101), a selective tropomyosin receptor kinase (TRK) inhibitor, in adult and pediatric TRK fusion cancers" Presentation from the ASCO Annual Meeting 2017.
Farago et al., "Durable Clinical Response to Entrectinib in NTRK1-Rearranged Non-Small Cell Lung Cancer" Journal of Thoracic Oncology (2015) vol. 10, No. 12, pp. 1670-1674.
[No Author Listed] National Center for Biotechnology Information PubChem Database. Ceritinib, CID=57379345, pubchem.ncbi.nim.nih.gov/compund/Ceritinib, created 2012, accessed on Jul. 21, 2019.
Dhami et al., "Comprehensive genomic profiling aids in treatment of metastatic endometrial cancer," Cold Spring Harb Mol Case Stud (2018) vol. 4, Article a002089, 14 pages.
Guagnano et al., "FGFR Genetic Alterations Predict for Sensitivity to NVP-BGJ398, a Selective Pan-FGFR Inhibitor," Cancer Discovery (2012) vol. 2, pp. 1118-1133.
Javle et al., "Biliary Cancer: Utility of Next-Generation Sequencing for Clinical Management," Cancer (2016) vol. 122, pp. 3838-3847.
Jiao et al., "Exome sequencing identifies frequest inactivating mutations in BAP1, ARID1A and PBRM in intrahepatic cholangiocarcinomas," Nature Genetics (2013) vol. 45, No. 12, pp. 1470-1473 and Supplementary Information.
Lee et al., "The potential role of comprehensive genomic profiling to guide targeted therapy for patients with biliary cancer," Ther Adv Gastroenterol (2017) vol. 10, No. 6, pp. 507-520.
Ou et al., "Emergence of FGFR3-TACC3 fusions as a potential by-pass resistance mechanism to EGFR tyrosine kinase inhibitors in EGFR mutated NSCLC patients," Lung Cancer (2017) vol. 111, pp. 61-67.
Wiesner et al., "Kinase fusions are frequent in Spitz tumours and spitzoid melanomas," Nature Communications (2014) vol. 5, Article 3116, 9 pages.
Giamas et al., (2007). "Protein kinases as targets for cancer treatment," Pharmacogenomics, 8(8):1005-1016.
Ardini et al., (2014). "The TPM3-NTRK1 rearrangement is a recurring event in colorectal carcinoma and is associated with tumor sensitivity to TRKA kinase inhibition," Mol Oncol., 8:1495-507.
Bender et al., (2019). "Refractory and metastatic infantile fibrosarcoma harboring LMNA-NTRK1 fusion shows complete and durable response to crizotinib," Cold Spring Harb Mol Case Stud., 5:a00376, 9 pages.
Cocco et al., (2018). "NTRK fusion-positive cancers and TRK inhibitor therapy," Nat Rev Clin Oncol., 15:731-747, 34 pages.
Deinhardt et al., (2014). "Trk receptors," Handb Exp Pharmacol., 220:103-19.
Fang et al., (2016). "Detection of a novel RET gene fusion in a non-small cell lung cancer patient using AMP chemistry," J Thoracic Oncol., 11 :S21-S22.
Fang et al., (2019). "MPRIP-ALK, a Novel ALK Rearrangement That Responds to ALK Inhibition in NSCLC," J Thorac Oncol., 14:e148-e151.
Gainor et al., (2013). "Novel targets in non-small cell lung cancer: ROS1 and RET fusions," Oncologist, 18:865-75.
Gosenca et al., (2014). "Identification and functional characterization of imatinib-sensitive DTD1-PDGFRB and CCDC88C-PDGFRB fusion genes in eosinophilia-associated myeloid/lymphoid neoplasms," Genes Chromosomes Cancer, 53:411-21.
Greco et al., (1998). "Role of the TFG N-terminus and coiled-coil domain in the transforming activity of the thyroid TRK-T3 oncogene," Oncogene, 16:809-16.
Griono et al., (2019). "A Simple RNA Target Capture NGS Strategy for Fusion Genes Assessment in the Diagnostics of Pediatric B-cell Acute Lymphoblastic Leukemia," Hemasphere, 3:e250, 9 pages.
Hirai et al., (2020). "Large-scale metabarcoding analysis of epipelagic and mesopelagic copepods in the Pacific," PLOS One, 15:e0233189, 24 pages.
Naumann et al., (2015). "Fusion of PDGFRB to MPRIP, CPSF6, and GOLGB1 in three patients with eosinophilia-associated myeloproliferative neoplasms," Genes Chromosomes Cancer, 54:762-70.

(56) References Cited

OTHER PUBLICATIONS

Shu et al., (2020). "Identification of a Novel MPRIP-ROS1 Fusion and Clinical Efficacy of Crizotinib in an Advanced Lung Adenocarcinoma Patient: A Case Report," Onco Targets Ther., 13:10387-10391.

Zhang et al., (2010). "Fusion of EML4 and ALK is associated with development of lung adenocarcinomas lacking EGFR and KRAS mutations and is correlated with ALK expression," Mol Cancer, 9:188, 12 pages.

* cited by examiner

FIG. 1A

| Fusion | Disease | Breakpoint 1 | Breakpoint 2 | Rearrangement |
|---|---|---|---|---|
| FGFR3-TACC3 | Lung adenocarcinoma | chr4:1,808,755 | chr4:1,737,289 | duplication |
| FGFR3-TACC3 | Cervical adenocarcinoma | chr4:1,808,702 | chr4:1,737,469 | duplication |
| FGFR3-TACC3 | Uterus endometrial adenocarcinoma | chr4:1,808,880 | chr4:1,739,095 | duplication |
| TRIM24-BRAF | Glioblastoma | chr7:140,490,180 | chr7:138,245,669 | inversion |
| TRIM24-BRAF | Melanoma | chr7:140,489,369 | chr7:138,241,731 | inversion |
| CNTLN-RAF1 | Spindle Cell Sarcoma | ~chr3:12,643,880 | ~chr9:17,238,200 | chr3:9 translocation |
| TRIM33-RAF1 | Ameloblastic fibrosarcoma | chr3:12,641,441 | chr1:114,967,300 | chr1:3 translocation |
| PDZRN3-RAF1 | Adenocarcinoma of unknown primary | chr3:12,642,141 | chr3:73,442,594 | deletion |
| LMNA-NTRK1 | Non-Langerhans Histocytosis | chr1:156,844,787 | chr1:156,105,353 | deletion |
| RABGAP1L-NTRK1 | Cholangiocarcinoma | ~chr1:156,849,730 | ~chr1:174,637,720 | deletion |
| MPRIP-NTRK1 | Lung adenocarcinoma | chr1:156,845,212 | chr17:17,080,829 | chr1:17 translocation |
| TRIM33-RET | Lung adenocarcinoma | chr1:114,948,358 | chr10:43,611,185 | chr1:10 translocation |
| FGFR1-NTM | Urothelial (transitional cell) carcinoma | chr8:38,318,554 | chr11:131,271,869 | chr8:11 translocation |
| TTC23-IGF1R | Ovarian epithelial carcinoma | chr15:99,434,631 | chr15:99,751,103 | inversion |
| DOT1L-MYST3(KAT6A) | Lung adenocarcinoma | ~chr19:2,214,550 | chr8:41,904,252 | chr8:19 translocation |
| SMAD4-MYO5B | Colorectal adenocarcinoma | chr18:48,573,683 | chr18:47,682,520 | inversion |
| HMGXB3-FLT4 | Breast carcinoma | ~chr5:149,396,435 | ~chr5:180,043,875 | |
| MLL-YAP1 | Unknown | chr11:102,099,656 | chr11:118,352,435 | |
| TMPRSS2-MX1 | Prostate carcinoma | ~chr21:42,874,744 | chr21:42,820,221 | |
| MCFD2-ALK | Lung adenocarcinoma | chr2:47,148,685 | chr2:29,447,936 | |
| RANBP17-FGFR3 | Breast carcinoma | chr5:170,726,887 | chr4:1,807,497 | |
| NUMA1-ERBB4 | Pancreas ductal adenocarcinoma | chr11:71,727,864 | chr2:212,495,208 | |
| TPM3-NTRK1 | Colorectal carcinoma (CRC) | chr1: ~154,132,770 | chr1:156,844,170 | inversion |
| SNAPC4-NOTCH1 | Breast cancer | chr9:~139,292,300 | chr9:139,397,700 | tandem duplication |
| TSC2-CREBBP | Breast cancer | chr16:2,136,500 | chr16: 3,793,550 | inversion |

FIG. 1B

| Fusion | Disease | Breakpoint 1 | Breakpoint 2 | Rearrangement |
|---|---|---|---|---|
| C5orf42-ERBB4 | Triple negative breast cancer (TNBC) | chr5:37,156,250 | chr2:212,568,950 | translocation |
| USP2-CBL | Spleen sarcoma | chr11:119,242,468 | chr11:119148790 | inversion |
| STK32B-ALK | Uterus leiomyosarcoma | chr4:5,475,193 | chr2:29,447,949 | translocation |
| FGFR2-TACC3 | Cholangiocarcinoma | chr10:123,243,122 | chr4:1,740,657 | translocation |
| FGFR2-KIAA1598 | Cholangiocarcinoma | chr10:123,239,241 | chr10:118708643 | deletion |
| BICC1-FGFR2 | Cholangiocarcinoma | chr10:60446461 | chr10:123,241,845 | inversion |
| FGFR3-JAKMIP1 | Bladder urothelial carcinoma | chr4:1,808,873 | chr4:6,098,343 | inversion |
| MASP2-MTOR | Cervix squamous cell carcinoma | chr4:6,098,343 | chr1:11,303,421 | duplication |
| FGFR2-BICC1 | Cholangiocarcinoma | chr10:123,241,713 | chr10:60,567,607 | inversion |
| CD74-ROS1 | Lung adenocarcinoma | chr5:149,783,724 | chr6:117,649290 | translocation |

FIG. 1C

| Fusion | 5' Transcript ID | Last exon of 5' transcript | 3' Transcript ID | First exon of 3' transcript |
|---|---|---|---|---|
| FGFR3-TACC3 | NM_000142 | exon 17 | NM_006342 | exon 8 |
| FGFR3-TACC3 | NM_000142 | exon 17 | NM_006342 | exon 8 |
| FGFR3-TACC3 | NM_000142 | exon 18 | NM_006342 | exon 10 |
| TRIM24-BRAF | NM_003852 | exon 9 | NM_004333 | exon 9 |
| TRIM24-BRAF | NM_003852 | exon 9 | NM_004333 | exon 9 |
| CNTLN-RAF1 | NM_017738 | exon 5 | NM_002880 | exon 8 |
| TRIM33-RAF1 | NM_015906 | exon 9 | NM_002880 | exon 10 |
| PDZRN3-RAF1 | NM_015009 | exon 5 | NM_002880 | exon 8 |
| LMNA-NTRK1 | NM_170707 | exon 5 | NM_002529 | exon 12 |
| RABGAP1L-NTRK1 | NM_014857 | exon 14 | NM_002529 | exon 16 |
| MPRIP-NTRK1 | NM_015134 | exon 21 | NM_002529 | exon 12 |
| TRIM33-RET | NM_015906 | exon 14 | NM_020630 | exon 12 |
| FGFR1-NTM | NM_015850 | exon 1 (noncoding) | NM_016522 | exon 1 |
| TTC23-IGF1R | NM_022905 | exon 7 | NM_000875 | exon 4 |
| DOT1L-MYST3 (KAT6A) | NM_032482 | exon 18 | NM_006766 | exon 3 |
| SMAD4-MYO5B | NM_005359 | exon 2 | NM_001080467 | exon 2 |
| HMGXB3-FLT4 | NM_014983 | exon 5 | NM_002020 | exon 23 |
| MLL-YAP1 | NM_005933 | exon 6 | NM_006106 | exon 7 |
| TMPRSS2-MX1 | NM_001135009 | exon 1 | NM_001144925 | exon 16 |
| MCFD2-ALK | NM_001171508 | exon 1 | NM_004304 | exon 20 |
| RANBP17-FGFR3 | NM_022897 | exon 28 | NM_000142 | exon 14 |
| NUMA1-ERBB4 | NM_006185 | exon 13 | NM_005235 | exon 18 |
| TPM3-NTRK1 | NM_153649 | exon 7 | NM_002529 | exon 9 |
| SNAPC4-NOTCH1 | NM_003086 | exon 1 | NM_017617 | exon 28 |
| TSC2-CREBBP | NM_001077183 | exon 35 | NM_004380 | exon 24 |
| C5orf42-ERBB4 | NM_023073 | exon 40 | NM_005235 | exon 11 |
| USP2-CBL | NM_004205 | exon 2 | NM_005188 | exon 8 |
| STK32B-ALK | NM_018401 | exon 11 | NM_004304 | exon 20 |
| FGFR2-TACC3 | NM_001144915 | exon 16 | NM_006342 | exon 11 |
| FGFR2-KIAA1598 | NM_001144915 | exon 16 | NM_001127211 | exon 7 |
| BICC1-FGFR2 | NM_001080512 | exon 2 | NM_001144915 | exon 17 |
| FGFR3-JAKMIP1 | NM_000142 | exon 17 | NM_001099433 | exon 4 |
| MASP2-MTOR | NM_006610 | exon 3 | NM_004958 | exon 9 |
| FGFR2-BICC1 | NM_001144915 | exon 16 | NM_001080512 | exon 18 |
| CD74-ROS1 | NM_004355 | exon 6 | NM_002944 | exon 33 |

FIG. 1D

| FUSION/COMPONENT | Type of Sequence | SEQ ID | FIGURE |
|---|---|---|---|
| FGFR3-TACC3 | | | |
| Fusion | Nt | 1 | 2 |
| Fusion | Aa | 2 | 2 |
| 5' partner | Nt | 3 | 3 |
| 5' partner | Aa | 4 | 4 |
| 3' partner | Nt | 5 | 5 |
| 3' partner | Aa | 6 | 6 |
| TRIM24-BRAF | | | |
| 5' partner | Nt | 7 | 7 |
| 5' partner | Aa | 8 | 8 |
| 3' partner | Nt | 9 | 9 |
| 3' partner | Aa | 10 | 10 |
| CNTLN-RAF1 | | | |
| 5' partner | Nt | 11 | 11 |
| 5' partner | Aa | 12 | 12 |
| 3' partner | Nt | 13 | 13 |
| 3' partner | Aa | 14 | 14 |
| TRIM33-RAF1 | | | |
| 5' partner | Nt | 15 | 15 |
| 5' partner | Aa | 16 | 16 |
| 3' partner | Nt | 13 | 13 |
| 3' partner | Aa | 14 | 14 |
| PDZRN3-RAF1 | | | |
| 5' partner | Nt | 17 | 17 |
| 5' partner | Aa | 18 | 18 |
| 3' partner | Nt | 13 | 13 |
| 3' partner | Aa | 14 | 14 |
| LMNA-NTRK1 | | | |
| 5' partner | Nt | 19 | 19 |
| 5' partner | Aa | 20 | 20 |
| 3' partner | Nt | 21 | 21 |
| 3' partner | Aa | 22 | 22 |
| RABGAP1L-NTRK1 | | | |
| 5' partner | Nt | 23 | 23 |
| 5' partner | Aa | 24 | 24 |
| 3' partner | Nt | 21 | 21 |
| 3' partner | Aa | 22 | 22 |

FIG. 1E

| | | | |
|---|---|---|---|
| MPRIP-NTRK1 | | | |
| 5' partner | Nt | 25 | 25 |
| 5' partner | Aa | 26 | 26 |
| 3' partner | Nt | 21 | 21 |
| 3' partner | Aa | 22 | 22 |
| TRIM33-RET | | | |
| 5' partner | Nt | 15 | 15 |
| 5' partner | Aa | 16 | 16 |
| 3' partner | Nt | 29 | 29 |
| 3' partner | Aa | 30 | 30 |
| FGFR1-NTM | | | |
| 5' partner | Nt | 31 | 31 |
| 5' partner | Aa | 32 | 32 |
| 3' partner | Nt | 33 | 33 |
| 3' partner | Aa | 34 | 34 |
| TTC23-IGF1R | | | |
| 5' partner | Nt | 35 | 35 |
| 5' partner | Aa | 36 | 36 |
| 3' partner | Nt | 37 | 37 |
| 3' partner | Aa | 38 | 38 |
| DOT1L-MYST3 (KAT6A) | | | |
| 5' partner | Nt | 39 | 39 |
| 5' partner | Aa | 40 | 40 |
| 3' partner | Nt | 41 | 41 |
| 3' partner | Aa | 42 | 42 |
| SMAD4-MYO5B | | | |
| 5' partner | Nt | 43 | 43 |
| 5' partner | Aa | 44 | 44 |
| 3' partner | Nt | 45 | 45 |
| 3' partner | Aa | 46 | 46 |
| HMGXB3-FLT4 | | | |
| 5' partner | Nt | 47 | 47 |
| 5' partner | Aa | 48 | 48 |
| 3' partner | Nt | 49 | 49 |
| 3' partner | Aa | 50 | 50 |
| MLL-YAP1 | | | |
| 5' partner | Nt | 51 | 51 |
| 5' partner | Aa | 52 | 52 |
| 3' partner | Nt | 53 | 53 |
| 3' partner | Aa | 54 | 54 |

FIG. 1F

| TMPRSS2-MX1 | | | |
|---|---|---|---|
| 5' partner | Nt | 55 | 55 |
| 5' partner | Aa | 56 | 56 |
| 3' partner | Nt | 57 | 57 |
| 3' partner | Aa | 58 | 58 |
| MCFD2-ALK | | | |
| 5' partner | Nt | 59 | 59 |
| 5' partner | Aa | 60 | 60 |
| 3' partner | Nt | 61 | 61 |
| 3' partner | Aa | 62 | 62 |
| RANBP17-FGFR3 | | | |
| 5' partner | Nt | 63 | 63 |
| 5' partner | Aa | 64 | 64 |
| 3' partner | Nt | 3 | 3 |
| 3' partner | Aa | 4 | 4 |
| NUMA1-ERBB4 | | | |
| 5' partner | Nt | 65 | 65 |
| 5' partner | Aa | 66 | 66 |
| 3' partner | Nt | 27 | 27 |
| 3' partner | Aa | 28 | 28 |
| TPM3-NTRK1 | | | |
| Fusion | Nt | 67 | 67 |
| Fusion | Aa | 68 | 67 |
| 5' partner | Nt | 69 | 68 |
| 5' partner | Aa | 70 | 69 |
| 3' partner | Nt | 21 | 21 |
| 3' partner | Aa | 22 | 22 |
| SNAPC4-NOTCH1 | | | |
| Fusion | Nt | 71 | 70 |
| Fusion | Aa | 72 | 70 |
| 5' partner | Nt | 73 | 71 |
| 5' partner | Aa | 74 | 72 |
| 3' partner | Nt | 75 | 73 |
| 3' partner | Aa | 76 | 74 |
| TSC2-CREBBP | | | |
| Fusion | Nt | 77 | 75 |
| Fusion | Aa | 78 | 75 |
| 5' partner | Nt | 79 | 76 |
| 5' partner | Aa | 80 | 77 |
| 3' partner | Nt | 81 | 78 |

FIG. 1G

| | | | |
|---|---|---|---|
| 3' partner | Aa | 82 | 79 |
| C5orf42-ERBB4 | | | |
| Fusion | Nt | 83 | 80 |
| Fusion | Aa | 84 | 80 |
| 5' partner | Nt | 85 | 81 |
| 5' partner | Aa | 86 | 82 |
| 3' partner | Nt | 27 | 27 |
| 3' partner | Aa | 28 | 28 |
| USP2-CBL | | | |
| Fusion | Nt | 87 | 83 |
| Fusion | Aa | 88 | 83 |
| 5' partner | Nt | 89 | 84 |
| 5' partner | Aa | 90 | 85 |
| 3' partner | Nt | 91 | 86 |
| 3' partner | Aa | 92 | 87 |
| STK32B-ALK | | | |
| Fusion | Nt | 93, 127 | 88 |
| Fusion | Aa | 94, 128 | 88 |
| 5' partner | Nt | 95 | 89 |
| 5' partner | Aa | 96 | 90 |
| 3' partner | Nt | 61 | 61 |
| 3' partner | Aa | 62 | 62 |
| FGFR2-TACC3 | | | |
| Fusion | Nt | 97 | 91 |
| Fusion | Aa | 98 | 81 |
| 5' partner | Nt | 99 | 92 |
| 5' partner | Aa | 100 | 93 |
| 3' partner | Nt | 5 | 5 |
| 3' partner | Aa | 6 | 6 |
| FGFR2-KIAA1598 | | | |
| Fusion | Nt | 101 | 94 |
| Fusion | Aa | 102 | 94 |
| 5' partner | Nt | 99 | 92 |
| 5' partner | Aa | 100 | 93 |
| 3' partner | Nt | 103 | 95 |
| 3' partner | Aa | 104 | 96 |
| BICC1-FGFR2 | | | |
| Fusion | Nt | 105 | 97 |
| Fusion | Aa | 106 | 97 |

FIG. 1H

| 5' partner | Nt | 107 | 98 |
|---|---|---|---|
| 5' partner | Aa | 108 | 99 |
| 3' partner | Nt | 99 | 92 |
| 3' partner | Aa | 100 | 93 |
| FGFR3-JAKMIP1 | | | |
| Fusion | Nt | 109 | 100 |
| Fusion | Aa | 110 | 100 |
| 5' partner | Nt | 3 | 3 |
| 5' partner | Aa | 4 | 4 |
| 3' partner | Nt | 111 | 101 |
| 3' partner | Aa | 112 | 102 |
| MASP2-MTOR | | | |
| Fusion | Nt | 113 | 103 |
| Fusion | Aa | 114 | 103 |
| 5' partner | Nt | 115 | 104 |
| 5' partner | Aa | 116 | 105 |
| 3' partner | Nt | 117 | 106 |
| 3' partner | Aa | 118 | 107 |
| FGFR2-BICC1 | | | |
| Fusion | Nt | 119 | 108 |
| Fusion | Aa | 120 | 108 |
| 5' partner | Nt | 99 | 92 |
| 5' partner | Aa | 100 | 93 |
| 3' partner | Nt | 107 | 98 |
| 3' partner | Aa | 108 | 99 |
| CD74-ROS1 | | | |
| Fusion | Nt | 121 | 109 |
| Fusion | Aa | 122 | 109 |
| 5' partner | Nt | 123 | 110 |
| 5' partner | Aa | 124 | 111 |
| 3' partner | Nt | 125 | 112 |
| 3' partner | Aa | 126 | 113 |

FIG. 2A

```
atgggcgcccctgcctgcgccctcgcgctctgcgtggccgtggccatcgtggccggcgcc    60
 M  G  A  P  A  C  A  L  A  L  C  V  A  V  A  I  V  A  G  A     20 tcctcggagtccttggggacggagcagcgcgtcgtggggcgagcggcagaagtcccgggc   120
 S  S  E  S  L  G  T  E  Q  R  V  V  G  R  A  A  E  V  P  G     40 ccagagcccggccagcaggagcagttggtcttcggcagcggggatgctgtggagctgagc   180
 P  E  P  G  Q  Q  E  Q  L  V  F  G  S  G  D  A  V  E  L  S     60 tgtcccccgcccgggggtggtcccatggggcccactgtctgggtcaaggatggcacaggg   240
 C  P  P  P  G  G  G  P  M  G  P  T  V  W  V  K  D  G  T  G     80 ctggtgccctcggagcgtgtcctggtggggccccagcggctgcaggtgctgaatgcctcc   300
 L  V  P  S  E  R  V  L  V  G  P  Q  R  L  Q  V  L  N  A  S    100 cacgaggactccggggcctacagctgccggcagcggctcacgcagcgcgtactgtgccac   360
 H  E  D  S  G  A  Y  S  C  R  Q  R  L  T  Q  R  V  L  C  H    120 ttcagtgtgcgggtgacagacgctccatcctcgggagatgacgaagacggggaggacgag   420
 F  S  V  R  V  T  D  A  P  S  S  G  D  D  E  D  G  E  D  E    140 gctgaggacacaggtgtggacacaggggccccttactggacacggcccgagcggatggac   480
 A  E  D  T  G  V  D  T  G  A  P  Y  W  T  R  P  E  R  M  D    160 aagaagctgctggccgtgccggccgccaacaccgtccgcttccgctgcccagccgctggc   540
 K  K  L  L  A  V  P  A  A  N  T  V  R  F  R  C  P  A  A  G    180 aaccccactccctccatctcctggctgaagaacggcagggagttccgcggcgagcaccgc   600
 N  P  T  P  S  I  S  W  L  K  N  G  R  E  F  R  G  E  H  R    200 attggaggcatcaagctgcggcatcagcagtggagcctggtcatggaaagcgtggtgccc   660
 I  G  G  I  K  L  R  H  Q  Q  W  S  L  V  M  E  S  V  V  P    220 tcggaccgcggcaactacacctgcgtcgtggagaacaagtttggcagcatccggcagacg   720
 S  D  R  G  N  Y  T  C  V  V  E  N  K  F  G  S  I  R  Q  T    240 tacacgctggacgtgctggagcgctccccgcaccggcccatcctgcaggcggggctgccg   780
 Y  T  L  D  V  L  E  R  S  P  H  R  P  I  L  Q  A  G  L  P    260 gccaaccagacggcggtgctgggcagcgacgtggagttccactgcaaggtgtacagtgac   840
 A  N  Q  T  A  V  L  G  S  D  V  E  F  H  C  K  V  Y  S  D    280 gcacagccccacatccagtggctcaagcacgtggaggtgaatggcagcaaggtgggcccg   900
 A  Q  P  H  I  Q  W  L  K  H  V  E  V  N  G  S  K  V  G  P    300 gacggcacaccctacgttaccgtgctcaagacggcgggcgctaacaccaccgacaaggag   960
 D  G  T  P  Y  V  T  V  L  K  T  A  G  A  N  T  T  D  K  E    320 ctagaggttctctccttgcacaacgtcacctttgaggacgccggggagtacacctgcctg  1020
 L  E  V  L  S  L  H  N  V  T  F  E  D  A  G  E  Y  T  C  L    340
```

FIG. 2B

```
gcgggcaattctattgggttttctcatcactctgcgtggctggtggtgctgccagccgag 1080
 A  G  N  S  I  G  F  S  H  H  S  A  W  L  V  V  L  P  A  E   360 gaggagctggtggaggctgacgaggcgggcagtgtgtatgcaggcatcctcagctacggg 1140
 E  E  L  V  E  A  D  E  A  G  S  V  Y  A  G  I  L  S  Y  G   380 gtgggcttcttcctgttcatcctggtggtggcggctgtgacgctctgccgcctgcgcagc 1200
 V  G  F  F  L  F  I  L  V  V  A  A  V  T  L  C  R  L  R  S   400 cccccaagaaaggcctgggctcccccaccgtgcacaagatctcccgcttcccgctcaag 1260
 P  P  K  K  G  L  G  S  P  T  V  H  K  I  S  R  F  P  L  K   420 cgacaggtgtccctggagtccaacgcgtccatgagctccaacacaccactggtgcgcatc 1320
 R  Q  V  S  L  E  S  N  A  S  M  S  S  N  T  P  L  V  R  I   440 gcaaggctgtcctcaggggagggccccacgctggccaatgtctccgagctcgagctgcct 1380
 A  R  L  S  S  G  E  G  P  T  L  A  N  V  S  E  L  E  L  P   460 gccgaccccaaatgggagctgtctcgggcccggctgaccctgggcaagccccttggggag 1440
 A  D  P  K  W  E  L  S  R  A  R  L  T  L  G  K  P  L  G  E   480 ggctgcttcggccaggtggtcatggcggaggccatcggcattgacaaggaccgggccgcc 1500
 G  C  F  G  Q  V  V  M  A  E  A  I  G  I  D  K  D  R  A  A   500 aagcctgtcaccgtagccgtgaagatgctgaaagacgatgccactgacaaggacctgtcg 1560
 K  P  V  T  V  A  V  K  M  L  K  D  D  A  T  D  K  D  L  S   520 gacctggtgtctgagatggagatgatgaagatgatcgggaaacacaaaaacatcatcaac 1620
 D  L  V  S  E  M  E  M  M  K  M  I  G  K  H  K  N  I  I  N   540 ctgctgggcgcctgcacgcagggcgggcccctgtacgtgctggtggagtacgcggccaag 1680
 L  L  G  A  C  T  Q  G  G  P  L  Y  V  L  V  E  Y  A  A  K   560 ggtaacctgcgggagtttctgcgggcgcggcggccccccgggcctggactactccttcgac 1740
 G  N  L  R  E  F  L  R  A  R  R  P  P  G  L  D  Y  S  F  D   580 acctgcaagccgccccgaggagcagctcaccttcaaggacctggtgtcctgtgcctaccag 1800
 T  C  K  P  P  E  E  Q  L  T  F  K  D  L  V  S  C  A  Y  Q   600 gtggcccggggcatggagtacttggcctcccagaagtgcatccacagggacctggctgcc 1860
 V  A  R  G  M  E  Y  L  A  S  Q  K  C  I  H  R  D  L  A  A   620 cgcaatgtgctggtgaccgaggacaacgtgatgaagatcgcagacttcgggctggcccgg 1920
 R  N  V  L  V  T  E  D  N  V  M  K  I  A  D  F  G  L  A  R   640 gacgtgcacaacctcgactactacaagaagacaaccaacggccggctgcccgtgaagtgg 1980
 D  V  H  N  L  D  Y  Y  K  K  T  T  N  G  R  L  P  V  K  W   660 atggcgcctgaggccttgtttgaccgagtctacactcaccagagtgacgtctggtccttt 2040
 M  A  P  E  A  L  F  D  R  V  Y  T  H  Q  S  D  V  W  S  F   680
```

FIG. 2C

```
ggggtcctgctctgggagatcttcacgctggggggctccccgtaccccggcatccctgtg 2100
 G   V   L   L   W   E   I   F   T   L   G   G   S   P   Y   P   G   I   P   V     700 gaggagctcttcaagctgctgaaggagggccaccgcatggacaagcccgccaactgcaca 2160
 E   E   L   F   K   L   L   K   E   G   H   R   M   D   K   P   A   N   C   T     720 cacgacctgtacatgatcatgcgggagtgctggcatgccgcgccctcccagaggcccacc 2220
 H   D   L   Y   M   I   M   R   E   C   W   H   A   A   P   S   Q   R   P   T     740 ttcaagcagctggtggaggacctggaccgtgtccttaccgtgacgtccaccgactttaag 2280
 F   K   Q   L   V   E   D   L   D   R   V   L   T   V   T   S   T   D   F   K     760 gagtcggccttgaggaagcagtccttatacctcaagttcgacccccctcctgagggacagt 2340
 E   S   A   L   R   K   Q   S   L   Y   L   K   F   D   P   L   L   R   D   S     780 cctggtagaccagtgcccgtggccaccgagaccagcagcatgcacggtgcaaatgagact 2400
 P   G   R   P   V   P   V   A   T   E   T   S   S   M   H   G   A   N   E   T     800 ccctcaggacgtccgcgggaagccaagcttgtggagttcgatttcttgggagcactggac 2460
 P   S   G   R   P   R   E   A   K   L   V   E   F   D   F   L   G   A   L   D     820 attcctgtgccaggcccacccccaggtgttcccgcgcctgggggcccacccctgtccacc 2520
 I   P   V   P   G   P   P   P   G   V   P   A   P   G   G   P   P   L   S   T     840 ggacctatagtggacctgctccagtacagccagaaggacctggatgcagtggtaaaggcg 2580
 G   P   I   V   D   L   L   Q   Y   S   Q   K   D   L   D   A   V   V   K   A     860 acacaggaggagaaccgggagctgaggagcaggtgtgaggagctccacgggaagaacctg 2640
 T   Q   E   E   N   R   E   L   R   S   R   C   E   E   L   H   G   K   N   L     880 gaactggggaagatcatggacaggttcgaagaggttgtgtaccaggccatggaggaagtt 2700
 E   L   G   K   I   M   D   R   F   E   E   V   V   Y   Q   A   M   E   E   V     900 cagaagcagaaggaactttccaaagctgaaatccagaaagttctaaaagaaaaagaccaa 2760
 Q   K   Q   K   E   L   S   K   A   E   I   Q   K   V   L   K   E   K   D   Q     920 cttaccacagatctgaactccatggagaagtccttctccgacctcttcaagcgttttgag 2820
 L   T   T   D   L   N   S   M   E   K   S   F   S   D   L   F   K   R   F   E     940 aaacagaaagaggtgatcgagggctaccgcaagaacgaagagtcactgaagaagtgcgtg 2880
 K   Q   K   E   V   I   E   G   Y   R   K   N   E   E   S   L   K   K   C   V     960 gaggattacctggcaaggatcacccaggagggccagaggtaccaagccctgaaggcccac 2940
 E   D   Y   L   A   R   I   T   Q   E   G   Q   R   Y   Q   A   L   K   A   H     980 gcggaggagaagctgcagctggcaaacgaggagatcgcccaggtccggagcaaggcccag 3000
 A   E   E   K   L   Q   L   A   N   E   E   I   A   Q   V   R   S   K   A   Q    1000 gcggaagcgttggccctccaggccagcctgaggaaggagcagatgcgcatccagtcgctg 3060
 A   E   A   L   A   L   Q   A   S   L   R   K   E   Q   M   R   I   Q   S   L    1020
```

FIG. 2D

```
gagaagacagtggagcagaagactaaagagaacgaggagctgaccaggatctgcgacgac 3120
 E   K   T   V   E   Q   K   T   K   E   N   E   E   L   T   R   I   C   D   D  1040 ctcatctccaagatggagaagatctga 3147 (SEQ ID NO: 1)
 L   I   S   K   M   E   K   I   -  1049 (SEQ ID NO: 2)
```

FIG. 3A

```
GTCGCGGGCA GCTGGCGCCG CGCGGTCCTG CTCTGCCGGT CGCACGGACG  50
CACCGGCGGG CCGCCGGCCG GAGGGACGGG GCGGGAGCTG GGCCCGCGGA  100
CAGCGAGCCG GAGCGGGAGC CGCGCGTAGC GAGCCGGGCT CCGGCGCTCG  150
CCAGTCTCCC GAGCGGCGCC CGCCTCCCGC CGGTGCCCGC GCCGGGCCGT  200
GGGGGGCAGC ATGCCCGCGC GCGCTGCCTG AGGACGCCGC GGCCCCCGCC  250
CCCGCCATGG GCGCCCCTGC CTGCGCCCTC GCGCTCTGCG TGGCCGTGGC  300
CATCGTGGCC GGCGCCTCCT CGGAGTCCTT GGGGACGGAG CAGCGCGTCG  350
TGGGGCGAGC GGCAGAAGTC CCGGGCCCAG AGCCCGGCCA GCAGGAGCAG  400
TTGGTCTTCG GCAGCGGGGA TGCTGTGGAG CTGAGCTGTC CCCCGCCCGG  450
GGGTGGTCCC ATGGGCCCA CTGTCTGGGT CAAGGATGGC ACAGGGCTGG  500
TGCCCTCGGA GCGTGTCCTG GTGGGGCCCC AGCGGCTGCA GGTGCTGAAT  550
GCCTCCCACG AGGACTCCGG GGCCTACAGC TGCCGGCAGC GGCTCACGCA  600
GCGCGTACTG TGCCACTTCA GTGTGCGGGT GACAGACGCT CCATCCTCGG  650
GAGATGACGA AGACGGGGAG GACGAGGCTG AGGACACAGG TGTGGACACA  700
GGGGCCCCTT ACTGGACACG GCCCGAGCGG ATGGACAAGA AGCTGCTGGC  750
CGTGCCGGCC GCCAACACCG TCCGCTTCCG CTGCCCAGCC GCTGGCAACC  800
CCACTCCCTC CATCTCCTGG CTGAAGAACG GCAGGGAGTT CCGCGGCGAG  850
CACCGCATTG GAGGCATCAA GCTGCGGCAT CAGCAGTGGA GCCTGGTCAT  900
GGAAAGCGTG GTGCCCTCGG ACCGCGGCAA CTACACCTGC GTCGTGGAGA  950
ACAAGTTTGG CAGCATCCGG CAGACGTACA CGCTGGACGT GCTGGAGCGC  1000
TCCCCGCACC GGCCCATCCT GCAGGCGGGG CTGCCGGCCA ACCAGACGGC  1050
GGTGCTGGGC AGCGACGTGG AGTTCCACTG CAAGGTGTAC AGTGACGCAC  1100
AGCCCCACAT CCAGTGGCTC AAGCACGTGG AGGTGAATGG CAGCAAGGTG  1150
GGCCCGGACG GCACACCCTA CGTTACCGTG CTCAAGACGG CGGGCGCTAA  1200
CACCACCGAC AAGGAGCTAG AGGTTCTCTC CTTGCACAAC GTCACCTTTG  1250
AGGACGCCGG GGAGTACACC TGCCTGGCGG GCAATTCTAT TGGGTTTTCT  1300
CATCACTCTG CGTGGCTGGT GGTGCTGCCA GCCGAGGAGG AGCTGGTGGA  1350
GGCTGACGAG GCGGGCAGTG TGTATGCAGG CATCCTCAGC TACGGGGTGG  1400
GCTTCTTCCT GTTCATCCTG GTGGTGGCGG CTGTGACGCT CTGCCGCCTG  1450
CGCAGCCCCC CCAAGAAAGG CCTGGGCTCC CCCACCGTGC ACAAGATCTC  1500
CCGCTTCCCG CTCAAGCGAC AGGTGTCCCT GGAGTCCAAC GCGTCCATGA  1550
GCTCCAACAC ACCACTGGTG CGCATCGCAA GGCTGTCCTC AGGGGAGGGC  1600
CCCACGCTGG CCAATGTCTC CGAGCTCGAG CTGCCTGCCG ACCCCAAATG  1650
GGAGCTGTCT CGGGCCCGGC TGACCCTGGG CAAGCCCCTT GGGGAGGGCT  1700
GCTTCGGCCA GGTGGTCATG GCGGAGGCCA TCGGCATTGA CAAGGACCGG  1750
GCCGCCAAGC CTGTCACCGT AGCCGTGAAG ATGCTGAAAG ACGATGCCAC  1800
TGACAAGGAC CTGTCGGACC TGGTGTCTGA GATGGAGATG ATGAAGATGA  1850
TCGGGAAACA CAAAAACATC ATCAACCTGC TGGGCGCCTG CACGCAGGGC  1900
GGGCCCCTGT ACGTGCTGGT GGAGTACGCG GCCAAGGGTA ACCTGCGGGA  1950
GTTTCTGCGG GCGCGGCGGC CCCCGGGCCT GGACTACTCC TTCGACACCT  2000
GCAAGCCGCC CGAGGAGCAG CTCACCTTCA AGGACCTGGT GTCCTGTGCC  2050
TACCAGGTGG CCCGGGGCAT GGAGTACTTG GCCTCCCAGA AGTGCATCCA  2100
CAGGGACCTG GCTGCCCGCA ATGTGCTGGT GACCGAGGAC AACGTGATGA  2150
AGATCGCAGA CTTCGGGCTG GCCCGGGACG TGCACAACCT CGACTACTAC  2200
AAGAAGACaA CCAACGGCCG GCTGCCCGTG AAGTGGATGG CGCCTGAGGC  2250
CTTGTTTGAC CGAGTCTACA CTCACCAGAG TGACGTCTGG TCCTTTGGGG  2300
TCCTGCTCTG GGAGATCTTC ACGCTGGGGG CTCCCCGTA CCCCGGCATC  2350
CCTGTGGAGG AGCTCTTCAA GCTGCTGAAG GAGGGCCACC GCATGGACAA  2400
GCCCGCCAAC TGCACACACG ACCTGTACAT GATCATGCGG GAGTGCTGGC  2450
ATGCCGCGCC CTCCCAGAGG CCCACCTTCA AGCAGCTGGT GGAGGACCTG  2500
GACCGTGTCC TTACCGTGAC GTCCACCGAC GAGTACCTGG ACCTGTCGGC  2550
GCCTTTCGAG CAGTACTCCC CGGGTGGCCA GGACACCCCC AGCTCCAGCT  2600
```

FIG. 3B

```
CCTCAGGGGA CGACTCCGTG TTTGCCCACG ACCTGCTGCC CCCGGCCCCA  2650
CCCAGCAGTG GGGGCTCGCG GACGTGAAGG GCCACTGGTC CCCAACAATG  2700
TGAGGGGTCC CTAGCAGCCC ACCCTGCTGC TGGTGCACAG CCACTCCCCG  2750
GCATGAGACT CAGTGCAGAT GGAGAGACAG CTACACAGAG CTTTGGTCTG  2800
TGTGTGTGTG TGTGCGTGTG TGTGTGTGTG TGTGCACATC CGCGTGTGCC  2850
TGTGTGCGTG CGCATCTTGC CTCCAGGTGC AGAGGTACCC TGGGTGTCCC  2900
CGCTGCTGTG CAACGGTCTC CTGACTGGTG CTGCAGCACC GAGGGGCCTT  2950
TGTTCTGGGG GGACCCAGTG CAGAATGTAA GTGGGCCCAC CCGGTGGGAC  3000
CCCCGTGGGG CAGGGAGCTG GGCCCGACAT GGCTCCGGCC TCTGCCTTTG  3050
CACCACGGGA CATCACAGGG TGGGCCTCGG CCCCTCCCAC ACCCAAAGCT  3100
GAGCCTGCAG GGAAGCCCCA CATGTCCAGC ACCTTGTGCC TGGGGTGTTA  3150
GTGGCACCGC CTCCCCACCT CCAGGCTTTC CCACTTCCCA CCCTGCCCCT  3200
CAGAGACTGA AATTACGGGT ACCTGAAGAT GGGAGCCTTT ACCTTTTATG  3250
CAAAAGGTTT ATTCCGGAAA CTAGTGTACA TTTCTATAAA TAGATGCTGT  3300
GTATATGGTA TATATACATA TATATATATA ACATATATGG AAGAGGAAAA  3350
GGCTGGTACA ACGGAGGCCT GCGACCCTGG GGGCACAGGA GGCAGGCATG  3400
GCCCTGGGCG GGGCGTGGGG GGGCGTGGAG GGAGGCCCCA GGGGGTCTCA  3450
CCCATGCAAG CAGAGGACCA GGGCCTTTTC TGGCACCGCA GTTTTGTTTT  3500
AAAACTGGAC CTGTATATTT GTAAAGCTAT TTATGGGCCC CTGGCACTCT  3550
TGTTCCCACA CCCCAACACT TCCAGCATTT AGCTGGCCAC ATGGCGGAGA  3600
GTTTTAATTT TTAACTTATT GACAACCGAG AAGGTTTATC CCGCCGATAG  3650
AGGGACGGCC AAGAATGTAC GTCCAGCCTG CCCCGGAGCT GGAGGATCCC  3700
CTCCAAGCCT AAAAGGTTGT TAATAGTTGG AGGTGATTCC AGTGAAGATA  3750
TTTTATTTCC TTTGTCCTTT TTCAGGAGAA TTAGATTTCT ATAGGATTTT  3800
TCTTTAGGAG ATTTATTTTT TGGACTTCAA AGCAAGCTGG TATTTTCATA  3850
CAAATTCTTC TAATTGCTGT GTGTCCCAGG CAGGGAGACG GTTTCCAGGG  3900
AGGGGCCGGC CCTGTGTGCA GGTTCCGATG TTATTAGATG TTACAAGTTT  3950
ATATATATCT ATATATATAA TTTATTGAGT TTTTACAAGA TGTATTTGTT  4000
GTAGACTTAA CACTTCTTAC GCAATGCTTC TAGAGTTTTA TAGCCTGGAC  4050
TGCTACCTTT CAAAGCTTGG AGGGAAGCCG TGAATTCAGT TGGTTCGTTC  4100
TGTACTGTTA CTGGGCCCTG AGTCTGGGCA GCTGTCCCTT GCTTGCCTGC  4150
AGGGCCATGG CTCAGGGTGG TCTCTTCTTG GGGCCCAGTG CATGGTGGCC  4200
AGAGGTGTCA CCCAAACCGG CAGGTGCGAT TTTGTTAACC CAGCGACGAA  4250
CTTTCCGAAA AATAAAGACA CCTGGTTGCT AACCTGGaaa aaaaaaaaa  4300
aaaa (SEQ ID NO: 3)
```

FIG. 4

```
MGAPACALALCVAVAIVAGASSESLGTEQRVVGRAAEVPGPEPGQQEQLVFGSGDAVELS
CPPPGGGPMGPTVWVKDGTGLVPSERVLVGPQRLQVLNASHEDSGAYSCRQRLTQRVLCH
FSVRVTDAPSSGDDEDGEDEAEDTGVDTGAPYWTRPERMDKKLLAVPAANTVRFRCPAAG
NPTPSISWLKNGREFRGEHRIGGIKLRHQQWSLVMESVVPSDRGNYTCVVENKFGSIRQT
YTLDVLERSPHRPILQAGLPANQTAVLGSDVEFHCKVYSDAQPHIQWLKHVEVNGSKVGP
DGTPYVTVLKTAGANTTDKELEVLSLHNVTFEDAGEYTCLAGNSIGFSHHSAWLVVLPAE
EELVEADEAGSVYAGILSYGVGFFLFILVVAAVTLCRLRSPPKKGLGSPTVHKISRFPLK
RQVSLESNASMSSNTPLVRIARLSSGEGPTLANVSELELPADPKWELSRARLTLGKPLGE
GCFGQVVMAEAIGIDKDRAAKPVTVAVKMLKDDATDKDLSDLVSEMEMMKMIGKHKNIIN
LLGACTQGGPLYVLVEYAAKGNLREFLRARRPPGLDYSFDTCKPPEEQLTFKDLVSCAYQ
VARGMEYLASQKCIHRDLAARNVLTEDNVMKIADFGLARDVHNLDYYKKTTNGRLPVKW
MAPEALFDRVYTHQSDVWSFGVLLWEIFTLGGSPYPGIPVEELFKLLKEGHRMDKPANCT
HDLYMIMRECWHAAPSQRPTFKQLVEDLDRVLTVTSTDEYLDLSAPFEQYSPGGQDTPSS
SSSGDDSVFAHDLLPPAPPSSGGSRT- (SEQ ID NO: 4)
```

FIG. 5A

```
GCGTTTGAAA CTCCGGCGCG CCGGCGGCCA TCAAGGGCTA GAAGCGCGAC  50
GGCGGTAGCA GCTAGGCTTG GCCCCGGCG TGGAGCAGAC GCGGACCCCT  100
CCTTCCTGGC GGCGGCGGCG CGGGCTCAGA GCCCGGCAAC GGGCGGGCGG  150
GCAGAATGAG TCTGCAGGTC TTAAACGACA AAAATGTCAG CAATGAAAAA  200
AATACAGAAA ATTGCGACTT CCTGTTTTCG CCACCAGAAG TTACCGGAAG  250
ATCGTCTGTT CTTCGTGTGT CACAGAAAGA AAATGTGCCA CCCAAGAACC  300
TGGCCAAAGC TATGAAGGTG ACTTTTCAGA CACCTCTGCG GGATCCACAG  350
ACGCACAGGA TTCTAAGTCC TAGCATGGCC AGCAAACTTG AGGCTCCTTT  400
CACTCAGGAT GACACCCTTG GACTGGAAAA CTCACACCCG GTCTGGACAC  450
AGAAAGAGAA CCAACAGCTC ATCAAGGAAG TGGATGCCAA AACTACTCAT  500
GGAATTCTAC AGAAACCAGT GGAGGCTGAC ACCGACCTCC TGGGGATGC   550
AAGCCCAGCC TTTGGGAGTG GCAGCTCCAG CGAGTCTGGC CCAGGTGCCC  600
TGGCTGACCT GGACTGCTCA AGCTCTTCCC AGAGCCCAGG AAGTTCTGAG  650
AACCAAATGG TGTCTCCAGG AAAAGTGTCT GGCAGCCCTG AGCAAGCCGT  700
GGAGGAAAAC CTTAGTTCCT ATTCCTTAGA CAGAAGAGTG ACACCCGCCT  750
CTGAGACCCT AGAAGACCCT TGCAGGACAG AGTCCCAGCA CAAAGCGGAG  800
ACTCCGCACG GAGCCGAGGA AGAATGCAAA GCGGAGACTC CGCACGGAGC  850
CGAGGAGGAA TGCCGGCACG GTGGGGTCTG TGCTCCCGCA GCAGTGGCCA  900
CTTCGCCTCC TGGTGCAATC CCTAAGGAAG CCTGCGGAGG AGCACCCCTG  950
CAGGGTCTGC CTGGCGAAGC CCTGGGCTGC CCTGCGGGTG TGGGCACCCC  1000
CGTGCCAGCA GATGGCACTC AGACCCTTAC CTGTGCACAC ACCTCTGCTC  1050
CTGAGAGCAC AGCCCCAACC AACCACCTGG TGGCTGGCAG GGCCATGACC  1100
CTGAGTCCTC AGGAAGAAGT GGCTGCAGGC CAAATGGCCA GCTCCTCGAG  1150
GAGCGGACCT GTAAAACTAG AATTTGATGT ATCTGATGGC GCCACCAGCA  1200
AAAGGGCACC CCCACCAAGG AGACTGGGAG AGAGGTCCGG CCTCAAGCCT  1250
CCCTTGAGGA AAGCAGCAGT GAGGCAGCAA AAGGCCCCGC AGGAGGTGGA  1300
GGAGGACGAC GGTAGGAGCG GAGCAGGAGA GGACCCCCC ATGCCAGCTT   1350
CTCGGGGCTC TTACCACCTC GACTGGGACA AAATGGATGA CCCAAACTTC  1400
ATCCCGTTCG GAGGTGACAC CAAGTCTGGT TGCAGTGAGG CCCAGCCCCC  1450
AGAAAGCCCT GAGACCAGGC TGGGCCAGCC AGCGGCTGAA CAGTTGCATG  1500
CTGGGCCTGC CACGGAGGAG CCAGGTCCCT GTCTGAGCCA GCAGCTGCAT  1550
TCAGCCTCAG CGGAGGACAC GCCTGTGGTG CAGTTGGCAG CCGAGACCCC  1600
AACAGCAGAG AGCAAGGAGA GAGCCTTGAA CTCTGCCAGC ACCTCGCTTC  1650
CCACAAGCTG TCCAGGCAGT GAGCCAGTGC CCACCCATCA GCAGGGGCAG  1700
CCTGCCTTGG AGCTGAAAGA GGAGAGCTTC AGAGACCCCG CTGAGGTTCT  1750
AGGCACGGGC GCGGAGGTGG ATTACCTGGA GCAGTTTGGA ACTTCCTCGT  1800
TTAAGGAGTC GGCCTTGAGG AAGCAGTCCT TATACCTCAA GTTCGACCCC  1850
CTCCTGAGGG ACAGTCCTGG TAGACCAGTG CCCGTGGCCA CCGAGACCAG  1900
CAGCATGCAC GGTGCAAATG AGACTCCCTC AGGACGTCCG CGGGAAGCCA  1950
AGCTTGTGGA GTTCGATTTC TTGGGAGCAC TGGACATTCC TGTGCCAGGC  2000
CCACCCCCAG GTGTTCCCGC GCCTGGGGGC CCACCCCTGT CCACCGGACC  2050
TATAGTGGAC CTGCTCCAGT ACAGCCAGAA GGACCTGGAT GCAGTGGTAA  2100
AGGCGACACA GGAGGAGAAC CGGGAGCTGA GGAGCAGGTG TGAGGAGCTC  2150
CACGGGAAGA ACCTGGAACT GGGGAAGATC ATGGACAGGT TCGAAGAGGT  2200
TGTGTACCAG GCCATGGAGG AAGTTCAGAA GCAGAAGGAA CTTTCCAAAG  2250
CTGAAATCCA GAAAGTTCTA AAAGAAAAAG ACCAACTTAC CACAGATCTG  2300
AACTCCATGG AGAAGTCCTT CTCCGACCTC TTCAAGCGTT TTGAGAAACA  2350
GAAAGAGGTG ATCGAGGGCT ACCGCAAGAA CGAAGAGTCA CTGAAGAAGT  2400
GCGTGGAGGA TTACCTGGCA AGGATCACCC AGGAGGGCCA GAGGTACCAA  2450
GCCCTGAAGG CCCACGCGGA GGAGAAGCTG CAGCTGGCAA ACGAGGAGAT  2500
CGCCCAGGTC CGGAGCAAGG CCCAGGCGGA AGCGTTGGCC CTCCAGGCCA  2550
GCCTGAGGAA GGAGCAGATG CGCATCCAGT CGCTGGAGAA GACAGTGGAG  2600
```

FIG. 5B

```
CAGAAGACTA AAGAGAACGA GGAGCTGACC AGGATCTGCG ACGACCTCAT  2650
CTCCAAGATG GAGAAGATCT GACCTCCACG GAGCCGCTGT CCCCGCCCCC  2700
CTGCTCCCGT CTGTCTGTCC TGTCTGATTC TCTTAGGTGT CATGTTCTTT  2750
TTTCTGTCTT GTCTTCAACT TTTTAAAAA CTAGATTGCT TTGAAAACAT  2800
GACTCAATAA AAGTTTCCTT TCAATTTAAA CACTGAAaaa aaaaaaa
(SEQ ID NO: 5)
```

FIG. 6

```
MSLQVLNDKNVSNEKNTENCDFLFSPPEVTGRSSVLRVSQKENVPPKNLAKAMKVTFQTP
LRDPQTHRILSPSMASKLEAPFTQDDTLGLENSHPVWTQKENQQLIKEVDAKTTHGILQK
PVEADTDLLGDASPAFGSGSSSESGPGALADLDCSSSSQSPGSSENQMVSPGKVSGSPEQ
AVEENLSSYSLDRRVTPASETLEDPCRTESQHKAETPHGAEEECKAETPHGAEEECRHGG
VCAPAAVATSPPGAIPKEACGGAPLQGLPGEALGCPAGVGTPVPADGTQTLTCAHTSAPE
STAPTNHLVAGRAMTLSPQEEVAAGQMASSSRSGPVKLEFDVSDGATSKRAPPPRRLGER
SGLKPPLRKAAVRQQKAPQEVEEDDGRSGAGEDPPMPASRGSYHLDWDKMDDPNFIPFGG
DTKSGCSEAQPPESPETRLGQPAAEQLHAGPATEEPGPCLSQQLHSASAEDTPVVQLAAE
TPTAESKERALNSASTSLPTSCPGSEPVPTHQQGQPALELKEESFRDPAEVLGTGAEVDY
LEQFGTSSFKESALRKQSLYLKFDPLLRDSPGRPVPVATETSSMHGANETPSGRPREAKL
VEFDFLGALDIPVPGPPPGVPAPGGPPLSTGPIVDLLQYSQKDLDAVVKATQEENRELRS
RCEELHGKNLELGKIMDRFEEVVYQAMEEVQKQKELSKAEIQKVLKEKDQLTTDLNSMEK
SFSDLFKRFEKQKEVIEGYRKNEESLKKCVEDYLARITQEGQRYQALKAHAEEKLQLANE
EIAQVRSKAQAEALALQASLRKEQMRIQSLEKTVEQKTKENEELTRICDDLISKMEKI-
(SEQ ID NO: 6)
```

FIG. 7A

```
GACAGATACC CTCCTTCCGG CCGCGCCACT CGGGAGGCGG ATCCCGTGGG  50
CCTGAGGAGG CTTCCCCCGC CCGGTTTGCT TTCCCTCCCT CGCTGGCGCT  100
GCCGCGAGTC CACCGAGCGG CCTCTGAGGA GCAGCCGCAG GAGGAGGAGG  150
AGGTCGTCGG GGGCGGCGGG CGGAGACCGC GCTCTCGCTT CCCCGGCGGC  200
GGCAAGGGCA GGACAATGGA GGTGGCGGTG GAGAAGGCGG TGGCGGCGGC  250
GGCAGCGGCC TCGGCTGCGG CCTCCGGGGG GCCCTCGGCG GCGCCGAGCG  300
GGGAGAACGA GGCCGAGAGT CGGCAGGGCC CGGACTCGGA GCGCGGCGGC  350
GAGGCGGCCC GGCTCAACCT GTTGGACACT TGCGCCGTGT GCCACCAGAA  400
CATCCAGAGC CGGGCGCCCA AGCTGCTGCC CTGCCTGCAC TCTTTCTGCC  450
AGCGCTGCCT GCCCGCGCCC CAGCGCTACC TCATGCTGCC CGCGCCCATG  500
CTGGGCTCGG CCGAGACCCC GCCACCCGTC CCTGCCCCCG GCTCGCCGGT  550
CAGCGGCTCG TCGCCGTTCG CCACCCAAGT TGGAGTCATT CGTTGCCCAG  600
TTTGCAGCCA AGAATGTGCA GAGAGACACA TCATAGATAA CTTTTTTGTG  650
AAGGACACTA CTGAGGTTCC CAGCAGTACA GTAGAAAAGT CAAATCAGGT  700
ATGTACAAGC TGTGAGGACA ACGCAGAAGC CAATGGGTTT TGTGTAGAGT  750
GTGTTGAATG GCTCTGCAAG ACGTGTATCA GAGCTCATCA GAGGGTAAAG  800
TTCACAAAAG ACCACACTGT CAGACAGAAA GAGGAAGTAT CTCCAGAGGC  850
AGTTGGTGTC ACCAGCCAGC GACCAGTGTT TTGTCCTTTT CATAAAAAGG  900
AGCAGCTGAA GCTGTACTGT GAGACATGTG ACAAACTGAC ATGTCGAGAC  950
TGTCAGTTGT TAGAACATAA AGAGCATAGA TACCAATTTA TAGAAGAAGC  1000
TTTTCAGAAT CAGAAAGTGA TCATAGATAC ACTAATCACC AAACTGATGG  1050
AAAAAACAAA ATACATAAAA TTCACAGGAA ATCAGATCCA AAACAGAATT  1100
ATTGAAGTAA ATCAAAATCA AAAGCAGGTG AACAGGATA TTAAAGTTGC  1150
TATATTTACA CTGATGGTAG AAATAAATAA AAAAGGAAAA GCTCTACTGC  1200
ATCAGTTAGA GAGCCTTGCA AAGGACCATC GCATGAAACT TATGCAACAA  1250
CAACAGGAAG TGGCTGGACT CTCTAAACAA TTGGAGCATG TCATGCATTT  1300
TTCTAAATGG GCAGTTTCCA GTGGCAGCAG TACAGCATTA CTTTATAGCA  1350
AACGACTGAT TACATACCGG TTACGGCACC TCCTTCGTGC AAGGTGTGAT  1400
GCATCCCCAG TGACCAACAA CACCATCCAA TTTCACTGTG ATCCTAGTTT  1450
CTGGGCTCAA AATATCATCA ACTTAGGTTC TTTAGTAATC GAGGATAAAG  1500
AGAGCCAGCC ACAAATGCCT AAGCAGAATC CTGTCGTGGA ACAGAATTCA  1550
CAGCCACCAA GTGGTTTATC ATCAAACCAG TTATCCAAGT TCCCAACACA  1600
GATCAGCCTA GCTCAATTAC GGCTCCAGCA TATGCAGCAA CAGCAACCGC  1650
CTCCACGTTT GATAAACTTT CAGAATCACA GCCCCAAACC CAATGGACCA  1700
GTTCTTCCTC CTCATCCTCA ACAACTGAGA TATCCACCAA ACCAGAACAT  1750
ACCACGACAA GCAATAAAGC CAAACCCCCT ACAGATGGCT TCTTGGCTC  1800
AACAAGCCAT AAAACAGTGG CAGATCAGCA GTGGACAGGG AACCCCATCA  1850
ACTACCAACA GCACATCCTC TACTCCTTCC AGCCCCACGA TTACTAGTGC  1900
AGCAGGATAT GATGGAAAGG CTTTTGGTTC ACCTATGATC GATTTGAGCT  1950
CACCAGTGGG AGGGTCTTAT AATCTTCCCT CTCTTCCGGA TATTGACTGT  2000
TCAAGTACTA TTATGCTGGA CAATATTGTG AGGAAAGATA CTAATATAGA  2050
TCATGGCCAG CCAAGACCAC CCTCAAACAG AACGGTCCAG TCACCAAATT  2100
CATCAGTGCC ATCTCCAGGC CTTGCAGGAC CTGTTACTAT GACTAGTGTA  2150
CACCCCCCAA TACGTTCACC TAGTGCCTCC AGCGTTGGAA GCCGAGGAAG  2200
CTCTGGCTCT TCCAGCAAAC CAGCAGGAGC TGACTCTACA CACAAAGTCC  2250
CAGTGGTCAT GCTGGAGCCA ATTCGAATAA ACAAGAAAA CAGTGGACCA  2300
CCGGAAAATT ATGATTTCCC TGTTGTTATA GTGAAGCAAG AATCAGATGA  2350
AGAATCTAGG CCTCAAAATG CCAATTATCC AAGAAGCATA CTCACCTCCC  2400
TGCTCTTAAA TAGCAGTCAG AGCTCTACTT CTGAGGAGAC TGTGCTAAGA  2450
TCAGATGCCC CTGATAGTAC AGGAGATCAA CCTGGACTTC ACCAGGACAA  2500
TTCCTCAAAT GGAAAGTCTG AATGGTTGGA TCCTTCCCAG AAGTCACCTC  2550
```

FIG. 7B

```
TTCATGTTGG AGAGACAAGG AAAGAGGATG ACCCCAATGA GGACTGGTGT  2600
GCAGTTTGTC AAAACGGAGG GGAACTCCTC TGCTGTGAAA AGTGCCCCAA  2650
AGTATTCCAT CTTTCTTGTC ATGTGCCCAC ATTGACAAAT TTTCCAAGTG  2700
GAGAGTGGAT TTGCACTTTC TGCCGAGACT TATCTAAACC AGAAGTTGAA  2750
TATGATTGTG ATGCTCCAG TCACAACTCA GAAAAAAGA AAACTGAAGG    2800
CCTTGTTAAG TTAACACCTA TAGATAAAAG GAAGTGTGAG CGCCTACTTT  2850
TATTTCTTTA CTGCCATGAA ATGAGCCTGG CTTTTCAAGA CCCTGTTCCT  2900
CTAACTGTGC CTGATTATTA CAAAATAATT AAAAATCCAA TGGATTTGTC  2950
AACCATCAAG AAAAGACTAC AAGAAGATTA TTCCATGTAC TCAAAACCTG  3000
AAGATTTTGT AGCTGATTTT AGATTGATCT TTCAAAACTG TGCTGAATTC  3050
AATGAGCCTG ATTCAGAAGT AGCCAATGCT GGTATAAAAC TTGAAAATTA  3100
TTTTGAAGAA CTTCTAAAGA ACCTCTATCC AGAAAAAGG TTTCCCAAAC   3150
CAGAATTCAG GAATGAATCA GAAGATAATA AATTTAGTGA TGATTCAGAT  3200
GATGACTTTG TACAGCCCCG GAAGAAACGC CTCAAAAGCA TTGAAGAACG  3250
CCAGTTGCTT AAATAATATG CAGCACCACT AGCTTGTGCT GGTTTTTAGA  3300
TTTTTTGTT TTCAAAAAAA CATTTGTCAG TAATTAACA TCACTACAAA    3350
AAGAAGAGTT TGTGACTATT CTCATCTCTG TTTTGGACGT TTACTAGACT  3400
TTGATTTCCT TAATAGCCCA TTTCTGTTAA CCTCTTATCA CTAAGAAAGA  3450
AAGGAAAGAA GGAGATGAAT AGAAGAAAGA AAATGGAAAG AAGGAAAAAA  3500
GGAGGATAGA AAAAGGATGG AAGAAAGAAG CATTGAAAAC AAAGACATTC  3550
TTCCCACTTC TTGGATTTTT AAACCACAGT CTGGAGTGAT AGCTACTGTA  3600
GAAAGGAAAT AGACTTTGTA TGAACTCTTT AAGTTGAAAA GTAAAAAATA  3650
TATGTGGTTT GGATGTGTGC TTTAATTCAG CTTTAGAAAT TAATACCACT  3700
ACCCGTGAAT TATATGGCCT GACAATATGA ATTAGGTGTA CTGTACTGAA  3750
GAACAGTACT CCACAAACAT GGGTGGTAAC AAGAGTTCCA TCCCAGGAGG  3800
CCAAACGGTG CAACAGAAGG GTAGGTTAGA TGCTATTAAG AAGGCACTTA  3850
ATAGTACATC ATGTAAGATG GCAACTGTAT TAAAGAAAAA TCCGGAAAAC  3900
AAaaa (SEQ ID NO: 7)
```

FIG. 8

```
MEVAVEKAVAAAAAASAAASGGPSAAPSGENEAESRQGPDSERGGEAARLNLLDTCAVCH
QNIQSRAPKLLPCLHSFCQRCLPAPQRYLMLPAPMLGSAETPPPVPAPGSPVSGSSPFAT
QVGVIRCPVCSQECAERHIIDNFFVKDTTEVPSSTVEKSNQVCTSCEDNAEANGFCVECV
EWLCKTCIRAHQRVKFTKDHTVRQKEEVSPEAVGVTSQRPVFCPFHKKEQLKLYCETCDK
LTCRDCQLLEHKEHRYQFIEEAFQNQKVIIDTLITKLMEKTKYIKFTGNQIQNRIIEVNQ
NQKQVEQDIKVAIFTLMVEINKKGKALLHQLESLAKDHRMKLMQQQQEVAGLSKQLEHVM
HFSKWAVSSGSSTALLYSKRLITYRLRHLLRARCDASPVTNNTIQFHCDPSFWAQNIINL
GSLVIEDKESQPQMPKQNPVVEQNSQPPSGLSSNQLSKFPTQISLAQLRLQHMQQQQPPP
RLINFQNHSPKPNGPVLPPHPQQLRYPPNQNIPRQAIKPNPLQMAFLAQQAIKQWQISSG
QGTPSTTNSTSSTPSSPTITSAAGYDGKAFGSPMIDLSSPVGGSYNLPSLPDIDCSSTIM
LDNIVRKDTNIDHGQPRPPSNRTVQSPNSSVPSPGLAGPVTMTSVHPPIRSPSASSVGSR
GSSGSSSKPAGADSTHKVPVVMLEPIRIKQENSGPPENYDFPVVIVKQESDEESRPQNAN
YPRSILTSLLLNSSQSSTSEETVLRSDAPDSTGDQPGLHQDNSSNGKSEWLDPSQKSPLH
VGETRKEDDPNEDWCAVCQNGGELLCCEKCPKVFHLSCHVPTLTNFPSGEWICTFCRDLS
KPEVEYDCDAPSHNSEKKKTEGLVKLTPIDKRKCERLLLFLYCHEMSLAFQDPVPLTVPD
YYKIIKNPMDLSTIKKRLQEDYSMYSKPEDFVADFRLIFQNCAEFNEPDSEVANAGIKLE
NYFEELLKNLYPEKRFPKPEFRNESEDNKFSDDSDDDFVQPRKKRLKSIEERQLLK-
(SEQ ID NO: 8)
```

FIG. 9A

```
CGCCTCCCTT CCCCCTCCCC GCCCGACAGC GGCCGCTCGG GCCCCGGCTC    50
TCGGTTATAA GATGGCGGCG CTGAGCGGTG GCGGTGGTGG CGGCGCGGAG   100
CCGGGCCAGG CTCTGTTCAA CGGGGACATG GAGCCCGAGG CCGGCGCCGG   150
CGCCGGCGCC GCGGCCTCTT CGGCTGCGGA CCCTGCCATT CCGGAGGAGG   200
TGTGGAATAT CAAACAAATG ATTAAGTTGA CACAGGAACA TATAGAGGCC   250
CTATTGGACA AATTTGGTGG GGAGCATAAT CCACCATCAA TATATCTGGA   300
GGCCTATGAA GAATACACCA GCAAGCTAGA TGCACTCCAA CAAAGAGAAC   350
AACAGTTATT GGAATCTCTG GGAACGGAA CTGATTTTC TGTTCTAGC   400
TCTGCATCAA TGGATACCGT TACATCTTCT TCCTCTTCTA GCCTTTCAGT   450
GCTACCTTCA TCTCTTTCAG TTTTTCAAAA TCCCACAGAT GTGGCACGGA   500
GCAACCCCAA GTCACCACAA AAACCTATCG TTAGAGTCTT CCTGCCCAAC   550
AAACAGAGGA CAGTGGTACC TGCAAGGTGT GGAGTTACAG TCCGAGACAG   600
TCTAAAGAAA GCACTGATGA TGAGAGGTCT AATCCCAGAG TGCTGTGCTG   650
TTTACAGAAT TCAGGATGGA GAGAAGAAAC CAATTGGTTG GACACTGAT   700
ATTTCCTGGC TTACTGGAGA AGAATTGCAT GTGGAAGTGT TGGAGAATGT   750
TCCACTTACA ACACACAACT TTGTACGAAA AACGTTTTTC ACCTTAGCAT   800
TTTGTGACTT TTGTCGAAAG CTGCTTTTCC AGGGTTTCCG CTGTCAAACA   850
TGTGGTTATA AATTTCACCA GCGTTGTAGT ACAGAAGTTC CACTGATGTG   900
TGTTAATTAT GACCAACTTG ATTGCTGTT TGTCTCCAAG TTCTTTGAAC   950
ACCACCCAAT ACCACAGGAA GAGGCGTCCT TAGCAGAGAC TGCCCTAACA  1000
TCTGGATCAT CCCCTTCCGC ACCCGCCTCG GACTCTATTG GGCCCCAAAT  1050
TCTCACCAGT CCGTCTCCTT CAAAATCCAT TCCAATTCCA CAGCCCTTCC  1100
GACCAGCAGA TGAAGATCAT CGAAATCAAT TTGGGCAACG AGACCGATCC  1150
TCATCAGCTC CCAATGTGCA TATAAACACA ATAGAACCTG TCAATATTGA  1200
TGACTTGATT AGAGACCAAG GATTCGTGG TGATGGAGGA TCAACCACAG  1250
GTTTGTCTGC TACCCCCCCT GCCTCATTAC CTGGCTCACT AACTAACGTG  1300
AAAGCCTTAC AGAAATCTCC AGGACCTCAG CGAGAAAGGA AGTCATCTTC  1350
ATCCTCAGAA GACAGGAATC GAATGAAAAC ACTTGGTAGA CGGGACTCGA  1400
GTGATGATTG GGAGATTCCT GATGGGCAGA TTACAGTGGG ACAAAGAATT  1450
GGATCTGGAT CATTTGGAAC AGTCTACAAG GGAAAGTGGC ATGGTGATGT  1500
GGCAGTGAAA ATGTTGAATG TGACAGCACC TACACCTCAG CAGTTACAAG  1550
CCTTCAAAAA TGAAGTAGGA GTACTCAGGA AAACACGACA TGTGAATATC  1600
CTACTCTTCA TGGGCTATTC CACAAAGCCA CAACTGGCTA TTGTTACCCA  1650
GTGGTGTGAG GGCTCCAGCT TGTATCACCA TCTCCATATC ATTGAGACCA  1700
AATTTGAGAT GATCAAACTT ATAGATATTG CACGACAGAC TGCACAGGGC  1750
ATGGATTACT TACACGCCAA GTCAATCATC CACAGAGACC TCAAGAGTAA  1800
TAATATATTT CTTCATGAAG ACCTCACAGT AAAAATAGGT GATTTGGTC  1850
TAGCTACAGT GAAATCTCGA TGGAGTGGGT CCCATCAGTT TGAACAGTTG  1900
TCTGGATCCA TTTTGTGGAT GGCACCAGAA GTCATCAGAA TGCAAGATAA  1950
AAATCCATAC AGCTTTCAGT CAGATGTATA TGCATTTGGA ATTGTTCTGT  2000
ATGAATTGAT GACTGGACAG TTACCTTATT CAAACATCAA CAACAGGGAC  2050
CAGATAATTT TTATGGTGGG ACGAGGATAC CTGTCTCCAG ATCTCAGTAA  2100
GGTACGGAGT AACTGTCCAA AAGCCATGAA GAGATTAATG GCAGAGTGCC  2150
TCAAAAGAA AAGAGATGAG AGACCACTCT TTCCCCAAT TCTCGCCTCT  2200
ATTGAGCTGC TGGCCCGCTC ATTGCCAAAA ATTCACCGCA GTGCATCAGA  2250
ACCCTCCTTG AATCGGGCTG GTTTCCAAAC AGAGGATTTT AGTCTATATG  2300
CTTGTGCTTC TCCAAAAACA CCCATCCAGG CAGGGGATA TGGTGCGTTT  2350
CCTGTCCACT GAAACAAATG AGTGAGAGAG TTCAGGAGAG TAGCAACAAA  2400
AGGAAAATAA ATGAACATAT GTTTGCTTAT ATGTTAAATT GAATAAAATA  2450
CTCTCTTTTT TTTTAAGGTG AACCAAAGAA CACTTGTGTG GTTAAAGACT  2500
AGATATAATT TTTCCCCAAA CTAAAATTTA TACTTAACAT TGGATTTTA  2550
```

FIG. 9B

```
ACATCCAAGG GTTAAAATAC ATAGACATTG CTAAAAATTG GCAGAGCCTC  2600
TTCTAGAGGC TTTACTTTCT GTTCCGGGTT TGTATCATTC ACTTGGTTAT  2650
TTTAAGTAGT AAACTTCAGT TTCTCATGCA ACTTTGTTG CCAGCTATCA   2700
CATGTCCACT AGGGACTCCA GAAGAAGACC CTACCTATGC CTGTGTTTGC  2750
AGGTGAGAAG TTGGCAGTCG GTTAGCCTGG GTTAGATAAG GCAAACTGAA  2800
CAGATCTAAT TTAGGAAGTC AGTAGAATTT AATAATTCTA TTATTATTCT  2850
TAATAATTTT TCTATAACTA TTTCTTTTTA TAACAATTTG GAAAATGTGG  2900
ATGTCTTTTA TTTCCTTGAA GCAATAAACT AAGTTTCTTT TTATAAaaa
(SEQ ID NO: 9)
```

FIG. 10

```
MAALSGGGGGGAEPGQALFNGDMEPEAGAGAGAAASSAADPAIPEEVWNIKQMIKLTQEH
IEALLDKFGGEHNPPSIYLEAYEEYTSKLDALQQREQQLLESLGNGTDFSVSSSASMDTV
TSSSSSSLSVLPSSLSVFQNPTDVARSNPKSPQKPIVRVFLPNKQRTVVPARCGVTVRDS
LKKALMMRGLIPECCAVYRIQDGEKKPIGWDTDISWLTGEELHVEVLENVPLTTHNFVRK
TFFTLAFCDFCRKLLFQGFRCQTCGYKFHQRCSTEVPLMCVNYDQLDLLFVSKFFEHHPI
PQEEASLAETALTSGSSPSAPASDSIGPQILTSPSPSKSIPIPQPFRPADEDHRNQFGQR
DRSSSAPNVHINTIEPVNIDDLIRDQGFRGDGGSTTGLSATPPASLPGSLTNVKALQKSP
GPQRERKSSSSSEDRNRMKTLGRRDSSDDWEIPDGQITVGQRIGSGSFGTVYKGKWHGDV
AVKMLNVTAPTPQQLQAFKNEVGVLRKTRHVNILLFMGYSTKPQLAIVTQWCEGSSLYHH
LHIIETKFEMIKLIDIARQTAQGMDYLHAKSIIHRDLKSNNIFLHEDLTVKIGDFGLATV
KSRWSGSHQFEQLSGSILWMAPEVIRMQDKNPYSFQSDVYAFGIVLYELMTGQLPYSNIN
NRDQIIFMVGRGYLSPDLSKVRSNCPKAMKRLMAECLKKKRDERPLFPQILASIELLARS
LPKIHRSASEPSLNRAGFQTEDFSLYACASPKTPIQAGGYGAFPVH-
(SEQ ID NO: 10)
```

FIG. 11A

```
AACTTGACCC GTTAGCAGCC GCAGCCATGG CGGCGCGTTC GCCTCCCTCA   50
CCGCACCCTT CGCCCCCAGC GCGACAGCTG GGCCCCAGGT CCCCACGTGT  100
TGGGCGGGGA GCTGAAGTAC ACGCAATGCG CAGCGAGGCC TCGGGTTTTG  150
CCGGCGCAGC GCGGGAGGTG GTCGCGGACG AAAGTGATAA AATCTGGGTG  200
GGTGAAGAAG GGTCAGGGGG CCGGCGAGGG CCTGGGGGGG CAGCTCCGGC  250
TCATGCTCCC CTCCTCAGCG CGCCCATGGG GTCCAGACGG CTAGAGGGCA  300
TCTCGGTAGA GGAGGCGATG GTGACCCGGA CGCAGCTGCT GGAGGAAGAG  350
CTGAGCAGCC TAAAGGAGGA GTTGGCCCTG TGTCAGGCTG ATAAAGAATT  400
TGTATGGTCT TTGTGGAAAC GTCTCCAGGT TACAAACCCA GATCTCACAC  450
AAGTGGTCAG TTTGGTTGTG GAAAGAGAAA AACAGAAATC TGAAGCTAAA  500
GACAGAAAAG TTCTAGAAAT TCTGCAAGTC AAGGATGCCA AAATACAAGA  550
ATTTGAACAG AGAGAGTCAG TACTGAAACA GGAAATAAAT GACCTTGTAA  600
AACGGAAAAT TGCAGTAGAT GAAGAAAATG CTTTCTTAAG GAAAGAATTC  650
AGTGACTTGG AGAAGAAATT TAAAGATAAA AGTCAAGAAA TTAAGGACAC  700
TAAGGAGTGT GTACAGAACA AGAAGAGCA AAACAGACTA GTTATAAAA  750
ATCTGGAGGA GGAAAACAAG AAATTAAGTA CCCGCTGCAC TGACCTGCTA  800
AATGACCTGG AGAAATTGAG GAAGCAGGAA GCACATTTGA GAAAAGAAAA  850
ATATAGCACT GATGCAAAAA TAAAGACCTT TGAAGACAAT TTAATTGAAG  900
CAAGGAAAGA AGTTGAAGTA TCACAGAGTA AATACAATGC TCTATCATTA  950
CAGTTGAGTA ATAAACAGAC TGAACTTATC CAGAAGGATA TGGATATTAC 1000
CCTGGTCAGG AAGGAACTGC AGGAGCTGCA GAATCTTTAC AAACAGAACA 1050
GTACACATAC AGCCCAGCAA GCAGAGCTGA TCCAGCAGCT TCAGGTTCTC 1100
AATATGGACA CACAAAAAGT ACTGAGAAAT CAGGAAGATG TTCACACAGC 1150
TGAAAGTATA TCATATCAAA AACTTTACAA TGAGTTACAT ATTTGTTTTG 1200
AAACCACAAA ATCAAATGAA GCTATGCTCC GGCAAAGTGT TACTAATCTT 1250
CAGGATCAGC TATTACAAAA AGAGCAAGAA AATGCTAAGT TAAAAGAAAA 1300
ACTTCAGGAA TCACAGGGAG CACCTCTTCC TTTACCTCAA GAAAGTGATC 1350
CAGACTACTC AGCACAGGTA CCTCATCGCC CATCCTTATC AAGCTTAGAA 1400
ACGTTAATGG TTTCACAGAA GTCTGAAATT GAGTATTTAC AGGAGAAACT 1450
AAAGATAGCA AATGAAAAAC TGTCAGAAAA CATATCTGCC AACAAGGGTT 1500
TCTCCCGAAA GAGCATCATG ACAAGTGCTG AAGGAAAACA TAAGGAACCA 1550
CCTGTGAAAC GTTCAAGGTC TTTGTCCCCA AAGAGCTCTT TCACAGACTC 1600
AGAAGAGCTA CAGAAGCTGA GAAAAGCTGA AGAAAGATT GAAAACTTAG 1650
AGAAGGCACT ACAACTAAAG AGCCAAGAAA ATGATGAGCT AAGAGATGCC 1700
CATGAAAAAC GCAAGGAACG GCTACAGATG TTACAGACCA ACTACAGAGC 1750
AGTAAAAGAG CAATTAAAAC AGTGGGAAGA AGGCAGTGGC ATGACTGAAA 1800
TCAGGAAAAT AAAGAGAGCA GATCCCCAAC AACTTCGACA AGAAGATTCT 1850
GACGCTGTGT GGAATGAACT GGCATATTTC AAAAGGGAAA ACCAGGAGCT 1900
AATGATTCAA AAGATGAATC TTGAAGAAGA ATTAGATGAA CTTAAAGTAC 1950
ATATATCTAT TGATAAGGCA GCAATACAAG AATTGAATAG ATGTGTGGCA 2000
GAGAGAAGAG AAGAACAGCT CTTTAGATCT GGTGAAGATG ATGAGGTCAA 2050
GAGGAGTACT CCAGAGAAGA ATGGAAAAGA AATGTTGGAG CAGACATTAC 2100
AGAAGGTCAC TGAGTTGGAA AATCGGCTGA ATCTTTTGA GAAAGGTCG 2150
AGAAAATTAA AAGAAGGGAA TAAAAAATTA ATGAAAGAAA ATGATTTTCT 2200
GAAATCCCTC TTAAACAGC AACAAGAAGA TACAGAGACC AGAGAAAAG 2250
AGCTAGAACA GATAATAAAG GGGAGTAAAG ATGTAGAAAA AGAAAATACT 2300
GAACTTCAAG TAAAAATCAG TGAGCTGGAG ACAGAAGTCA CTTCCCTGAG 2350
GAGACAAGTG GCAGAAGCTA ATGCATTGAG AAATGAAAAT GAAGAGCTGA 2400
TCAACCCAAT GGAGAAATCA CACCAGTCAG CAGACAGAGC TAAATCCGAG 2450
ATGGCCACCA TGAAAGTGAG ATCTGGACGA TATGATTGTA AGACAACTAT 2500
```

FIG. 11B

```
GACCAAGGTT AAATTTAAAG CTGCGAAGAA AAATTGCTCT GTGGGTCGTC  2550
ACCACACTGT TCTCAATCAT TCCATCAAGG TTATGAGCAA TGTGTTTGAG  2600
AACCTCAGCA AGGACGGCTG GGAGGATGTG AGTGAAAGCA GCAGTGATTC  2650
TGAAGCACAG ACCTCTCAAA CTTTGGGAAC AATTATTGTA GAAACATCCC  2700
AGAAAATAAG TCCTACGGAA GATGGAAAAG ACCAGAAAGA AAGTGATCCA  2750
ACAGAAGACA GCCAAACACA AGGAAAAGAA ATAGTACAGA CATATTTAAA  2800
TATAGATGGC AAGACCCCAA AGGACTATTT TCATGATAAG AATGCCAAAA  2850
AACCAACTTT TCAAAAGAAG AATTGCAAGA TGCAAAAGAG TTCACATACA  2900
GCAGTTCCTA CTAGAGTCAA CAGAGAAAAG TACAAAAATA TAACTGCCCA  2950
GAAATCAAGT AGCAATATTA TTTTATTACG AGAACGGATT ATATCCTTGC  3000
AACAACAAAA CAGTGTACTT CAGAATGCCA AGAAAACAGC AGAATTGTCT  3050
GTTAAAGAAT ATAAAGAAGT TAATGAAAAG CTCCTCCATC AACAGCAAGT  3100
ATCCGATCAA CGATTTCAGA CAAGCAGGCA GACAATAAAG AAGCTAAATT  3150
TGGATTTGGC TGGGCTTCGG AAAGAAAAAG AAGATTTACT AAAGAAATTG  3200
GAGTCCTCAT CTGAAATCAC AAGTTTGGCA GAAGAAAATT CCCAGGTAAC  3250
ATTTCCACGG ATACAAGTTA CATCACTTAG TCCTTCAAGG AGCATGGATT  3300
TGGAAATGAA GCAATTGCAG TATAAACTAA AGAATGCTAC TAATGAACTC  3350
ACTAAACAGT CATCAAATGT GAAGACTTTG AAATTTGAAC TCCTAGCAAA  3400
AGAAGAACAC ATAAAGGAAA TGCATGAAAA GATATCTCGA ATGGAGAGGG  3450
ATATAACTAT GAAAAGACAT TTGATAGAGG ACTTGAAATT TCGACAGAAA  3500
GTAAATTTGG AAAGTAACAA GAGTTTTAGT GAAATGTTAC AAAATCTTGA  3550
TAAAAAGGTA AAGACATTAA CTGAAGAATG TTCCAACAAG AAGGTATCAA  3600
TTGATTCACT AAAGCAAAGA CTTAACGTTG CTGTAAAAGA AAAGTCACAG  3650
TATGAACAGA TGTATCAGAA ATCTAAAGAG GAGTTAGAAA AAAAGGATCT  3700
CAAGCTTACT CTCCTAGTAT CAAGAATAAG TGAGACTGAA TCTGCAATGG  3750
CAGAAATTGA AACAGCAGCA TCTAAGCAGC TTCAAGAATT AGCATTGCAA  3800
AGTGAACAGG TCCTAGAAGG TGCACAGAAG ACATTGCTGT TAGCCAATGA  3850
AAAAGTAGAA GAGTTCACCA CATTTGTGAA GGCTTTGGCC AAAGAGTTGC  3900
AAAATGATGT CCATGTGGTA AGGCGACAAA TAAGAGAGCT TAAAAAAATG  3950
AAGAAAAACA GGGACGCCTG TAAAACCTCA ACCCATAAAG CCCAGACCTT  4000
GGCAGCTTCT ATCCTGAACA TTTCACGGTC AGATTTAGAG GAAATATTAG  4050
ACACAGAAGA TCAAGTGGAA ATTGAAAAAA CAAAAATTGA TGCTGAAAAT  4100
GACAAGGAAT GGATGTTGTA CATTCAGAAA CTTCTTGAAG GACAGCTTCC  4150
TTTTGCCTCA TATTTACTAG AAGCAGTACT GGAAAAAATA AATGAAAAAA  4200
AGAAACTAGT TGAAGGATAT TTCACAATTA TGAAAGATAT TAGATGATAT  4250
TAAAATGGAG AGCTTTATTG CAAATGTGAA AACTTTTAT GTGGTGTGAT  4300
TGGAATACAT GCATTGCAAT CCTGACACGG TATCTGCTCC AACTATCAAT  4350
AGTCAGGTTC AATACCAAAA TAAGAAGTCT CTGAAAATAA TTAATTGCTG  4400
AACAAGTGAA ACTAATTAAG TACATAGCCA TTTAAAAGGA AATAGTGTAG  4450
CATCTGATGG TCGAATACAA ATATTGCCAC AAATCAGTGC AAACTTAAAA  4500
ATGATTTTCC TTCTAGTGCA TTAAAAGAAA CTGAGCAGGC TTGGTACACA  4550
CAAATTGGCC TGAGCATAAG AAGAAAAGT ATCAACTAAG GATTTAATGT  4600
TTTACGTTTC ATGAAGAAAC TAGACTTTTT ACATAAAACT GCTATAGATG  4650
GCCATAAGTG GTCCAGGGAG CAACAGATTT GTAGTATGAG CAAATATAAA  4700
ATGAAGCATC ATAACTTGAG CATTTATTGA AATAAATTGT GTGGTCCAAT  4750
TGAATCTGTT CTCATTGATG TGCTGGTTTA TGTAGGAGAT ACTGTGTATT  4800
TCTACAACTC TTTGGCAAAA ACAAAAACAT TTCTTCTTC TCTCTCTTAA  4850
CTTCACAATA CTATACGTTG TGTAGTCATA TAAATTTGCA GGGAACCACA  4900
AACCCAATGT ATAAAATTAG GCTCTATTTA ACAGAACTAC TACTGTGGTC  4950
AGCTAATTTA AGTTACATTC TTAACCATGA TGTCATCCTT ATTTAGATTC  5000
CTGGACATTC CCACCTCATT TCACCTCTTC ACCGTGTTCC TGCCATACCC  5050
```

FIG. 11C

```
TTTTTGGTTC CTCTAATTCA CCATACTGGT GCCTGCCTCC CACATTTGCC  5100
CTTGGTCTTC TCTCTTTCTA GAATACTCTG CACTCAACTT TCCTCATGGC  5150
TGGCTCCTTG TCATCATTCA GCTCCACCTT CCCCGGTCCC TCAGAGACAC  5200
ATTCTCTGAC CAGCTTACTA TTTTATTTCC TCATAGCACA AAATTATCTA  5250
TCTGTTCATG TATTTGTTTT CTTGTTTATT TTCTTCTTTT CCCTCTTTAG  5300
TATGTAGGTC CCATGAGATT AAGGCAAGGG TTGGCAGATT ATAGCCTGCA  5350
GGGCGAATCT GGCCTGCCAC CTGTTTTGTA TGGCCCACAA GCTAAGAATG  5400
GTTTTTGCCT TATTAAATGG TTTTAAAAA ATCAAAAGGA GAATAATATT  5450
TTGTAGCATG TGAAAATTAT ATAAAATTCA AATTTTGGTG TCTGTTAATA  5500
AAGTTTTATT GGAAaaaaaa aa (SEQ ID NO: 11)
```

FIG. 12

```
MAARSPPSPHPSPPARQLGPRSPRVGRGAEVHAMRSEASGFAGAAREVVADESDKIWVGE
EGSGGRRGPGGAAPAHAPLLSAPMGSRRLEGISVEEAMVTRTQLLEEELSSLKEELALCQ
ADKEFVWSLWKRLQVTNPDLTQVVSLVVEREKQKSEAKDRKVLEILQVKDAKIQEFEQRE
SVLKQEINDLVKRKIAVDEENAFLRKEFSDLEKKFKDKSQEIKDTKECVQNKEEQNRLVI
KNLEEENKKLSTRCTDLLNDLEKLRKQEAHLRKEKYSTDAKIKTFEDNLIEARKEVEVSQ
SKYNALSLQLSNKQTELIQKDMDITLVRKELQELQNLYKQNSTHTAQQAELIQQLQVLNM
DTQKVLRNQEDVHTAESISYQKLYNELHICFETTKSNEAMLRQSVTNLQDQLLQKEQENA
KLKEKLQESQGAPLPLPQESDPDYSAQVPHRPSLSSLETLMVSQKSEIEYLQEKLKIANE
KLSENISANKGFSRKSIMTSAEGKHKEPPVKRSRSLSPKSSFTDSEELQKLRKAERKIEN
LEKALQLKSQENDELRDAHEKRKERLQMLQTNYRAVKEQLKQWEEGSGMTEIRKIKRADP
QQLRQEDSDAVWNELAYFKRENQELMIQKMNLEEELDELKVHISIDKAAIQELNRCVAER
REEQLFRSGEDDEVKRSTPEKNGKEMLEQTLQKVTELENRLKSFEKRSRKLKEGNKKLMK
ENDFLKSLLKQQQEDTETREKELEQIIKGSKDVEKENTELQVKISELETEVTSLRRQVAE
ANALRNENEELINPMEKSHQSADRAKSEMATMKVRSGRYDCKTTMTKVKFKAAKKNCSVG
RHHTVLNHSIKVMSNVFENLSKDGWEDVSESSSDSEAQTSQTLGTIIVETSQKISPTEDG
KDQKESDPTEDSQTQGKEIVQTYLNIDGKTPKDYFHDKNAKKPTFQKKNCKMQKSSHTAV
PTRVNREKYKNITAQKSSSNIILLRERIISLQQQNSVLQNAKKTAELSVKEYKEVNEKLL
HQQQVSDQRFQTSRQTIKKLNLDLAGLRKEKEDLLKKLESSSEITSLAEENSQVTFPRIQ
VTSLSPSRSMDLEMKQLQYKLKNATNELTKQSSNVKTLKFELLAKEEHIKEMHEKISRME
RDITMKRHLIEDLKFRQKVNLESNKSFSEMLQNLDKKVKTLTEECSNKKVSIDSLKQRLN
VAVKEKSQYEQMYQKSKEELEKKDLKLTLLVSRISETESAMAEIETAASKQLQELALQSE
QVLEGAQKTLLLANEKVEEFTTFVKALAKELQNDVHVVRRQIRELKKMKKNRDACKTSTH
KAQTLAASILNISRSDLEEILDTEDQVEIEKTKIDAENDKEWMLYIQKLLEGQLPFASYL
LEAVLEKINEKKKLVEGYFTIMKDIR- (SEQ ID NO: 12)
```

FIG. 13A

```
AGAATCGGAG AGCCGGTGGC GTCGCAGGTC GGGAGGACGA GCACCGAGTC   50
GAGGGCTCGC TCGTCTGGGC CGCCCGAGAG TCTTAATCGC GGGCGCTTGG  100
GCCGCCATCT TAGATGGCGG GAGTAAGAGG AAAACGATTG TGAGGCGGGA  150
ACGGCTTTCT GCTGCCTTTT TTGGGCCCCG AAAAGGGTCA GCTGGCCGGG  200
CTTTGGGGCG CGTGCCCTGA GGCGCGGAGC GCGTTTGCTA CGATGCGGGG  250
GCTGCTCGGG GCTCCGTCCC CTGGGCTGGG GACGCGCCGA ATGTGACCGC  300
CTCCCGCTCC CTCACCCGCC GCGGGGAGGA GGAGCGGGCG AGAAGCTGCC  350
GCCGAACGAC AGGACGTTGG GGCGGCCTGG CTCCCTCAGG TTTAAGAATT  400
GTTTAAGCTG CATCAATGGA GCACATACAG GGAGCTTGGA AGACGATCAG  450
CAATGGTTTT GGATTCAAAG ATGCCGTGTT TGATGGCTCC AGCTGCATCT  500
CTCCTACAAT AGTTCAGCAG TTTGGCTATC AGCGCCGGGC ATCAGATGAT  550
GGCAAACTCA CAGATCCTTC TAAGACAAGC AACACTATCC GTGTTTCTT   600
GCCGAACAAG CAAAGAACAG TGGTCAATGT GCGAAATGGA ATGAGCTTGC  650
ATGACTGCCT TATGAAAGCA CTCAAGGTGA GGGGCCTGCA ACCAGAGTGC  700
TGTGCAGTGT TCAGACTTCT CCACGAACAC AAAGGTAAAA AAGCACGCTT  750
AGATTGGAAT ACTGATGCTG CGTCTTTGAT TGGAGAAGAA CTTCAAGTAG  800
ATTTCCTGGA TCATGTTCCC CTCACAACAC ACAACTTTGC TCGGAAGACG  850
TTCCTGAAGC TTGCCTTCTG TGACATCTGT CAGAAATTCC TGCTCAATGG  900
ATTTCGATGT CAGACTTGTG GCTACAAATT TCATGAGCAC TGTAGCACCA  950
AAGTACCTAC TATGTGTGTG GACTGGAGTA ACATCAGACA ACTCTTATTG 1000
TTTCCAAATT CCACTATTGG TGATAGTGGA GTCCCAGCAC TACCTTCTTT 1050
GACTATGCGT CGTATGCGAG AGTCTGTTTC CAGGATGCCT GTTAGTTCTC 1100
AGCACAGATA TTCTACACCT CACGCCTTCA CCTTTAACAC CTCCAGTCCC 1150
TCATCTGAAG GTTCCCTCTC CAGAGGCAG AGGTCGACAT CCACACCTAA 1200
TGTCCACATG GTCAGCACCA CCCTGCCTGT GGACAGCAGG ATGATTGAGG 1250
ATGCAATTCG AAGTCACAGC GAATCAGCCT CACCTTCAGC CCTGTCCAGT 1300
AGCCCCAACA ATCTGAGCCC AACAGGCTGG TCACAGCCGA AAACCCCGT  1350
GCCAGCACAA AGAGAGCGGG CACCAGTATC TGGGACCCAG GAGAAAAACA 1400
AAATTAGGCC TCGTGGACAG AGAGATTCAA GCTATTATTG GGAAATAGAA 1450
GCCAGTGAAG TGATGCTGTC CACTCGGATT GGGTCAGGCT CTTTTGGAAC 1500
TGTTTATAAG GGTAAATGGC ACGGAGATGT TGCAGTAAAG ATCCTAAAGG 1550
TTGTCGACCC AACCCCAGAG CAATTCCAGG CCTTCAGGAA TGAGGTGGCT 1600
GTTCTGCGCA AAACACGGCA TGTGAACATT CTGCTTTTCA TGGGGTACAT 1650
GACAAAGGAC AACCTGGCAA TTGTGACCCA GTGGTGCGAG GGCAGCAGCC 1700
TCTACAAACA CCTGCATGTC CAGGAGACCA AGTTTCAGAT GTTCCAGCTA 1750
ATTGACATTG CCCGGCAGAC GGCTCAGGGA ATGGACTATT TGCATGCAAA 1800
GAACATCATC CATAGAGACA TGAAATCCAA CAATATATTT CTCCATGAAG 1850
GCTTAACAGT GAAAATTGGA GATTTGGTT TGGCAACAGT AAAGTCACGC 1900
TGGAGTGGTT CTCAGCAGGT TGAACAACCT ACTGGCTCTG TCCTCTGGAT 1950
GGCCCCAGAG GTGATCCGAA TGCAGGATAA CAACCCATTC AGTTTCCAGT 2000
CGGATGTCTA CTCCTATGGC ATCGTATTGT ATGAACTGAT GACGGGGGAG 2050
CTTCCTTATT CTCACATCAA CAACCGAGAT CAGATCATCT TCATGGTGGG 2100
CCGAGGATAT GCCTCCCCAG ATCTTAGTAA GCTATATAAG AACTGCCCCA 2150
AAGCAATGAA GAGGCTGGTA GCTGACTGTG TGAAGAAAGT AAAGGAAGAG 2200
AGGCCTCTTT TTCCCCAGAT CCTGTCTTCC ATTGAGCTGC TCCAACACTC 2250
TCTACCGAAG ATCAACCGGA GCGCTTCCGA GCCATCCTTG CATCGGGCAG 2300
CCCACACTGA GGATATCAAT GCTTGCACGC TGACCACGTC CCCGAGGCTG 2350
CCTGTCTTCT AGTTGACTTT GCACCTGTCT TCAGGCTGCC AGGGGAGGAG 2400
GAGAAGCCAG CAGGCACCAC TTTTCTGCTC CCTTTCTCCA GAGGCAGAAC 2450
ACATGTTTTC AGAGAAGCTG CTGCTAAGGA CCTTCTAGAC TGCTCACAGG 2500
GCCTTAACTT CATGTTGCCT TCTTTCTAT CCCTTTGGGC CCTGGGAGAA  2550
```

FIG. 13B

```
GGAAGCCATT TGCAGTGCTG GTGTGTCCTG CTCCCTCCCC ACATTCCCCA   2600
TGCTCAAGGC CCAGCCTTCT GTAGATGCGC AAGTGGATGT TGATGGTAGT   2650
ACAAAAAGCA GGGGCCCAGC CCCAGCTGTT GGCTACATGA GTATTTAGAG   2700
GAAGTAAGGT AGCAGGCAGT CCAGCCCTGA TGTGGAGACA CATGGGATTT   2750
TGGAAATCAG CTTCTGGAGG AATGCATGTC ACAGGCGGGA CTTTCTTCAG   2800
AGAGTGGTGC AGCGCCAGAC ATTTTGCACA TAAGGCACCA AACAGCCCAG   2850
GACTGCCGAG ACTCTGGCCG CCCGAAGGAG CCTGCTTTGG TACTATGGAA   2900
CTTTTCTTAG GGGACACGTC CTCCTTTCAC AGCTTCTAAG GTGTCCAGTG   2950
CATTGGGATG GTTTTCCAGG CAAGGCACTC GGCCAATCCG CATCTCAGCC   3000
CTCTCAGGGA GCAGTCTTCC ATCATGCTGA ATTTTGTCTT CCAGGAGCTG   3050
CCCCTATGGG GCGGGGCCGC AGGGCCAGCC TTGTTTCTCT AACAAACAAA   3100
CAAACAAACA GCCTTGTTTC TCTAGTCACA TCATGTGTAT ACAAGGAAGC   3150
CAGGAATACA GGTTTTCTTG ATGATTTGGG TTTTAATTTT GTTTTTATTG   3200
CACCTGACAA AATACAGTTA TCTGATGGTC CCTCAATTAT GTTATTTAA    3250
TAAAATAAAT TAAATTTAGG TGTAAaaaaa aaaaaaaaaa a
(SEQ ID NO: 13)
```

FIG. 14

```
MEHIQGAWKTISNGFGFKDAVFDGSSCISPTIVQQFGYQRRASDDGKLTDPSKTSNTIRV
FLPNKQRTVVNVRNGMSLHDCLMKALKVRGLQPECCAVFRLLHEHKGKKARLDWNTDAAS
LIGEELQVDFLDHVPLTTHNFARKTFLKLAFCDICQKFLLNGFRCQTCGYKFHEHCSTKV
PTMCVDWSNIRQLLLFPNSTIGDSGVPALPSLTMRRMRESVSRMPVSSQHRYSTPHAFTF
NTSSPSSEGSLSQRQRSTSTPNVHMVSTTLPVDSRMIEDAIRSHSESASPSALSSSPNNL
SPTGWSQPKTPVPAQRERAPVSGTQEKNKIRPRGQRDSSYYWEIEASEVMLSTRIGSGSF
GTVYKGKWHGDVAVKILKVVDPTPEQFQAFRNEVAVLRKTRHVNILLFMGYMTKDNLAIV
TQWCEGSSLYKHLHVQETKFQMFQLIDIARQTAQGMDYLHAKNIIHRDMKSNNIFLHEGL
TVKIGDFGLATVKSRWSGSQQVEQPTGSVLWMAPEVIRMQDNNPFSFQSDVYSYGIVLYE
LMTGELPYSHINNRDQIIFMVGRGYASPDLSKLYKNCPKAMKRLVADCVKKVKEERPLFP
QILSSIELLQHSLPKINRSASEPSLHRAAHTEDINACTLTTSPRLPVF-
(SEQ ID NO: 14)
```

FIG. 15A

| | | | | | |
|---|---|---|---|---|---|
| CTGCGGCTGG | GGCTGGGGGC | GGCGGCGGCG | GCGACGCGGG | CGGCGGGCGG | 50 |
| CGCGGGGCGG | TCCGGCGGGT | TCAAAGAGGA | AAAC*ATG*GCG | GAAAACAAAG | 100 |
| GCGGCGGCGA | GGCTGAGAGC | GGCGGCGGGG | GCAGCGGCAG | CGCGCCGGTA | 150 |
| ACTGCCGGGG | CCGCCGGGCC | CGCCGCGCAG | GAGGCGGAGC | CGCCTCTCAC | 200 |
| CGCGGTGCTG | GTGGAGGAGG | AGGAGGAGGA | AGGCGGCAGG | GCCGGCGCTG | 250 |
| AGGGCGGCGC | GGCCGGGCCC | GACGACGGGG | GGGTGGCCGC | GGCCTCCTCG | 300 |
| GGCTCGGCCC | AGGCTGCTTC | ATCTCCTGCG | GCCTCAGTGG | GCACTGGAGT | 350 |
| TGCCGGGGGC | GCAGTATCGA | CGCCGGCTCC | AGCTCCAGCC | TCGGCTCCCG | 400 |
| CTCCGGGTCC | CTCGGCAGGG | CCGCCTCCTG | GACCGCCAGC | CTCGCTCCTG | 450 |
| GACACCTGCG | CCGTGTGTCA | GCAGAGCTTG | CAGAGCCGGC | GTGAGGCGGA | 500 |
| GCCCAAGCTG | CTGCCCTGTC | TTCACTCCTT | CTGCCTGCGC | TGCCTGCCCG | 550 |
| AGCCGGAGCG | CCAGCTCAGC | GTGCCCATCC | CGGGGGGCAG | CAACGGCGAC | 600 |
| ATCCAGCAAG | TGGTGTAAT | ACGGTGCCCA | GTATGCCGCC | AAGAATGCAG | 650 |
| ACAGATAGAC | CTTGTGGATA | ATTATTTTGT | GAAAGACACA | TCTGAAGCTC | 700 |
| CTAGCAGTTC | TGATGAAAAA | TCAGAACAGG | TATGTACTAG | TTGTGAAGAC | 750 |
| AATGCAAGTG | CAGTTGGCTT | TTGTGTAGAA | TGTGGAGAGT | GGCTATGTAA | 800 |
| GACATGTATC | GAAGCACATC | AAAGAGTAAA | ATTTACTAAA | GATCACTTGA | 850 |
| TCAGGAAGAA | AGAAGATGTC | TCAGAGTCTG | TTGGAGCATC | TGGTCAACGC | 900 |
| CCTGTTTTCT | GCCCTGTACA | CAAACAAGAA | CAGTTGAAAC | TTTTCTGTGA | 950 |
| AACATGTGAT | AGATTGACAT | GTAGAGACTG | TCAGCTATTG | GAACACAAAG | 1000 |
| AACATAGGTA | TCAGTTTTTG | GAAGAAGCTT | TTCAAAATCA | GAAGGGTGCA | 1050 |
| ATTGAGAATC | TACTGGCGAA | ACTTCTTGAG | AAGAAGAATT | ATGTTCATTT | 1100 |
| TGCAGCTACT | CAGGTGCAGA | ATAGGATAAA | AGAAGTAAAT | GAGACTAACA | 1150 |
| AACGAGTAGA | ACAGGAAATT | AAAGTGGCCA | TTTTCACCCT | TATCAATGAA | 1200 |
| ATTAATAAGA | AAGGAAAATC | TCTCTTACAA | CAGCTAGAGA | ATGTTACAAA | 1250 |
| GGAAAGACAG | ATGAAGTTAC | TACAGCAGCA | GAATGACATC | ACAGGCCTTT | 1300 |
| CCCGGCAGGT | GAAGCATGTT | ATGAACTTCA | CAAATTGGGC | AATTGCAAGT | 1350 |
| GGCAGCAGCA | CAGCACTACT | ATACAGCAAG | CGACTGATTA | CTTTCCAGTT | 1400 |
| GCGTCATATT | TTGAAAGCAC | GGTGTGATCC | TGTCCCTGCT | GCTAATGGAG | 1450 |
| CAATACGTTT | CCATTGTGAT | CCCACCTTCT | GGGCAAAGAA | TGTAGTCAAT | 1500 |
| TTAGGTAATC | TAGTAATAGA | GAGTAAACCA | GCTCCTGGTT | ATACTCCTAA | 1550 |
| TGTTGTAGTT | GGGCAAGTTC | CTCCAGGGAC | AAACCACATT | AGTAAAACCC | 1600 |
| CTGGACAGAT | TAACTTAGCA | CAGCTTCGAC | TCCAGCACAT | GCAACAACAA | 1650 |
| GTATATGCAC | AGAAACATCA | GCAGTTGCAA | CAGATGAGGA | TGCAGCAACC | 1700 |
| ACCAGCACCT | GTACCAACTA | CAACAACAAC | AACACAACAG | CATCCTAGAC | 1750 |
| AAGCAGCCCC | TCAGATGTTA | CAACAACAGC | CTCCTCGATT | GATCAGTGTG | 1800 |
| CAAACAATGC | AAAGAGGCAA | CATGAACTGT | GGAGCTTTTC | AAGCCCATCA | 1850 |
| GATGAGACTG | GCTCAGAATG | CTGCCAGAAT | ACCAGGGATA | CCCAGGCACA | 1900 |
| GCGGCCCTCA | ATATTCCATG | ATGCAGCCAC | ACCTCCAAAG | ACAACACTCA | 1950 |
| AACCCAGGGC | ATGCTGGACC | CTTTCCCGTA | GTATCGGTAC | ACAACACCAC | 2000 |
| AATCAACCCA | ACGAGCCCTA | CTACAGCAAC | TATGGCAAAT | GCAAACCGAG | 2050 |
| GTCCCACCAG | CCCATCTGTT | ACAGCAATAG | AGCTAATCCC | CTCAGTTACC | 2100 |
| AATCCAGAAA | ACCTTCCATC | GCTGCCAGAT | ATTCCACCCA | TACAGTTGGA | 2150 |
| AGATGCTGGC | TCAAGTAGTT | TAGATAATCT | ACTAAGTAGA | TACATCTCAG | 2200 |
| GCAGTCACCT | ACCCCACAG | CCTACAAGCA | CCATGAATCC | TTCTCCAGGT | 2250 |
| CCCTCTGCCC | TTTCTCCGGG | ATCATCAGGT | TTATCCAATT | CTCACACACC | 2300 |
| TGTGAGACCC | CCAAGTACTT | CTAGTACTGG | CAGTCGAGGC | AGCTGTGGGT | 2350 |
| CATCAGGAAG | AACTGCTGAG | AAGACAAGTC | TTAGTTTCAA | ATCTGATCAG | 2400 |
| GTGAAGGTCA | AGCAAGAACC | TGGGACTGAA | GATGAAATAT | GTAGCTTTTC | 2450 |
| AGGAGGTGTA | AAACAAGAAA | AAACAGAGGA | TGGCAGGAGG | AGTGCTTGCA | 2500 |
| TGTTGAGCAG | TCCTGAGAGT | AGCTTGACAC | CACCTCTCTC | AACCAACCTG | 2550 |

FIG. 15B

```
CATCTAGAAA GTGAATTGGA TGCATTGGCA AGCCTGGAAA ACCATGTGAA  2600
AATTGAACCT GCAGATATGA ATGAAAGCTG CAAACAGTCA GGGCTCAGCA  2650
GCCTTGTTAA TGGAAAGTCC CCAATTCGAA GCCTCATGCA CAGGTCGGCA  2700
AGGATTGGAG GAGATGGCAA CAATAAAGAT GATGACCCAA ATGAAGACTG  2750
GTGTGCTGTC TGCCAAAACG GAGGAGATCT CTTGTGCTGC GAAAAATGTC  2800
CAAAGGTCTT TCATCTAACT TGTCATGTTC CAACACTACT TAGCTTTCCA  2850
AGTGGGGACT GGATATGCAC ATTTTGTAGA GATATTGGAA AGCCAGAAGT  2900
TGAATATGAT TGTGATAATT TGCAACATAG TAAGAAGGGG AAAACTGCGC  2950
AGGGGTTAAG CCCCGTGGAC CAAAGGAAAT GTGAACGTCT TCTGCTTTAC  3000
CTCTATTGCC ATGAATTAAG TATTGAATTC CAGGAGCCTG TTCCTGCTTC  3050
GATACCAAAC TACTATAAAA TTATAAAGAA ACCATGGAT TTATCCACCG  3100
TGAAAAAGAA GCTTCAGAAA AAACATTCCC AACACTACCA AATCCCGGAT  3150
GACTTTGTGG CCGATGTCCG TTTGATCTTC AAGAACTGTG AAAGGTTTAA  3200
TGAAATGATG AAAGTTGTTC AAGTTTATGC AGACACACAA GAGATTAATT  3250
TGAAGGCTGA TTCAGAAGTA GCTCAGGCAG GGAAAGCAGT TGCATTGTAC  3300
TTTGAAGATA AACTCACAGA GATCTACTCA GACAGGACCT TCGCACCTTT  3350
GCCAGAGTTT GAGCAGGAAG AGGATGATGG TGAGGTAACT GAGGACTCTG  3400
ATGAAGACTT TATACAGCCC CGCAGAAAAC GCCTAAAGTC AGATGAGAGA  3450
CCAGTACATA TAAAG*TAA*AA TGACATGGAT TTAAATCAAT TGTTAAAAA  3500
AAAAAAAACG AAAAAAAAAA AAAAAACACA AAAAACCCAG AAAACTTTA  3550
AGTGTTGCTG GAATATCCTG CCTACAGTGG GCACCTCCTT GAAGAAGCTG  3600
ATAGCTTTTA CACAGTATTA GATTGAAATA ATGGACAGAA ACACATTCTT  3650
GTCAAGAAAG GGGGAGAGAA GTCTGTTTGC AAGTTTCAAA GCAAAAAGCA  3700
AAAGTGAAAT GATTTGAGGA TTTCTGTTCT AATGGAGATG ATTCTCTGAT  3750
TGTTAGAAAT GGCAAATATT GATGATTGTG TGCTATTGAT TGGTGCAGGA  3800
TACTTGGTAT ACGAGTAAAT ACTTGAGACT CGTGTCACTT GATAAATTTT  3850
CTTTTTGGAC TAGGTCGCAC AGTTATTAAA ACAACTTTTA ACCCTCCCCC  3900
TTCACACACA TACATATCAG GTTGTTTTCT AGTTAAAAAC CCAAGTAGCT  3950
CAGATTCTAC TTTAATGTCA GTGCAGATTT GCATTGAATC ATGCCATTAT  4000
GTTTTTTCTC ATTTTTATGC TGTTGGGTCT TAGTTTTTAA ATTGATATAA  4050
AGAACTCAGC AATGGTTTTA TTTTCTACTC ATACTTAGGG TTTAGGAAAC  4100
ACTACCACTA GTTATCATTT AATCAACTTC AATGGTCTAC TGAAACAAAA  4150
ATGGTAACTT TTCATTAGTG GATTATTTAG AGTTATAGTA GTTGTTTCCA  4200
GAAAACACTT CCTCACAATT GTACTTCCCA ATCAAATCAT GTGATCATAC  4250
AGTTATTCCC ATGAAAGGCA GAATGTTTGT TTCAAAATTA ATCTAGTTTT  4300
CTGTACATTT AAATTTGAGA AGGTGACAAC TGGCTCTTTT CCAGTCTTCC  4350
TTCATGTCAG TTTTCTGATA GACCACTATT GGCAAACAGT ATCTGTCAAC  4400
TACCAAATGT GTAAAATTTT CTGTATTTCA CTTTGTCTTA TTTGTAAATA  4450
GTGAACTAAA ACTTTTGGCA GATCAGCAAC ATTTGCTGAG CCTGTTTTTT  4500
AAGCTAATGT GTATTCTTAC TAATGTTCCT ATCAAGAATG GATTTGTAAT  4550
ATATGCTGTC TATTTCTAAT GTTCACATTC ATATTTTGAG GTTCTATCTT  4600
ATTTTAATAG AGAACAGACT TCTCAAAAAA TCTTCAGAAG CAGCTTATTA  4650
TTGAAATATC GAAATATTGA AATAAACCCG GTGGGGTTAG ATTACTCATC  4700
TGTCCACCAA GTGGGACATT TGCATGGACT GGGGGCTTAA AGGACTTAGA  4750
AGAGACCTGT AAGTAAATCC TGAAAATGAG CCAATCCCCA CTTGAATGGT  4800
TACTGGAGTA AACCCACCTT TACCACCCCA ATTACAGCAC CCGAGGCCGA  4850
TAAACCAACT TGGCTCTGGT TCATTTTTCT TTTCTTCATT TGTGATGCTC  4900
AGATTCAAAA TGTGTGTTCT ACACTGTTAC AGGCTTCTCT TTTGTTTGAT  4950
TAAAGATTTT AGTCCTACTT TTGTATGGAC ACATTAGAAT ATTCAGAGAC  5000
CAAAATAGAA GAATTTGCTG TTAGATATTT TCAGAAGTC AGCAGATTTG  5050
TGGCAAATCA TTTATTTGCC TTTTAAAAA TTCATTTAAG CAGTTCAGAG  5100
```

FIG. 15C

```
AGTAGACTAC TCAGAAAATT ATTTCACGTA ATTGTCTAAG AGGTCAATAT  5150
TTTTTAATGC ATATTGAATC AAATAAAGTG CTCTAAAGAA ATTATTATAC  5200
AAATTCCTTT GGGTTGTTTT TCTTTTCTTA ACAAGGGGTG GGGGTAAACA  5250
GGAATATGAT TCAGGCTTTC TGGTTGTGTA TTTAAAGAGT ATTGATTTTA  5300
TTATTACTAT TGATTTACTT TATTCCTGGC TTCCTTTTCA CTTTTCTTTC  5350
AATTTTAAA  AAATAATTTA AGCCGTTGAA AATATACCAA ACTGTTGAAA  5400
CATTTTACTC AAATTTTAAA TTCCTAAAAA TGTTTTTTAA TAAGAGGGAG  5450
AAAATTATTT AAAAATACTT ATGCCTATGC CAATTCCCCT CTTTTTTCAC  5500
AAAATCCATG ATTTCAGTTT GTAAGTAGAC ATATATCTAA GGGCACATTT  5550
TTGGAAAGTG AGGAATAGCA GCAGTATAAC TTCATTTTGT CAGGCCTTTG  5600
AGTTCTAATA TTTTGTATTG CTCTTCAAAT GGATCCTTTT AAAAAAATTG  5650
TAGATAATGA GTCATAAATA GATTCTGCCA ACTGAGGGGA GAAACATTTT  5700
AAGTAAATAT TTTCAGTAT  TTGGGGCCTT AAAAAATAAT TGTGTTTCCT  5750
TAAAATTACA TGTTAGATAG AGTTTTTAGG TTTTTTTGGT TTAAGATTG   5800
GTTAAAGCAA TTTAAAGCC  ACTTTTTTGT CAACATTTAA TAGCCTCCAC  5850
TTCTGTTAAG ATAATGTATA CTGCTGAGGA ATTACTATTA ATAGCTATCA  5900
ACATACCACC ATTAAATTAA GGTATTCACT TTAGATTTTT TATTAAAGCT  5950
TTTTCTTGC  ACACTGATCG TTGTGTTTCT AAGCTGATTT TTTCAGCTCT  6000
AATATACCTA TGGTTAAAAA GTATAAAAAC TTAAATTGAT ATTTAGATAT  6050
ATGTTTTCCT ATTAGTTTAT GTTTTAAAAA GACAAAATTG TATCTGTCAG  6100
TCCCTGAAGG CAGTTTGTTT TTATACTCTC TCACATTTGT ATTTGTTTT   6150
TAAATGGCAG TATTTTAGAA GATTTGGAGA AAAGTCCACA TAATAATGTT  6200
TTCTTAAAAG CTTTTAAAGT TTTTGCTGTA CTTCAATTTA CTTCTTCCAT  6250
CAGAAAACTA AGAACAAAGT GTTGCTCAGT CTGTTCCGCT GACCTAAATT  6300
TGTGTTTTCA GCACTTGGCT CAGCCAATTC ACTGAGTGAA GGAATTGCTT  6350
TATGAGGCAA AGCATGTGAA AGTTCTAAAG TATGGTTAGA TTGTAGGTCG  6400
TGCTCTATAT GGAAACATCA AACCATTACT ACAGAGAAAT GATAAGGCAT  6450
TGGATCCACT ATTGAAATTA TTATTTTTGG ATCAACAAGT TGGTACTTTC  6500
TGACTTCTGT ATCTTAACAT AAGGGAATTT TAGGTAATGC TAAGTCAGTT  6550
GTCTCATTTT TTGTGATAAG TTTTGGAATT TTTAGTTAAT TGAAATAAAT  6600
AATGCTTTTA AATAGAAGTA AAAGGTTTAT AAGTGTGCAA ATTGTAGATT  6650
TATCAATTAC CTCAGCAGGT ATCCTGCCAT GTAATTATTA GTGATTAGTG  6700
TTAATAAGAT AATAGATTCA GGTCTTCCAA CTATGCCCTT GGATTGTGGC  6750
CTACTGTATG TTATTAAATG GTCTCTTACT ATCCAAAATG GGAGTAGATG  6800
CTGTGGCCCC GTCTCCCTTG GCTTTACGT  CCCATATCCA CCCCCATTCA  6850
TGTACAACAT GTGAAATATA AAAATCTCAT TTCTTGTCAA AATCAGCACT  6900
GCTTATTTGC ATACTCAGCA TCGGATCAGT GAGTAGTTTT ATAAAAAATC  6950
CACGCACCCA ACTCCCTTAG TTAAAACAGA TTCTTAATTC ATACCATGAA  7000
TTCTTAATTT CTGTACCATC TATGTTAATG ATCTGCTGAA GGTGACTCAA  7050
GATTTCAAG  GTGTAATACA GTTGATCAT  GTACCGGACC TGGATATTTA  7100
ATTTTTTTC  CCTCACAGTT AATCTCCTCC TTGATAAAGC AATAACACTG  7150
CTTTGAGTCT GTTGCCTAAT AGCATGTCAG AATCCTCTCC TGGATGGTGA  7200
TTTTATAGGA AAGTTTGTAT GCATATCACC CAGTCTATCT TTTAAAAATT  7250
AAGAAATTTA AATGTATGCT GGAAGTAATG ACACTATATT GTGGCATTTT  7300
ATTTTAAAAA TTGGGGAAAG TTGCATATTT TTTAAAAGT  AAGTGTTTGA  7350
GTAAAAAAAT TGAAGGTACT TTTTAAGGA  AAAAAATTTA TATGCCACAG  7400
TTTACATAGA CATTTCAGAT TCAACACGTA CTCTTGAATA TAATGGTTTC  7450
TTTTACTTGG TCAAAATGCA TGTATAGCAT TTCTTTCATC TTAGTTCCTT  7500
GTGTTTGCCT ATGTGGTCCT TTATATATTT TTATTGTAT  CGAAGAAACA  7550
AAACTATCTT CAAAAATAAG TTAATTTGGA TATATTTGTC ATATCAAACT  7600
ACAAAGTGTA CAAAGTTAAG TTTAGCCCTT TTCTAGAAAG TGATCTTTAA  7650
```

FIG. 15D

```
AATTAAAAAT GCTCCTCTTT TAAATTCACC AAATTTATGT GTGGGAAGGC  7700
ACCAAAATGA TTTTGTAAGT GCCACTGCAA TATTCCCTTT CAAGTGTGGC  7750
CTAAATTTCA ATCTTAAGGA TGGAATGCAT GTCTGCTCCT TGTTCTGAAA  7800
AATGTAGGCA TCTACTACAT TTTAAAACAC AGTGAAACAT ATACATAAGC  7850
CTATAAAAAA AGATTTGTGC AATTTGAAAG CCTGTTAATT TTTTATGTAG  7900
ACATACCTAC ACACGAAAGG GTTAAATTCA CAGCCTTACT AGTTCCTTGC  7950
TTCCAGTATT TCAATTGGTC TCCTCCCCTC ATTATTATTA TTACTACTAG  8000
TACTATTATT TTTGCACATA GTTAACTGCC CTTCAATATG ATTCTTAAAA  8050
AGTGCTGTTT CTGTGGTATC GTATTCTCTA AATAATCATA TTTAATTTTT  8100
TAAAACAAGG TTGCAGTTTC TAATTGTTTC GTTCCTGTGT TTTTGCTGGT  8150
GTGTAATAAA AGCAAGTTTT TTCTTTTCAT GGTTATTTAA TACATTAGCT  8200
GCCTGTAAAT AATTCTTGTT ATAATGCTCT GGAATGTGTT GTAGAAGTTG  8250
TATTAGATTA GTTTTAAACC CTTGTTTGAA AGCCACATTG TTTTGGTTAT  8300
TTCTATTAAA TTAGAAAATT GAAAAAGTTT TCAAATGAA  (SEQ ID NO: 15)
```

FIG. 16

```
MAENKGGGEAESGGGGSGSAPVTAGAAGPAAQEAEPPLTAVLVEEEEEEGGRAGAEGGAA
GPDDGGVAAASSGSAQAASSPAASVGTGVAGGAVSTPAPAPASAPAPGPSAGPPPGPPAS
LLDTCAVCQQSLQSRREAEPKLLPCLHSFCLRCLPEPERQLSVPIPGGSNGDIQQVGVIR
CPVCRQECRQIDLVDNYFVKDTSEAPSSSDEKSEQVCTSCEDNASAVGFCVECGEWLCKT
CIEAHQRVKFTKDHLIRKKEDVSESVGASGQRPVFCPVHKQEQLKLFCETCDRLTCRDCQ
LLEHKEHRYQFLEEAFQNQKGAIENLLAKLLEKKNYVHFAATQVQNRIKEVNETNKRVEQ
EIKVAIFTLINEINKKGKSLLQQLENVTKERQMKLLQQQNDITGLSRQVKHVMNFTNWAI
ASGSSTALLYSKRLITFQLRHILKARCDPVPAANGAIRFHCDPTFWAKNVVNLGNLVIES
KPAPGYTPNVVVGQVPPGTNHISKTPGQINLAQLRLQHMQQQVYAQKHQQLQQMRMQQPP
APVPTTTTTQQHPRQAAPQMLQQQPPRLISVQTMQRGNMNCGAFQAHQMRLAQNAARIP
GIPRHSGPQYSMMQPHLQRQHSNPGHAGPFPVVSVHNTTINPTSPTTATMANANRGPTSP
SVTAIELIPSVTNPENLPSLPDIPPIQLEDAGSSSLDNLLSRYISGSHLPPQPTSTMNPS
PGPSALSPGSSGLSNSHTPVRPPSTSSTGSRGSCGSSGRTAEKTSLSFKSDQVKVKQEPG
TEDEICSFSGGVKQEKTEDGRRSACMLSSPESSLTPPLSTNLHLESELDALASLENHVKI
EPADMNESCKQSGLSSLVNGKSPIRSLMHRSARIGGDGNNKDDDPNEDWCAVCQNGGDLL
CCEKCPKVFHLTCHVPTLLSFPSGDWICTFCRDIGKPEVEYDCDNLQHSKKGKTAQGLSP
VDQRKCERLLLYLYCHELSIEFQEPVPASIPNYYKIIKKPMDLSTVKKKLQKKHSQHYQI
PDDFVADVRLIFKNCERFNEMMKVVQVYADTQEINLKADSEVAQAGKAVALYFEDKLTEI
YSDRTFAPLPEFEQEEDDGEVTEDSDEDFIQPRRKRLKSDERPVHIK-
(SEQ ID NO: 16)
```

FIG. 17A

| | | | | | |
|---|---|---|---|---|---|
| <u>G</u>CGCGCGGGC | GGCGTAGCCG | GCCTGTCTGG | GCCGCCTCGT | GGGGAGGGAG | 50 |
| GGGGCGCCCG | GCCGCCCGGC | GGCGACCCCG | GGGCCTGGCC | GCCACC*ATG*G | 100 |
| GCTTCGAGCT | GGACCGCTTC | GACGGCGACG | TGGACCCGGA | CCTGAAGTGC | 150 |
| GCGCTGTGCC | ACAAGGTCCT | GGAGGACCCG | CTGACCACGC | CGTGCGGCCA | 200 |
| CGTCTTCTGC | GCCGGCTGCG | TGCTGCCCTG | GGTGGTGCAG | GAGGGCAGCT | 250 |
| GCCCGGCGCG | CTGCCGCGGT | CGCCTGTCGG | CCAAAGAGCT | CAACCACGTC | 300 |
| CTGCCGCTCA | AGCGCCTTAT | CCTCAAGCTG | GACATCAAGT | GCGCGTACGC | 350 |
| GACGCGCGGC | TGCGGCCGGG | TGGTCAAGCT | GCAGCAGCTG | CCGGAGCACC | 400 |
| TCGAGCGCTG | CGACTTCGCG | CCCGCGCGCT | GTCGCCACGC | GGGTTGCGGC | 450 |
| CAGGTGCTGC | TGCGGCGCGA | CGTGGAGGCG | CACATGCGCG | ACGCgTGCGA | 500 |
| CGCGCGGCCA | GTGGGCCGCT | GCCAGGAGGG | CTGCGGGCTA | CCCTTGACGC | 550 |
| ACGGCGAGCA | GCGCGCGGGC | GGCCACTGCT | GCGCGCGAGC | GCTGCGGGCG | 600 |
| CACAACGGCG | CGCTCCAGGC | CCGCCTGGGC | GCGCTGCACA | AGGCGCTCAA | 650 |
| GAAGGAGGCG | CTGCGCGCTG | GGAAGCGCGA | GAAGTCGCTG | GTGGCCCAGC | 700 |
| TGGCCGCGGC | GCAGCTTGAG | CTGCAGATGA | CCGCGCTGCG | CTACCAGAAG | 750 |
| AAATTCACCG | AATACAGCGC | GCGCCTCGAC | TCGCTCAGCC | GCTGCGTGGC | 800 |
| CGCGCCGCCC | GGCGGCAA<u>GG</u> | GCGAAGAAAC | CAAAAGTCTG | ACTCTTGTCC | 850 |
| TGCATCGGGA | CTCCGGCTCC | CTGGGATTCA | ATATTATTGG | TGGCCGGCCG | 900 |
| AGTGT<u>GG</u>ATA | ACCACGATGG | ATCATCCAGT | GAAGGAATCT | TTGTATCCAA | 950 |
| GATAGTTGAC | AGTGGGCCTG | CAGCCAAGGA | AGGAGGCCTG | CAAATTCATG | 1000 |
| ACAGGATTAT | TGA<u>GG</u>TCAAC | GGCAGAGACT | TATCCAGAGC | AACTCATGAC | 1050 |
| CAGGCTGTGG | AAGCTTTCAA | GACAGCCAAG | GAGCCCATAG | TGGTGCAGGT | 1100 |
| GTTGAGAAGA | ACACCAAGGA | CCAAAATGTT | CACGCCTCCA | TCAGAGTCTC | 1150 |
| AGCTGGTGGA | CACGGGAACC | CAAACCGACA | TCACCTTTGA | ACATATCATG | 1200 |
| GCCCTCACTA | AGATGTCCTC | TCCCAGCCCA | CCCGTGCTGG | ATCCCTATCT | 1250 |
| CTTGCCAGAG | G<u>AG</u>CATCCCT | CAGCCCATGA | ATACTACGAT | CCAAATGACT | 1300 |
| ACATTGGAGA | CATCCATCAG | GAGATGGACA | GGGAGGAGCT | GGAGCTGGA<u>G</u> | 1350 |
| <u>G</u>AAGTGGACC | TCTACAGAAT | GAACAGCCAG | GACAAGCTGG | GCCTCACTGT | 1400 |
| GTGCTACCGG | ACGGACGATG | AAGACGACAT | TGGGATTTAT | ATCAGTGA<u>GA</u> | 1450 |
| TTGACCCTAA | CAGCATTGCA | GCCAAGGATG | GGCGCATCCG | AGAAGGAGAC | 1500 |
| CGCATTATCC | A<u>GA</u>TTAATGG | GATAGAGGTG | CAGAACCGTG | AAGAGGCTGT | 1550 |
| GGCTCTTCTA | ACCAGTGAAG | AAAATAAAAA | CTTTTCATTG | CTGATTGCAA | 1600 |
| GGCCTGAACT | CCA<u>GC</u>TGGAT | GAGGGCTGGA | TGGATGATGA | CAGGAACGAC | 1650 |
| TTTCTGGATG | ACCTGCACAT | GGACATGCTG | GAGGAGCAGC | ACCACCAGGC | 1700 |
| CATGCAATTC | ACAGCTAGCG | TGCTGCAGCA | <u>GA</u>AGAAGCAC | GACGAAGACG | 1750 |
| GTGGGACCAC | AGATACAGCC | ACCATCTTGT | CCAACCAGCA | CGAGAAGGAC | 1800 |
| AGCGGTGTGG | GGCGGACCGA | CGAGAGCACC | CGTAATGACG | AGAGCTCGGA | 1850 |
| GCAAGAGAAC | AATGGCGACG | ACGCCACCGC | ATCCTCCAAC | CCGCTGGCGG | 1900 |
| GGCAGAGGAA | GCTCACCTGC | AGCCAGGACA | CCTTGGGCAG | CGGCGACCTG | 1950 |
| CCCTTCAGCA | ACGAGTCTTT | CATTTCGGCC | GACTGCACGG | ACGCCGACTA | 2000 |
| CCTGGGGATC | CCGGTGGACG | AGTGCGAGCG | CTTCCGCGAG | CTCCTGGAGC | 2050 |
| TCAAGTGCCA | GGTGAAGAGC | GCCACCCCTT | ACGGCCTGTA | CTACCCTAGC | 2100 |
| GGCCCCCTGG | ACGCCGGCAA | GAGTGACCCT | GAGAGCGTGG | ACAAGGAGCT | 2150 |
| GGAGCTGCTG | AACGAAGAGC | TGCGCAGCAT | CGAGCTGGAG | TGCCTGAGCA | 2200 |
| TCGTGCGCGC | CCACAAGATG | CAGCAGCTCA | AGGAGCAGTA | CCGCGAGTCC | 2250 |
| TGGATGCTGC | ACAACAGCGG | CTTCGCAAC | TACAACACCA | GCATCGACGT | 2300 |
| GCGCAGACAC | GAGCTCTCAG | ATATCACCGA | GCTCCCGGAG | AAATCCGACA | 2350 |
| AGGACAGCTC | GAGCGCCTAC | AACACAGGCG | AGAGCTGCCG | CAGCACCCCG | 2400 |
| CTCACCCTGG | AGATCTCCCC | CGACAACTCC | TTGAGGAGAG | CGGCGGAGGG | 2450 |
| CATCAGCTGC | CCGAGCAGCG | AAGGGGCTGT | GGGGACCACG | GAAGCCTACG | 2500 |
| GGCCAGCCTC | CAAGAATCTG | CTCTCCATCA | CGGAAGATCC | CGAAGTGGGC | 2550 |

FIG. 17B

```
ACCCCTACCT ATAGCCCGTC CCTGAAGGAG CTGGACCCCA ACCAGCCCCT  2600
GGAAAGCAAA GAGCGGAGAG CCAGCGACGG GAGCCGGAGC CCCACGCCCA  2650
GCCAGAAGCT GGGCAGCGCC TACCTGCCCT CCTATCACCA CTCCCCATAC  2700
AAGCACGCGC ACATCCCGGC GCACGCCCAG CACTACCAGA GCTACATGCA  2750
GCTGATCCAG CAGAAGTCGG CCGTGGAGTA CGCGCAAAGC CAGATGAGCC  2800
TGGTGAGCAT GTGCAAGGAC CTGAGCTCTC CCACCCCGTC GGAGCCGCGC  2850
ATGGAGTGGA AGGTGAAGAT CCGCAGCGAC GGGACGCGCT ACATCACCAA  2900
GAGGCCCGTG CGGGACCGCC TGCTGCGGGA GCGCGCCCTG AAGATCCGGG  2950
AAGAGCGCAG CGGCATGACC ACCGACGACG ACGCGGTGAG CGAGATGAAG  3000
ATGGGGCGCT ACTGGAGCAA GGAGGAGAGG AAGCAGCACC TGGTGAAGGC  3050
CAAGGAGCAG CGGCGGCGGC GCGAGTTCAT GATGCAGAGC AGGTTGGATT  3100
GTCTCAAGGA GCAGCAAGCA GCCGATGACA GGAAGGAGAT GAACATTCTC  3150
GAACTGAGCC ACAAAAAGAT GATGAAGAAG AGGAATAAGA AAATCTTCGA  3200
TAACTGGATG ACGATCCAAG AACTCTTAAC CCACGGCACA AAATCCCCGG  3250
ACGGCACTAG AGTATACAAT TCCTTCCTAT CGGTGACTAC TGTATAATTT  3300
TCACTTCTGC ATTATGTACA TAAAGGAGAC CACTACCACT GGGGTAGAAA  3350
TTCCTGCCTC GTTCAATGCG GCAAGTTTTT GTATATAAGA TAAGTACGGT  3400
CTTCATGTTT ATAGTCCAAA TTTGCAAACC CTACAACTCT GGGTGTCATA  3450
GGTCTATTTT AAGGGAAGAG AGAGAAAAAC ACCCTTACTA TCTTGGAAGG  3500
CAATATTAAC AAACAGAGCT TTTTCAAAT AGCAATTGTA CTTTTCTACC    3550
TGTACCCTTT TACATAAAGT GTTTAAATTT CAGAAAGATC TTTTATTAAG  3600
CATACTTTCA CAGAATAACT TGTTTAAACT ATATTCATAT AAAAAAGTTA  3650
AACACGCTTT TTTTCCTGCC TAAAACACAA ATACAACTGC CAGTATGTAT  3700
TTTTAATGGA ACCCTATTTT ATAATGGTAC GTTACTGAAT GTGTTTCATA  3750
TGCGTGACCG TTAAGATATT ATCATTTAGG TGAAGGTTTC AACTCAAAAC  3800
CACCCAACCC GGTGGTTAAC GATTAATAC ATATAACCAA ACCGGCAGCG    3850
TTTAGAGTTG GGATATACAT TTAAACATTT TCCTGGTTAA GGTTCCCAAG  3900
AGAGTGTAAA GGTTTTAGCA GAAAGCAAAA TATCTTGCAT CTTTATGGAA  3950
GTTTAAAGCA TGTTTGCAAA TATTGCAGCC CATTGAAAGA ATTTGCATGT  4000
ACAGGAAAGT TGTGGATGGA GACGGTTTGT GGAATTTTAA GTGCTCATTG  4050
TAGTAAACTT TTGCTTTGTA GATTGAAGG TACAGACTTA TACAGGCAAG    4100
TTCACAAAAT CATGATTAGT TACAAACAGT AAAATGAAGT TAAAATAAAT  4150
TATTATTTTC T (SEQ ID NO: 17)
```

FIG. 18

```
MGFELDRFDGDVDPDLKCALCHKVLEDPLTTPCGHVFCAGCVLPWVVQEGSCPARCRGRL
SAKELNHVLPLKRLILKLDIKCAYATRGCGRVVKLQQLPEHLERCDFAPARCRHAGCGQV
LLRRDVEAHMRDACDARPVGRCQEGCGLPLTHGEQRAGGHCCARALRAHNGALQARLGAL
HKALKKEALRAGKREKSLVAQLAAAQLELQMTALRYQKKFTEYSARLDSLSRCVAAPPGG
KGEETKSLTLVLHRDSGSLGFNIIGGRPSVDNHDGSSSEGIFVSKIVDSGPAAKEGGLQI
HDRIIEVNGRDLSRATHDQAVEAFKTAKEPIVVQVLRRTPRTKMFTPPSESQLVDTGTQT
DITFEHIMALTKMSSPSPPVLDPYLLPEEHPSAHEYYDPNDYIGDIHQEMDREELELEEV
DLYRMNSQDKLGLTVCYRTDDEDDIGIYISEIDPNSIAAKDGRIREGDRIIQINGIEVQN
REEAVALLTSEENKNFSLLIARPELQLDEGWMDDDRNDFLDDLHMDMLEEQHHQAMQFTA
SVLQQKKHDEDGGTTDTATILSNQHEKDSGVGRTDESTRNDESSEQENNGDDATASSNPL
AGQRKLTCSQDTLGSGDLPFSNESFISADCTDADYLGIPVDECERFRELLELKCQVKSAT
PYGLYYPSGPLDAGKSDPESVDKELELLNEELRSIELECLSIVRAHKMQQLKEQYRESWM
LHNSGFRNYNTSIDVRRHELSDITELPEKSDKDSSSAYNTGESCRSTPLTLEISPDNSLR
RAAEGISCPSSEGAVGTTEAYGPASKNLLSITEDPEVGTPTYSPSLKELDPNQPLESKER
RASDGSRSPTPSQKLGSAYLPSYHHSPYKHAHIPAHAQHYQSYMQLIQQKSAVEYAQSQM
SLVSMCKDLSSPTPSEPRMEWKVKIRSDGTRYITKRPVRDRLLRERALKIREERSGMTTD
DDAVSEMKMGRYWSKEERKQHLVKAKEQRRREFMMQSRLDCLKEQQAADDRKEMNILEL
SHKKMMKKRNKKIFDNWMTIQELLTHGTKSPDGTRVYNSFLSVTTV-
(SEQ ID NO: 18)
```

FIG. 19A

```
AGGAGGACCT ATTAGAGCCT TTGCCCCGGC GTCGGTGACT CAGTGTTCGC   50
GGGAGCGCCG CACCTACACC AGCCAACCCA GATCCCGAGG TCCGACAGCG  100
CCCGGCCCAG ATCCCCACGC CTGCCAGGAG CAAGCCGAGA GCCAGCCGGC  150
CGGCGCACTC CGACTCCGAG CAGTCTCTGT CCTTCGACCC GAGCCCCGCG  200
CCCTTTCCGG GACCCCTGCC CCGCGGGCAG CGCTGCCAAC CTGCCGGCCA  250
TGGAGACCCC GTCCCAGCGG CGCGCCACCC GCAGCGGGGC GCAGGCCAGC  300
TCCACTCCGC TGTCGCCCAC CCGCATCACC CGGCTGCAGG AGAAGGAGGA  350
CCTGCAGGAG CTCAATGATC GCTTGGCGGT CTACATCGAC CGTGTGCGCT  400
CGCTGGAAAC GGAGAACGCA GGGCTGCGCC TTCGCATCAC CGAGTCTGAA  450
GAGGTGGTCA GCCGCGAGGT GTCCGGCATC AAGGCCGCCT ACGAGGCCGA  500
GCTCGGGGAT GCCCGCAAGA CCCTTGACTC AGTAGCCAAG GAGCGCGCCC  550
GCCTGCAGCT GGAGCTGAGC AAAGTGCGTG AGGAGTTTAA GGAGCTGAAA  600
GCGCGCAATA CCAAGAAGGA GGGTGACCTG ATAGCTGCTC AGGCTCGGCT  650
GAAGGACCTG GAGGCTCTGC TGAACTCCAA GGAGGCCGCA CTGAGCACTG  700
CTCTCAGTGA GAAGCGCACG CTGGAGGGCG AGCTGCATGA TCTGCGGGGC  750
CAGGTGGCCA AGCTTGAGGC AGCCCTAGGT GAGGCCAAGA AGCAACTTCA  800
GGATGAGATG CTGCGGCGGG TGGATGCTGA GAACAGGCTG CAGACCATGA  850
AGGAGGAACT GGACTTCCAG AAGAACATCT ACAGTGAGGA GCTGCGTGAG  900
ACCAAGCGCC GTCATGAGAC CCGACTGGTG GAGATTGACA ATGGGAAGCA  950
GCGTGAGTTT GAGAGCCGGC TGGCGGATGC GCTGCAGGAA CTGCGGGCCC 1000
AGCATGAGGA CCAGGTGGAG CAGTATAAGA AGGAGCTGGA GAAGACTTAT 1050
TCTGCCAAGC TGGACAATGC CAGGCAGTCT GCTGAGAGGA ACAGCAACCT 1100
GGTGGGGGCT GCCCACGAGG AGCTGCAGCA GTCGCGCATC CGCATCGACA 1150
GCCTCTCTGC CCAGCTCAGC CAGCTCCAGA AGCAGCTGGC AGCCAAGGAG 1200
GCGAAGCTTC GAGACCTGGA GGACTCACTG GCCCGTGAGC GGGACACCAG 1250
CCGGCGGCTG CTGGCGGAAA AGGAGCGGGA GATGGCCGAG ATGCGGGCAA 1300
GGATGCAGCA GCAGCTGGAC GAGTACCAGG AGCTTCTGGA CATCAAGCTG 1350
GCCCTGGACA TGGAGATCCA CGCCTACCGC AAGCTCTTGG AGGGCGAGGA 1400
GGAGAGGCTA CGCCTGTCCC CCAGCCCTAC CTCGCAGCGC AGCCGTGGCC 1450
GTGCTTCCTC TCACTCATCC CAGACACAGG GTGGGGGCAG CGTCACCAAA 1500
AAGCGCAAAC TGGAGTCCAC TGAGAGCCGC AGCAGCTTCT CACAGCACGC 1550
ACGCACTAGC GGGCGCGTGG CCGTGGAGGA GGTGGATGAG GAGGGCAAGT 1600
TTGTCCGGCT GCGCAACAAG TCCAATGAGG ACCAGTCCAT GGGCAATTGG 1650
CAGATCAAGC GCCAGAATGG AGATGATCCC TTGCTGACTT ACCGGTTCCC 1700
ACCAAAGTTC ACCCTGAAGG CTGGGCAGGT GGTGACGATC TGGGCTGCAG 1750
GAGCTGGGGC CACCCACAGC CCCCCTACCG ACCTGGTGTG GAAGGCACAG 1800
AACACCTGGG GCTGCGGGAA CAGCCTGCGT ACGGCTCTCA TCAACTCCAC 1850
TGGGGAAGAA GTGGCCATGC GCAAGCTGGT GCGCTCAGTG ACTGTGGTTG 1900
AGGACGACGA GGATGAGGAT GGAGATGACC TGCTCCATCA CCACCACGGC 1950
TCCCACTGCA GCAGCTCGGG GGACCCCGCT GAGTACAACC TGCGCTCGCG 2000
CACCGTGCTG TGCGGGACCT GCGGGCAGCC TGCCGACAAG GCATCTGCCA 2050
GCGGCTCAGG AGCCCAGGTG GGCGGACCCA TCTCCTCTGG CTCTTCTGCC 2100
TCCAGTGTCA CGGTCACTCG CAGCTACCGC AGTGTGGGGG GCAGTGGGGG 2150
TGGCAGCTTC GGGGACAATC TGGTCACCCG CTCCTACCTC CTGGGCAACT 2200
CCAGCCCCCG AACCCAGAGC CCCCAGAACT GCAGCATCAT GTAATCTGGG 2250
ACCTGCCAGG CAGGGGTGGG GGTGGAGGCT TCCTGCGTCC TCCTCACCTC 2300
ATGCCCACCC CCTGCCCTGC ACGTCATGGG AGGGGGCTTG AAGCCAAAGA 2350
AAAATAACCC TTTGGTTTTT TCTTCTGTA  TTTTTTTTC  TAAGAGAAGT 2400
TATTTTCTAC AGTGGTTTTA TACTGAAGGA AAAACACAAG CAAAAAAAA  2450
AAAAAGCATC TATCTCATCT ATCTCAATCC TAATTTCTCC TCCCTTCCTT 2500
TTCCCTGCTT CCAGGAAACT CCACATCTGC CTTAAAACCA AAGAGGGCTT 2550
```

FIG. 19B

```
CCTCTAGAAG CCAAGGGAAA GGGGTGCTTT TATAGAGGCT AGCTTCTGCT 2600
TTTCTGCCCT GGCTGCTGCC CCCACCCCGG GGACCCTGTG ACATGGTGCC 2650
TGAGAGGCAG GCATAGAGGC TTCTCCGCCA GCCTCCTCTG GACGGCAGGC 2700
TCACTGCCAG GCCAGCCTCC GAGAGGGAGA GAGAGAGAGA GAGGACAGCT 2750
TGAGCCGGGC CCCTGGGCTT GGCCTGCTGT GATTCCACTA CACCTGGCTG 2800
AGGTTCCTCT GCCTGCCCCG CCCCCAGTCC CCACCCCTGC CCCCAGCCCC 2850
GGGGTGAGTC CATTCTCCCA GGTACCAGCT GCGCTTGCTT TTCTGTATTT 2900
TATTTAGACA AGAGATGGGA ATGAGGTGGG AGGTGGAAGA AGGGAGAAGA 2950
AAGGTGAGTT TGAGCTGCCT TCCCTAGCTT TAGACCCTGG GTGGGCTCTG 3000
TGCAGTCACT GGAGGTTGAA GCCAAGTGGG GTGCTGGGAG GAGGGAGAGG 3050
GAGGTCACTG GAAAGGGGAG AGCCTGCTGG CACCCACCGT GGAGGAGGAA 3100
GGCAAGAGGG GGTGGAGGGG TGTGGCAGTG GTTTTGGCAA ACGCTAAAGA 3150
GCCCTTGCCT CCCCATTTCC CATCTGCACC CCTTCTCTCC TCCCCAAATC 3200
AATACACTAG TTGTTTCTAC CCCTGGCaaa aaaaaaaaa (SEQ ID NO: 19)
```

FIG. 20

```
METPSQRRATRSGAQASSTPLSPTRITRLQEKEDLQELNDRLAVYIDRVRSLETENAGLR
LRITESEEVVSREVSGIKAAYEAELGDARKTLDSVAKERARLQLELSKVREEFKELKARN
TKKEGDLIAAQARLKDLEALLNSKEAALSTALSEKRTLEGELHDLRGQVAKLEAALGEAK
KQLQDEMLRRVDAENRLQTMKEELDFQKNIYSEELRETKRRHETRLVEIDNGKQREFESR
LADALQELRAQHEDQVEQYKKELEKTYSAKLDNARQSAERNSNLVGAAHEELQQSRIRID
SLSAQLSQLQKQLAAKEAKLRDLEDSLARERDTSRRLLAEKEREMAEMRARMQQQLDEYQ
ELLDIKLALDMEIHAYRKLLEGEEERLRLSPSPTSQRSRGRASSHSSQTQGGGSVTKKRK
LESTESRSSFSQHARTSGRVAVEEVDEEGKFVRLRNKSNEDQSMGNWQIKRQNGDDPLLT
YRFPPKFTLKAGQVVTIWAAGAGATHSPPTDLVWKAQNTWGCGNSLRTALINSTGEEVAM
RKLVRSVTVVEDDEDEDGDDLLHHHHGSHCSSSGDPAEYNLRSRTVLCGTCGQPADKASA
SGSGAQVGGPISSGSSASSVTVTRSYRSVGGSGGGSFGDNLVTRSYLLGNSSPRTQSPQN
CSIM- (SEQ ID NO: 20)
```

FIG. 21A

```
TGCAGCTGGG AGCGCACAGA CGGCTGCCCC GCCTGAGCGA GGCGGGCGCC  50
GCCGCGATGC TGCGAGGCGG ACGGCGCGGG CAGCTTGGCT GGCACAGCTG  100
GGCTGCGGGG CCGGGCAGCC TGCTGGCTTG GCTGATACTG GCATCTGCGG  150
GCGCCGCACC CTGCCCCGAT GCCTGCTGCC CCCACGGCTC CTCGGGACTG  200
CGATGCACCC GGGATGGGGC CCTGGATAGC CTCCACCACC TGCCCGGCGC  250
AGAGAACCTG ACTGAGCTCT ACATCGAGAA CCAGCAGCAT CTGCAGCATC  300
TGGAGCTCCG TGATCTGAGG GGCCTGGGGG AGCTGAGAAA CCTCACCATC  350
GTGAAGAGTG GTCTCCGTTT CGTGGCGCCA GATGCCTTCC ATTTCACTCC  400
TCGGCTCAGT CGCCTGAATC TCTCCTTCAA CGCTCTGGAG TCTCTCTCCT  450
GGAAAACTGT GCAGGGCCTC TCCTTACAGG AACTGGTCCT GTCGGGGAAC  500
CCTCTGCACT GTTCTTGTGC CCTGCGCTGG CTACAGCGCT GGGAGGAGGA  550
GGGACTGGGC GGAGTGCCTG AACAGAAGCT GCAGTGTCAT GGGCAAGGGC  600
CCCTGGCCCA CATGCCCAAT GCCAGCTGTG GTGTGCCCAC GCTGAAGGTC  650
CAGGTGCCCA ATGCCTCGGT GGATGTGGGG GACGACGTGC TGCTGCGGTG  700
CCAGGTGGAG GGGCGGGGCC TGGAGCAGGC CGGCTGGATC CTCACAGAGC  750
TGGAGCAGTC AGCCACGGTG ATGAAATCTG GGGGTCTGCC ATCCCTGGGG  800
CTGACCCTGG CCAATGTCAC CAGTGACCTC AACAGGAAGA ACGTGACGTG  850
CTGGGCAGAG AACGATGTGG GCCGGGCAGA GGTCTCTGTT CAGGTCAACG  900
TCTCCTTCCC GGCCAGTGTG CAGCTGCACA CGGCGGTGGA GATGCACCAC  950
TGGTGCATCC CCTTCTCTGT GGATGGGCAG CCGGCACCGT CTCTGCGCTG  1000
GCTCTTCAAT GGCTCCGTGC TCAATGAGAC CAGCTTCATC TTCACTGAGT  1050
TCCTGGAGCC GGCAGCCAAT GAGACCGTGC GGCACGGGTG TCTGCGCCTC  1100
AACCAGCCCA CCCACGTCAA CAACGGCAAC TACACGCTGC TGGCTGCCAA  1150
CCCCTTCGGC CAGGCCTCCG CCTCCATCAT GGCTGCCTTC ATGGACAACC  1200
CTTTCGAGTT CAACCCCGAG GACCCCATCC CTGTCTCCTT CTCGCCGGTG  1250
GACACTAACA GCACATCTGG AGACCGGTG GAGAAGAAGG ACGAAACACC  1300
TTTTGGGGTC TCGGTGGCTG TGGGCCTGGC CGTCTTTGCC TGCCTCTTCC  1350
TTTCTACGCT GCTCCTTGTG CTCAACAAAT GTGGACGGAG AAACAAGTTT  1400
GGGATCAACC GCCCGGCTGT GCTGGCTCCA GAGGATGGGC TGGCCATGTC  1450
CCTGCATTTC ATGACATTGG GTGGCAGCTC CCTGTCCCCC ACCGAGGGCA  1500
AAGGCTCTGG GCTCCAAGGC CACATCATCG AGAACCCACA ATACTTCAGT  1550
GATGCCTGTG TTCACCACAT CAAGCGCCGG GACATCGTGC TCAAGTGGGA  1600
GCTGGGGGAG GGCGCCTTTG GGAAGGTCTT CCTTGCTGAG TGCCACAACC  1650
TCCTGCCTGA GCAGGACAAG ATGCTGGTGG CTGTCAAGGC ACTGAAGGAG  1700
GCGTCCGAGA GTGCTCGGCA GGACTTCCAG CGTGAGGCTG AGCTGCTCAC  1750
CATGCTGCAG CACCAGCACA TCGTGCGCTT CTTCGGCGTC TGCACCGAGG  1800
GCCGCCCCCT GCTCATGGTC TTTGAGTATA TGCGGCACGG GGACCTCAAC  1850
CGCTTCCTCC GATCCCATGG ACCTGATGCC AAGCTGCTGG CTGGTGGGGA  1900
GGATGTGGCT CCAGGCCCCC TGGGTCTGGG GCAGCTGCTG GCCGTGGCTA  1950
GCCAGGTCGC TGCGGGGATG GTGTACCTGG CGGGTCTGCA TTTTGTGCAC  2000
CGGGACCTGG CCACACGCAA CTGTCTAGTG GGCCAGGGAC TGGTGGTCAA  2050
GATTGGTGAT TTTGGCATGA GCAGGGATAT CTACAGCACC GACTATTACC  2100
GTGTGGGAGG CCGCACCATG CTGCCCATTC GCTGGATGCC GCCCGAGAGC  2150
ATCCTGTACC GTAAGTTCAC CACCGAGAGC GACGTGTGGA GCTTCGGCGT  2200
GGTGCTCTGG GAGATCTTCA CCTACGGCAA GCAGCCCTGG TACCAGCTCT  2250
CCAACACGGA GGCAATCGAC TGCATCACGC AGGGACGTGA GTTGGAGCGG  2300
CCACGTGCCT GCCCACCAGA GGTCTACGCC ATCATGCGGG GCTGCTGGCA  2350
GCGGGAGCCC CAGCAACGCC ACAGCATCAA GGATGTGCAC GCCCGGCTGC  2400
AAGCCCTGGC CCAGGCACCT CCTGTCTACC TGGATGTCCT GGGCTAGGGG  2450
GCCGGCCCAG GGGCTGGGAG TGGTTAGCCG GAATACTGGG GCCTGCCCTC  2500
AGCATCCCCC ATAGCTCCCA GCAGCCCCAG GGTGATCTCA AAGTATCTAA  2550
```

FIG. 21B

```
TTCACCCTCA GCATGTGGGA AGGGACAGGT GGGGGCTGGG AGTAGAGGAT  2600
GTTCCTGCTT CTCTAGGCAA GGTCCCGTCA TAGCAATTAT ATTTATTATC  2650
CCTTGaaaaa aaa (SEQ ID NO: 21)
```

FIG. 22

```
MLRGGRRGQLGWHSWAAGPGSLLAWLILASAGAAPCPDACCPHGSSGLRCTRDGALDSLH
HLPGAENLTELYIENQQHLQHLELRDLRGLGELRNLTIVKSGLRFVAPDAFHFTPRLSRL
NLSFNALESLSWKTVQGLSLQELVLSGNPLHCSCALRWLQRWEEEGLGGVPEQKLQCHGQ
GPLAHMPNASCGVPTLKVQVPNASVDVGDDVLLRCQVEGRGLEQAGWILTELEQSATVMK
SGGLPSLGLTLANVTSDLNRKNVTCWAENDVGRAEVSVQVNVSFPASVQLHTAVEMHHWC
IPFSVDGQPAPSLRWLFNGSVLNETSFIFTEFLEPAANETVRHGCLRLNQPTHVNNGNYT
LLAANPFGQASASIMAAFMDNPFEFNPEDPIPVSFSPVDTNSTSGDPVEKKDETPFGVSV
AVGLAVFACLFLSTLLLVLNKCGRRNKFGINRPAVLAPEDGLAMSLHFMTLGGSSLSPTE
GKGSGLQGHIIENPQYFSDACVHHIKRRDIVLKWELGEGAFGKVFLAECHNLLPEQDKML
VAVKALKEASESARQDFQREAELLTMLQHQHIVRFFGVCTEGRPLLMVFEYMRHGDLNRF
LRSHGPDAKLLAGGEDVAPGPLGLGQLLAVASQVAAGMVYLAGLHFVHRDLATRNCLVGQ
GLVVKIGDFGMSRDIYSTDYYRVGGRTMLPIRWMPPESILYRKFTTESDVWSFGVVLWEI
FTYGKQPWYQLSNTEAIDCITQGRELERPRACPPEVYAIMRGCWQREPQQRHSIKDVHAR
LQALAQAPPVYLDVLG- (SEQ ID NO: 22)
```

FIG. 23A

```
TGGACGAGCG CGCTTCCGAC CCGCCGCCAC CGCCTCCTCC CCTCCTTCTC  50
GGCCCGCCCC CTCCCTCGCC TCTTCCTGCC AGGCGGCCCT TCTCCCCTCC  100
CCTCTCAGTT CCCTCCGCCC TCCTCGGGCT CCAGCGGTGG CGGAGCGAAC  150
GGGACCGGCC CGGCTTCAGA GCGCGAGGTG GAGGGTGGAA CGCGGGCGCC  200
TGAAGGAGTT GTTGTCTCGG CAGCGCCCGC GGAGACGTGA AGAGGTGGTT  250
GTGGGAAGAG AAGTTTGCAG AACTGAAATG GAGGTCAGAG CTTCATTACA  300
GAAGGTTAGT GGATCATCTG ATTCTGTGGC TACAATGAAC AGTGAAGAAT  350
TTGTTTTGGT TCCTCAGTAT GCAGATGATA ATTCTACAAA ACATGAAGAA  400
AAACCTCAAC TGAAGATAGT TTCTAATGGT GATGAACAAT TGGAAAAAGC  450
CATGGAAGAG ATTTGAGAG ATTCCGAGAA AAGGCCAAGC AGTCTTCTTG  500
TTGATTGTCA AAGTTCCAGT GAGATTTCAG ACCATTCGTT TGGAGATATT  550
CCAGCCAGCC AAACAAATAA GCCATCTCTT CAGTTAATTT TGGATCCGTC  600
TAACACAGAA ATTTCTACAC CCAGACCATC TTCTCCAGGT GGACTACCTG  650
AAGAAGATAG TGTTTTATTT AATAAACTGA CCTACTTAGG ATGTATGAAG  700
GTTTCTTCCC CACGTAATGA AGTAGAGGCT TTACGGGCAA TGGCAACCAT  750
GAAATCTTCC AGTCAATACC CCTTTCCTGT TACCCTGTAT GTACCAAATG  800
TTCCAGAAGG TTCTGTGAGA ATTATAGACC AATCCAGCAA TGTGGAGATA  850
GCATCTTTTC CAATCTATAA GGTGTTATTC TGTGCACGTG ACATGACGG   900
AACAACAGAG AGCAATTGCT TTGCATTTAC AGAGAGTTCC CATGGTTCGG  950
AAGAATTTCA GATACATGTT TTCTCCTGTG AAATTAAAGA GGCAGTAAGC  1000
AGAATTTTGT ACAGTTTCTG TACAGCATTC AAACGTTCTT CCAGACAAGT  1050
GTCTGATGTT AAAGACTCAG TTATTCCTAC CCCCGACAGT GATGTGTTTA  1100
CCTTCAGTGT CTCCTTGGAG GTAAAAGAAG ACGATGGAAA AGGAAACTTT  1150
AGCCCTGTGC CTAAGGATAG AGATAAATTT TATTTCAAAT TAAAGCAAGG  1200
AATAGAGAAG AAGGTTGTGA TTACAGTGCA GCAACTTTCT AACAAAGAAT  1250
TAGCTATTGA AAGATGTTTT GGAATGTTAT TAAGCCCAGG TCGAAACGTG  1300
AAGAACAGTG ACATGCATTT ACTGGATATG GAATCCATGG GAAAGAGCTA  1350
TGATGGGAGA GCTTATGTCA TCACTGGCAT GTGGAACCCC AATGCACCAG  1400
TATTTCTGGC ACTTAACGAG GAAACCCCAA AAGATAAGCA AGTATACATG  1450
ACTGTGGCAG TGGATATGGT AGTCACAGAG GTGGTGGAGC CTGTTCGCTT  1500
TCTCCTGGAG ACAGTAGTCC GTGTGTACCC TGCAAATGAG CGATTTTGGT  1550
ATTTCAGCAG AAAGACTTTC ACAGAGACTT TCTTCATGAG ATTGAAACAG  1600
TCTGAGGGAA AAGGCCATAC CAATGCTGGA GATGCAATAT ATGAGGTGGT  1650
GAGTCTACAG CGAGAGTCTG ACAAGGAGGA ACCAGTCACT CCTACTAGTG  1700
GAGGGGGTCC AATGTCACCC CAGGATGATG AAGCAGAAGA GGAGAGTGAT  1750
AATGAACTCT CAAGTGGAAC AGGTGATGTG TCTAAGGATT GTCCTGAGAA  1800
GATCCTGTAT TCTTGGGGAG AGTTGCTAGG AAAATGGCAC AGTAACCTTG  1850
GTGCACGACC GAAAGGGCTG TCTACTCTGG TGAAGAGTGG TGTCCCTGAA  1900
GCATTGAGGG CAGAGGTATG GCAGTTATTG GCAGGCTGCC ATGACAACCA  1950
GGCAATGCTG GATAGATACC GAATTCTTAT CACAAAGGAC TCAGCCCAGG  2000
AGAGTGTTAT TACTCGAGAT ATTCATCGTA CATTTCCCGC ACATGATTAC  2050
TTTAAAGATA CTGGAGGAGA TGGTCAAGAA TCGCTCTATA AGATCTGCAA  2100
GGCCTACTCT GTGTATGATG AAGACATTGG GTACTGTCAA GGGCAGTCTT  2150
TTCTTGCTGC TGTATTACTG CTGCATATGC CAGAGGAACA AGCATTCTGT  2200
GTTTGGTGA AAATCATGTA CGACTATGGT TTGAGAGACC TCTACAGAAA  2250
CAACTTCGAA GATCTTCATT GCAAATTCTA CCAGTTGGAG AGACTAATGC  2300
AGGAACAGCT ACCGGACCTG CATAGCCATT TTTCTGATCT GAACCTGGAA  2350
GCTCATATGT ATGCATCCCA GTGGTTTCTC ACTCTTTTTA CTGCCAAGTT  2400
CCCACTCTGC ATGGTGTTCC ACATCATTGA CTTACTGCTT TGTGAGGGTT  2450
TGAACATAAT CTTTCATGTA GCTTTGGCTC TCCTAAAGAC CTCAAAGGAA  2500
GACCTTCTGC AGGCTGATTT TGAAGGTGCT TTAAAGTTCT TTAGAGTTCA  2550
```

FIG. 23B

```
GCTTCCAAAG AGATACAGGG CAGAGGAAAA TGCAAGAAGA CTGATGGAGC  2600
AGGCTTGCAA TATTAAAGTA CCAACCAAGA AGCTGAAGAA ATATGAGAAA  2650
GAATATCAGA CAATGCGAGA GAGTCAGCTG CAACAGGAAG ACCCAATGGA  2700
TAGATACAAG TTTGTATATT TGTAGGTAAC TCCAGCTGTT GCATTTATAC  2750
TGGGAATCTT CATAAGAAGC TGAGAGAAAG AGAGGGGAAA AAGAAAGTGG  2800
CTTTCTACTT TCAAAAATGA AACAAAAAGG AAAAATGGCA AAGTACTGTT  2850
TTAGCTGTGC ATGTCATATC CACAAAGACT TTTAGCAGGT GAACTGTTCC  2900
AAGACTGACA CAAGGATGTT TCAAACTTGC CTCTGTCTGT AGAAAATGTT  2950
AAAAATACCA ACTCACTTGG AAGGAAAAAT AAAAATCACA AAGGTATATT  3000
GAGCACAGTA aaaaaaaaaa aa (SEQ ID NO: 23)
```

FIG. 24

```
MEVRASLQKVSGSSDSVATMNSEEFVLVPQYADDNSTKHEEKPQLKIVSNGDEQLEKAME
EILRDSEKRPSSLLVDCQSSSEISDHSFGDIPASQTNKPSLQLILDPSNTEISTPRPSSP
GGLPEEDSVLFNKLTYLGCMKVSSPRNEVEALRAMATMKSSSQYPFPVTLYVPNVPEGSV
RIIDQSSNVEIASFPIYKVLFCARGHDGTTESNCFAFTESSHGSEEFQIHVFSCEIKEAV
SRILYSFCTAFKRSSRQVSDVKDSVIPTPDSDVFTFSVSLEVKEDDGKGNFSPVPKDRDK
FYFKLKQGIEKKVVITVQQLSNKELAIERCFGMLLSPGRNVKNSDMHLLDMESMGKSYDG
RAYVITGMWNPNAPVFLALNEETPKDKQVYMTVAVDMVVTEVVEPVRFLLETVVRVYPAN
ERFWYFSRKTFTETFFMRLKQSEGKGHTNAGDAIYEVVSLQRESDKEEPVTPTSGGGPMS
PQDDEAEEESDNELSSGTGDVSKDCPEKILYSWGELLGKWHSNLGARPKGLSTLVKSGVP
EALRAEVWQLLAGCHDNQAMLDRYRILITKDSAQESVITRDIHRTFPAHDYFKDTGGDGQ
ESLYKICKAYSVYDEDIGYCQGQSFLAAVLLLHMPEEQAFCVLVKIMYDYGLRDLYRNNF
EDLHCKFYQLERLMQEQLPDLHSHFSDLNLEAHMYASQWFLTLFTAKFPLCMVFHIIDLL
LCEGLNIIFHVALALLKTSKEDLLQADFEGALKFFRVQLPKRYRAEENARRLMEQACNIK
VPTKKLKKYEKEYQTMRESQLQQEDPMDRYKFVYL- (SEQ ID NO: 24)
```

FIG. 25A

```
GCGGCCGCGC TGAGCCCCTA GCCCGCCGGG AGCGCCAGGC CGGCCAGGCC   50
TGCGCCGCCG CCGCCGCCGC CGTCGCCGCC GCGCCGACCA TGTCGGCAGC  100
CAAGGAGAAC CCGTGCAGGA AATTCCAGGC CAACATCTTC AACAAGAGCA  150
AGTGTCAGAA CTGCTTCAAG CCCCGCGAGT CGCATCTGCT CAACGACGAG  200
GACCTGACGC AGGCAAAACC CATTTATGGC GGTTGGCTGC TCCTGGCTCC  250
AGATGGGACC GACTTTGACA ACCCAGTGCA CCGGTCTCGG AAATGGCAGC  300
GACGGTTCTT CATCCTTTAC GAGCACGGCC TCTTGCGCTA CGCCCTGGAT  350
GAGATGCCCA CGACCCTTCC TCAGGGCACC ATCAACATGA ACCAGTGCAC  400
AGATGTGGTG GATGGGGAGG GCCGCACGGG CCAGAAGTTC TCCCTGTGTA  450
TTCTGACGCC TGAGAAGGAG CATTTCATCC GGGCGGAGAC CAAGGAGATC  500
GTCAGTGGGT GGCTGGAGAT GCTCATGGTC TATCCCCGGA CCAACAAGCA  550
GAATCAGAAG AAGAAACGGA AAGTGGAGCC CCCCACACCA CAGGAGCCTG  600
GGCCTGCCAA GGTGGCTGTT ACCAGCAGCA GCAGCAGCAG CAGCAGCAGC  650
AGCAGCATCC CCAGTGCTGA GAAAGTCCCC ACCACCAAGT CCACACTCTG  700
GCAGGAAGAA ATGAGGACCA AGGACCAGCC AGATGGCAGC AGCCTGAGTC  750
CAGCTCAGAG TCCCAGCCAG AGCCAGCCTC CTGCTGCCAG CTCCCTGCGG  800
GAACCTGGGC TAGAGAGCAA AGAAGAGGAG AGCGCCATGA GTAGCGACCG  850
CATGGACTGT GGCCGCAAAG TCCGGGTGGA GAGCGGCTAC TTCTCTCTGG  900
AGAAGACCAA ACAGGACTTG AAGGCTGAAG AACAGCAGCT GCCCCCGCCG  950
CTCTCCCCTC CCAGCCCCAG CACCCCCAAC CACAGGAGGT CCCAGGTGAT 1000
TGAAAAGTTT GAGGCCTTGG ACATTGAGAA GGCAGAGCAC ATGGAGACCA 1050
ATGCAGTGGG GCCCTCACCA TCCAGCGACA CACGCCAGGG CCGCAGCGAG 1100
AAGAGGGCGT TCCCTAGGAA GCGGGACTTC ACCAATGAAG CCCCCCCAGC 1150
TCCTCTCCCA GACGCCTCGG CTTCCCCCCT GTCTCCACAC CGAAGAGCCA 1200
AGTCACTGGA CAGGAGGTCC ACGGAGCCCT CCGTGACGCC CGACCTGCTG 1250
AATTTCAAGA AAGGCTGGCT GACTAAGCAG TATGAGGACG GCCAGTGGAA 1300
GAAACACTGG TTTGTCCTCG CCGATCAAAG CCTGAGATAC TACAGGGATT 1350
CAGTGGCTGA GGAGGCAGCC GACTTGGATG GAGAAATTGA CTTGTCCGCA 1400
TGTTACGATG TCACAGAGTA TCCAGTTCAG AGAAACTATG GCTTCCAGAT 1450
ACATACAAAG GAGGGCGAGT TTACCCTGTC GGCCATGACA TCTGGGATTC 1500
GGCGGAACTG GATCCAGACC ATCATGAAGC ACGTGCACCC GACCACTGCC 1550
CCGGATGTGA CCAGCTCGTT GCCAGAGGAA AAAAACAAGA GCAGCTGCTC 1600
TTTTGAGACC TGCCCGAGGC CTACTGAGAA GCAAGAGGCA GAGCTGGGGG 1650
AGCCGGACCC TGAGCAGAAG AGGAGCCGCG CACGGGAGCG GAGGCGAGAG 1700
GGCCGCTCCA AGACCTTTGA CTGGGCTGAG TTCCGTCCCA TCCAGCAGGC 1750
CCTGGCTCAG GAGCGGGTGG GCGGCGTGGG GCCTGCTGAC ACCCACGAGC 1800
CCCTGCGCCC TGAGGCGGAG CCTGGGGAGC TGGAGCGGGA GCGTGCACGG 1850
AGGCGGGAGG AGCGCCGCAA GCGCTTCGGG ATGCTCGACG CCACAGACGG 1900
GCCAGGCACT GAGGATGCAG CCCTGCGCAT GGAGGTGGAC CGGAGCCCAG 1950
GGCTGCCTAT GAGCGACCTC AAAACGCATA ACGTCCACGT GGAGATTGAG 2000
CAGCGGTGGC ATCAGGTGGA GACCACACCT CTCCGGGAAG AGAAGCAGGT 2050
GCCCATCGCC CCCGTCCACC TGTCTTCTGA AGATGGGGGT GACCGGCTCT 2100
CCACACACGA GCTGACCTCT CTGCTCGAGA AGGAGCTGGA GCAGAGCCAG 2150
AAGGAGGCCT CAGACCTTCT GGAGCAGAAC CGGCTCCTGC AGGACCAGCT 2200
GAGGGTGGCC CTGGGCCGGG AGCAGAGCGC CCGTGAGGGC TACGTGCTGC 2250
AGGCCACGTG CGAGCGAGGG TTTGCAGCAA TGGAAGAAAC GCACCAGAAG 2300
AAGATTGAAG ATCTCCAGAG GCAGCACCAG CGGGAGCTAG AGAAACTTCG 2350
AGAAGAGAAA GACCGCCTCC TAGCCGAGGA GACAGCGGCC ACCATCTCAG 2400
CCATCGAAGC CATGAAGAAC GCCCACCGGG AGGAAATGGA GCGGGAGCTG 2450
GAGAAGAGCC AGCGGTCCCA GATCAGCAGC GTCAACTCGG ATGTTGAGGC 2500
CCTGCGGCGC CAGTACCTGG AGGAGCTGCA GTCGGTGCAG CGGGAACTGG 2550
```

FIG. 25B

```
AGGTCCTCTC GGAGCAGTAC TCGCAGAAGT GCCTGGAGAA TGCCCATCTG  2600
GCCCAGGCGC TGGAGGCCGA GCGGCAGGCC CTGCGGCAGT GCCAGCGTGA  2650
GAACCAGGAG CTCAATGCCC ACAACCAGGA GCTGAACAAC CGCCTGGCTG  2700
CAGAGATCAC ACGGTTGCGG ACGCTGCTGA CTGGGGACGG CGGTGGGGAG  2750
GCCACTGGGT CACCCCTTGC ACAGGGCAAG GATGCCTATG AACTAGAGGT  2800
CTTATTGCGG GTAAAGGAAT CGGAAATACA GTACCTGAAA CAGGAGATTA  2850
GCTCCCTCAA GGATGAGCTG CAGACGGCAC TGCGGGACAA GAAGTACGCA  2900
AGTGACAAGT ACAAAGACAT CTACACAGAG CTCAGCATCG CGAAGGCTAA  2950
GGCTGACTGT GACATCAGCA GGTTGAAGGA GCAGCTCAAG GCTGCAACGG  3000
AAGCACTGGG GGAGAAGTCC CCTGACAGTG CCACGGTGTC CGGATATGAT  3050
ATAATGAAAT CTAAAAGCAA CCCTGACTTC TTGAAGAAAG ACAGATCCTG  3100
TGTCACCCGG CAACTCAGAA ACATCAGGTC CAAGAGTCTG AAGGAAGGCC  3150
TGACGGTGCA AGAACGGTTG AAGCTCTTTG AATCCAGGGA CTTGAAGAAA  3200
GACTAGGTGT GTCCCATCCA AGTTGAGCAC GCGCCTTCCC CAGCTTGCAG  3250
CAGCACACCC CAAGCGCTGC TTTTCACCTG TACCTTTGTT TTATTATTAT  3300
TATTATTATT GCTGTTGTTG TCATCGTTAA CTGTGGGCAT GGAATGCGTG  3350
AGGCTGGCTT CTGGGTTGTC CACACCACTC TCTGCTGTGT TGACTTCCTG  3400
TTGTCTTCAT CAAAGCTTTT TTCCGTGGTA TTCTAAAATT AGGCCAGCAG  3450
TGGGGGCTGG GAGGGCATCT GTGTTAGTCC TTTCCTGGCT GTGACCCGCC  3500
ACACTCACTG TCAGTATTAA GGCCCAGCAG CCTGTTGATA AGCTACCCTG  3550
TCTCACCATG TGCTGGTGTG GAAACGGGGC CCAGCCAGCA CGCCTCAAGG  3600
TAGATGGAAT CCCCACTGGT CAGAGAAAAA GCTATGCGGA CACTCCAGCT  3650
TGGCCTGGGT CACAGCACTG ACTCCTCACC CGCTAGTCTG GCTGTTAAGA  3700
GGAGAAAGTG CACTGCCTTC CAGCCCAGGA GGAGGACAGC ATTTTGTATT  3750
TGTTCCACTG ATGCAGCTTA GAACCACACC CCTGAGAGTC GTGGCAAACC  3800
TTTCACAACC TGGAAAATGT TGAAAGCAAC CATTCCTATT TTTGTTTGTT  3850
TTTTATTAAA TCTTGCACAA AATCCCCGGC CCCTCTCCTT CCTTCCTTCC  3900
TTCCTTCCTC CGCTCGTTCC TTTCTTGGTC TCCAGTAACC CTGGTCTTTT  3950
CATAACTGCT CGAGATTGTT GACCTGCAGC CCAGGTTTCA GACTCTGATT  4000
GCAAAAAACA AATGAATTCC CCCCAGGAAT CATTCAAAAT GGGGGAAGGT  4050
TTGGGGGTTT GGGTTTTTTT TTTACCTTTT GGAAAAGAAA CCGTCACATT  4100
GCTTTGGAAA AGGTTGAGAG GAGACCCCTG TTAAGTCAAG AAGAAAGTAC  4150
AGAGGATGTC AGAATCTGAT GAGAACAGCA CATTAGTGTT TATTGAGACT  4200
CCGATCTTAA CTCTCATTTA ATTAATCTGA GCTCTGAAAA CCTATCTTGC  4250
AGCATTTATC TTTAAAGAG CCTGGTTAAA GTAAACCTAT ACTAACAATT  4300
TTGCTTTTTC TAACAGTTTG AGGAAGACCT TTTTAACCAC CACAAAACAT  4350
TCTATGGCAA TTCTTGAAAA TCTCTTAAAT TGGAGTCTAT TATGGCCCCA  4400
TGAAAACCAT TAATCCCATT AAGATAGGGA GTATAAACCC CTGGCTGGTG  4450
GAACAGGTTC TGCTACTTTA GGAGCAAGGT GGGGTGTGAG TAGATGGTTT  4500
TCATGCCAAG AACATGCTTT CACTTTGTAT TCATGCTTGT GTTGGTGTGA  4550
TGGTCTCTGT GGGTGGGTGG ATGCTTTGGG CGTTGAAATC TAGAAATCCT  4600
GTTGCTCAGT TTCTAGATGA AGTCATGAGC AAGGCCATCA GTGGAGCTCT  4650
GGCCCCGCCC CCAATGTGCA GAAGGGCCGG GAGCAAGGCC TGGAGTTTTC  4700
ATGTGTTTTC AGACCCAGGT TTAGGTGCTC TCTTCTCACT GAAATAACTA  4750
AGTGCTCTCC ACTGGCATCG AGCCCTTTCC ACAAGTTTTT AAGGCTCTTA  4800
ACCCACACTT TCACTCCTCT GCTACTAGTC TTCAGTGTTG TTAACAGCAA  4850
GAGAAAATTG GGTTTGTTTA AAAATCTACT TCTCTGAGGT GGCACAGTTG  4900
CGTAGCTGTA GTCCCAGCTA CTCAGGAGGC TGAGGTAGTA GGATTGCTTG  4950
AGCCCGGGAG GTCGAGGCTG CAATCAGTCA TGATCGTGTC ACTGCACTCC  5000
AGCCTGGGTG ACAAAGCAAG GCCCCATATC AGATATAGAT ATACTTATCA  5050
GACCCCCCCT GACCATTTAG ATTGGCAGTG CTTTGAGAAA TGCACTATGA  5100
```

FIG. 25C

```
CCTTTCTGTG TCAATGGGAA TATACAGAAG GAACATTCGG GACCCCGCTG  5150
TCCCCCACAG CCTCATTGTT GTCTCCAGGA CACTGCTGGG TCACACGAAT  5200
GCTCCAGGAC AGACAGGGAC CTGGAGTGCA TCAGGATCTG ACCAGATAGG  5250
AGTTTTTGCC TCGTGTCTGG GTGCTACGAT TTTGTGCCGT TCTCTGAGGT  5300
CCACCACCTG CCCTTCCTGG CATGGTTTCC TTCGTGACCA TCCCTGCTGC  5350
CCCTGGGGGT GGACCCCACT GGCCCTTCTG CAGACAGCTC CCTGCCTTCT  5400
GCCCTCCAGG GGGTTCTGGC CAGAGTCCAT GCTTGGAGAC AGGATCATCT  5450
GCCTTCAGCC CTCACAGTGC TTTAAATTAA AGCAAGTTTG CCCATAGGAC  5500
AAAAGAGCAT TTGATTCCCT TTTTTCTGTC ACATATCCCT TGAGGCTGGA  5550
CTTCAGGAAT CCTGGAAAAT TAATATGAGT GCAGCATGTG AGGGGTCAGA  5600
GACAGGCCAG CAGGGCGTCT GCATTCCTCC CTGCCACAGG TCTCTCCCCA  5650
GAGGCTGGTT TAGTGTAGGG TATTGCCAGG AAACGGACTG AGGCTGCTTT  5700
GCTAAGAGCT CCTGAAAATG CCCTGGGCCT GTCCTGGCGT TTCTGAAGAG  5750
CCCTCATACA GGGACAGCCA CCATCTGGGT CAAGGAAGTC TGGGTTCCCT  5800
GCTGGTGGGC TCCATCCTGC GATGGAGTGA ACCAGGCGAG AAAGGATGAC  5850
GATGTTCTTC ATGTTGCACC TGGACATGCC CCAGGAACAG AGACTTGCCC  5900
AGGTGGCAAC ACTGGCACAG ATGTTGACGG CTGCCCAACT GGTGCCACAC  5950
TGAGCAGGGA GCCTTGTGCT GCACAGGGCT GGGCCCTCTC TCCAGTTTCC  6000
TTCCTGCAGG CATCCAAATA CCCTGGAAGG GATTAACCC CTGAATTCCA  6050
GAGGGAAGAA AGAAGAACAG TGAAGAAGTA GAACTGGTTT CTGTATGGGG  6100
AGAGGAAAGT CTTAGGGACA GCTGCAGGCG GGGTCTCAGG CTGCTCCTTG  6150
GCACCAGCTA CACAGTAGTG AGCTTTCCCA GCTTTACCGA TGAGGAAGAA  6200
GTTCAAATAG ATAGACTTCA GCATTTAAT TATTTTCCTA TAAATGTATT  6250
TATGTGTAGT ATGCTAGCAC CAGCCAGTAA GCTGTGCCAC ACATATGAAT  6300
GGGAAAGCGA GGCAGTTGTG CTCGTGTGAG TTTCTGCAGG CTTGTGGGTA  6350
ATTACCTTGT GTGCACGCCT GCACGTGCAG AATAGTCACT TTCTGCTGGT  6400
CAGTTTCTTT ATCCACCCAT GGTGCCCCAG CCCCAGGCAG GTGTGGAGAC  6450
CAGCATTTCA GAGGACGCGC TGTCCACAGC CTCCCGGGTC TGAGTGGATC  6500
ATTGGGCAGG GGTGGAGACA GTGCGCTGCC CTCTGAGCTG GAAGCCTGTG  6550
CTTCAGGGAG TCATAATGGG CCTGTGCTAA GTGGGTGATG CAGTGGACAT  6600
CCCAGGGCGA CTAGAGGTGG CAGTATCGCG AATTTGCAGG TTTATTGAAC  6650
AAGAGGTAAC ATCGGAGAGG ATCTTGCCTT CGGATTCAGC AAGTATGAAG  6700
GCAGAAGAGC ATGGAGAGCA AGGCCCCACA GCCTGCTTAG TGAGTTGGAA  6750
GGCCCAGCAA GAACCTGTTT CTGCAGCAGC CACCAGCTCC CATCACCCCT  6800
TGACCCTCCA GCTCATGCTG GAGAAGAGGG AATTTTGGCT GTTTAAAGAA  6850
CACAGTTGTG AATCTCAGAA TGTGCCTGAA AGGAATACTG ACAGATAAGG  6900
CCGGAAACAA AACTGATGGC TTGAAAAACA TTTTTATGGA ATGTATTTAC  6950
TATCATTTTG TTTTACTATA GAGGTAGATG GGACTCTTAA CTTTTGGGTA  7000
CATGGAAACA TGCTGAAAAC TGAACACAAT CCTGATCATC ACTCCTGCCT  7050
GGCTGTCTCC TGGGAGGCTG CCGGGTGCCA CGGAGCTGGG ACACAGCAGA  7100
GCCCGCTAGG TGTTGCAGGG CCCTGGAGGC CAAGGCCACC CTGTGTGGGG  7150
TCCCTGTTGG CAGCCAGGTC CCTACACAAA CAAGTAATCC TGTTTGGCCT  7200
CCTAGGTTTT GCATATGACC TGCAGCCTAA TTTGGGGTGT AGGGGAAGCT  7250
CTGCTGGCCC CTGCTCCTTT GTATGTTGGG TGACTTTAAT GGCTGGCCAC  7300
ATACCCCTTT CTCCCAGCTA CTCATTCACT GACTTGGGTA AGTTCTAAGA  7350
CAGTTCGCAC TTAGAAAAGA ATGTGACACA TCAACATTAA CTTTTCCTGA  7400
AAAGAAGAGT TTGCCTAACA TGGTCCTAAA GAAGCTTGGA ATTTATAAGA  7450
CTTTCCTTTA TAAGATATAG TGGGGGTTTT TTTGGGTGGA GGGGGGTTGT  7500
TTTTTGTTTT TTGTTTTCAA GACAGAGTCT CGCTCTGTTG TCCAGGCTGG  7550
AGTGTAGTGG CATGATCTCG GCTCACTGCA ACCTCTGCCT CCCAGGTTCA  7600
TGCCATTCTC CTGCCTCAGC CTCCCGAGTA GCTGGGACTA CAGGTGTCTG  7650
```

FIG. 25D

```
CCGCCACGCC TGGCTAATTT TTTTGTATTT TTAGTAGAGA CGGGGTTTCA  7700
CCATGTTGGT CAGGATGGTC TCGATTTCCT GACCTCGTGA TCCGCCTGTC  7750
TCGGCCTCCC AAAGTGCTGG GATTACAGGC GTGAGCCACC ACGCCTGGCC  7800
TATAAGATAC GGTAAAAAAA AAAAACTGTG ACCCCTTTGT CACTAAGGGA  7850
GAAAGAAATT AAGTATTGTC AAAGTTCTAT AAAGAATGGA AATGTATGAT  7900
ATTATACTTC AAAGGAATTT GATGTTGAAA TTTAAAGAA AATTTGTCAT  7950
GTTGATGAGA AGCTTCACTT TCCTGGGAAC TTCATTCGTT TTAGGGCATG  8000
AGATAAAAGT CCTGGCTAGG GGAGCCATAG GTCTGTTGTA CAAGGAATTT  8050
GCTTTCTAAA CAAGTTGTAA CTTGCCCTAA GGTCCCTGTT GGAGCACTAA  8100
GAGGTGACAC AGGCCAGAGA CAACGTTTCG TTTCCCCTTC CCTGCAAGCT  8150
GGGATCAGCC CTGTGTTTTC TCCTTTCAGC TGAAGTGAGC GAAGGTTCTC  8200
AGTGCTGGCA AAAGAGCCCA CTTTCTAAAA GGACTTGGGA AGAAAGCTGC  8250
TGGGAACTTG CTTATTAAAA AGTTCCTTAG AATTAAGGTA TCTACCCACT  8300
GTTTTCGCAC CTTTCACCTT CCTGGGCTTT CCTGCCCTCC AGCATTCTTC  8350
TCTAGAGAGG TTCCTAGCCC GCTCAGCGCG AGCGTCTCCA GTAGGTAATA  8400
GCAGCTGAAC GTGGGTTTTC CACGGACTTC AGGCTTGGAG GTGCCATATA  8450
CAAGCACACT TCTTCCTTCC CCTGGCTTCT CCATGCCACC ACCCACTTTA  8500
AAGATGTAAA CTCAGTAGAT TTTTCATCCA GTGAACGGTC ATCTTCACAT  8550
CGAAAGGTGA AGGCCACCAC TGTTCTCAAT GCCAAGCAAC AGAACGTTCT  8600
GAGATGGCCG TTCTTCCTTG CACAGCAGCT ACGGCAGGTT GTTCTGCAGC  8650
CACCCCTTAG AGGGGGCTCT TCGTTTTACC TTTGTACAGT TCTTGTGTTT  8700
ACACATTTGG GCCAAACAGC TTTCAGCAAG GGCATGTGTC CACAGCTGAT  8750
GGGCAGTTAA GAACCAGCCT GAGCTGAAGG CTAGTAATAC CGTGCTGTAG  8800
GCTCTTTAAA AGGAAAGCCT GGCATAAACC CAGCATGGAA AGGAACATTA  8850
TCAGTTATCT CAAATTTTGT CTGCCAGGGA CAAGACCCTG TTCATTCTTT  8900
TGCCCTTTTC AGAACTGTGA GCTTCAAGTA TTCTTGCTTC TCTGTAAAGG  8950
GAAGACATCT CCCTTCTCTG AAATCCTTCA ACAAAAGAAA AGGCTCTTGG  9000
CAGGGTAGGG GAGTCAGTAG CTCAACACTA GATCATCCCT AGAGATGGGG  9050
CAAGTTTCTG TCTGAACACG TCTTGGGTCC GAGTCCTTAG GTGTTCGGAT  9100
GCAGTACTTT GTGAATACTT AAGCTACTGC ATGCTTGGTG TAGCTTGCAA  9150
TTTCTCTGTA TTTAAAAGCA GCTGTGTTTA TTTTCTTCAA AATAACCTGT  9200
ATATTATTTA GAGCAAGCAA TGTAAATATT ACTGAGAAGT TACTGCAGGG  9250
ATTTTTGTGA CAGAGTTTGT ATGGGTTTTT AAAAAAATCT TAGACACCCC  9300
TTTTTAAGAT GGGGAGAACA GGGTTGACTG CACCGTTGAA GCCCGCCCAG  9350
CATTATAAGG AAATGTTTTT AATGACTGCT GCATCTTTGT AAAACGTTTG  9400
GTCATCTAAC AGATGGTTTT AAAGTGTACA ATATCCAAAA TAACGATAGC  9450
CCTGTATCCA TACATTGTTT CATTGAAAGA ATTCTCTATT GCCTCTTCTT  9500
GGTAGAGCCA GAGTCCTTAA GGAAAATCAG GAAAATTAAG AAAATGATGG  9550
TGCCATCTTG ACCAGACTTC TGCACAGTAA TTTAACGCTA TCCTAGGGAG  9600
ACTTGGTTGA AGGCACAGTT CTGGGATCAG GGTCTAAATG TGCAGTTTCT  9650
GAGAACCTTC AAGACCACTC ACTGGGCAGG GCTCTGTGGA GCACTGGAGC  9700
TGTTTGGATT CCCCAGCCCT TTGGTCATAT CCTGGAATTC CGTGGAGGCT  9750
GCAGAACTTA GATGCAGCTG TTTTTACAG CACCTATTTT TGTCAGATTG  9800
GTAAGGAAAC ACTGAGTCAC AGAATACTTA AGAATTGGAG ACTCCAGTAA  9850
TGTAGGATGG CCTGAGAGGA CGTCCAAGTC CCAAGGGGTG GACACGGCAT  9900
GTTCCTCGGG CACAGCCTCA GTGGGGGCCT TCCCCAGGCG CAGCTCGGCC  9950
ACCTGAGGAA AGGGTGTTTC GGAGGCGCAG CCACACACAC AGCGCTGGCA 10000
GCCTCACGGT CACGCCCATC ACTCCCTGCC CCCCACTGCC CTTGAGAAGT 10050
TAGTGGTGTC ACATCCTTAG TTTTATAGAC AGCTAGGAAT AGATTGTGAA 10100
GAACACTCAG TTCACTACTG TGTTACATTT ATATCACAAG CTTCAATTAA 10150
AATGGATTTT AAAGGATTTT AGGATTACC TTTAGTATTA ACAACGTATC 10200
```

FIG. 25E

```
TACTGACATA CTGTTAGGAT TCAAAACCAG TTAAGTATAA GAATTACTTC  10250
ATGTGGTTTT CCTAGGGTAC AATTTATAAA AGGTAGAAAG CATCCAAGTG  10300
GCTCCTCAAC AATTACAATT CTTAATGATT TTCTCACAG  CTGTGCCCTT  10350
CTGTCAGGGT CAGTGTCAAA ATTCGTTATC AAAGGCAAAA CCTACTGTGC  10400
CAAGCTGGGG CGCTATATGT GAACGGAGTG GAAATGCTTC AGTCACCTCT  10450
GCCGCAGCTT GTGATTCCAG CAGTTCTCAC AAACGTTCTG TCACATGATG  10500
AAAAGAAGCA GCTTGTATAA TTCCAACTGG TGTTTCATTT CTGTTCTAAT  10550
GCTAAGTGGT AACGCTTAAC AAACAGACTA AAAGCTGTGT GCAGAAGAAA  10600
GGGCTGAATG AGTACCGCCT CCCTAGGTTC CAGCACAGCG CTCGGGTCTA  10650
AGAAGTAGAG CCCCGGGGTA GGGTGGGCCA TCCACTGTCA GGCCAGTGTC  10700
TCAAGAAAGC CTGACCAGCT GAGCTGCTGC TTTTTTTTG  GGGGGGGGG   10750
GGGGAGGGGC GTCTTGAGGC TTTTTTTTT  TTACAAAGT  TAGTTTGTGA  10800
TCAACGATTC ACTACAATTG AAGTGTTACT TTGTCAGAAT ATTTATTCCT  10850
TTGTGTGACA TGCTAGATTC CCTGGATGTA GCTGATCATT TTTATTTGT   10900
AAATATTACC TAACTTTACA TAAACTATAT CATAATAAAC TATTTTGCA   10950
TCACCCTTTG (SEQ ID NO: 25)
```

FIG. 26

```
MSAAKENPCRKFQANIFNKSKCQNCFKPRESHLLNDEDLTQAKPIYGGWLLLAPDGTDFD
NPVHRSRKWQRRFFILYEHGLLRYALDEMPTTLPQGTINMNQCTDVVDGEGRTGQKFSLC
ILTPEKEHFIRAETKEIVSGWLEMLMVYPRTNKQNQKKKRKVEPPTPQEPGPAKVAVTSS
SSSSSSSSSIPSAEKVPTTKSTLWQEEMRTKDQPDGSSLSPAQSPSQSQPPAASSLREPG
LESKEEESAMSSDRMDCGRKVRVESGYFSLEKTKQDLKAEEQQLPPPLSPPSPSTPNHRR
SQVIEKFEALDIEKAEHMETNAVGPSPSSDTRQGRSEKRAFPRKRDFTNEAPPAPLPDAS
ASPLSPHRRAKSLDRRSTEPSVTPDLLNFKKGWLTKQYEDGQWKKHWFVLADQSLRYYRD
SVAEEAADLDGEIDLSACYDVTEYPVQRNYGFQIHTKEGEFTLSAMTSGIRRNWIQTIMK
HVHPTTAPDVTSSLPEEKNKSSCSFETCPRPTEKQEAELGEPDPEQKRSRARERRREGRS
KTFDWAEFRPIQQALAQERVGGVGPADTHEPLRPEAEPGELERERARRREERRKRFGMLD
ATDGPGTEDAALRMEVDRSPGLPMSDLKTHNVHVEIEQRWHQVETTPLREEKQVPIAPVH
LSSEDGGDRLSTHELTSLLEKELEQSQKEASDLLEQNRLLQDQLRVALGREQSAREGYVL
QATCERGFAAMEETHQKKIEDLQRQHQRELEKLREEKDRLLAEETAATISAIEAMKNAHR
EEMERELEKSQRSQISSVNSDVEALRRQYLEELQSVQRELEVLSEQYSQKCLENAHLAQA
LEAERQALRQCQRENQELNAHNQELNNRLAAEITRLRTLLTGDGGGEATGSPLAQGKDAY
ELEVLLRVKESEIQYLKQEISSLKDELQTALRDKKYASDKYKDIYTELSIAKAKADCDIS
RLKEQLKAATEALGEKSPDSATVSGYDIMKSKSNPDFLKKDRSCVTRQLRNIRSKSLKEG
LTVQERLKLFESRDLKKD- (SEQ ID NO: 26)
```

FIG. 27A

```
CACGCGCGCC CGGCTGGGGG ATCTCCTCCG CGTGCCCGAA AGGGGGATAT    50
GCCATTTGGA CATGTAATTG TCAGCACGGG ATCTGAGACT TCCAAAAAAT   100
GAAGCCGGCG ACAGGACTTT GGGTCTGGGT GAGCCTTCTC GTGGCGGCGG   150
GGACCGTCCA GCCCAGCGAT TCTCAGTCAG TGTGTGCAGG AACGGAGAAT   200
AAACTGAGCT CTCTCTCTGA CCTGGAACAG CAGTACCGAG CCTTGCGCAA   250
GTACTATGAA AACTGTGAGG TTGTCATGGG CAACCTGGAG ATAACCAGCA   300
TTGAGCACAA CCGGGACCTC TCCTTCCTGC GGTCTGTTCG AGAAGTCACA   350
GGCTACGTGT TAGTGGCTCT TAATCAGTTT CGTTACCTGC CTCTGGAGAA   400
TTTACGCATT ATTCGTGGGA CAAAACTTTA TGAGGATCGA TATGCCTTGG   450
CAATATTTTT AAACTACAGA AAAGATGGAA ACTTTGGACT TCAAGAACTT   500
GGATTAAAGA ACTTGACAGA AATCCTAAAT GGTGGAGTCT ATGTAGACCA   550
GAACAAATTC CTTTGTTATG CAGACACCAT TCATTGGCAA GATATTGTTC   600
GGAACCCATG GCCTTCCAAC TTGACTCTTG TGTCAACAAA TGGTAGTTCA   650
GGATGTGGAC GTTGCCATAA GTCCTGTACT GGCCGTTGCT GGGGACCCAC   700
AGAAAATCAT TGCCAGACTT TGACAAGGAC GGTGTGTGCA GAACAATGTG   750
ACGGCAGATG CTACGGACCT TACGTCAGTG ACTGCTGCCA TCGAGAATGT   800
GCTGGAGGCT GCTCAGGACC TAAGGACACA GACTGCTTTG CCTGCATGAA   850
TTTCAATGAC AGTGGAGCAT GTGTTACTCA GTGTCCCCAA ACCTTTGTCT   900
ACAATCCAAC CACCTTTCAA CTGGAGCACA ATTTCAATGC AAAGTACACA   950
TATGGAGCAT TCTGTGTCAA GAAATGTCCA CATAACTTTG TGGTAGATTC  1000
CAGTTCTTGT GTGCGTGCCT GCCCTAGTTC CAAGATGGAA GTAGAAGAAA  1050
ATGGGATTAA AATGTGTAAA CCTTGCACTG ACATTTGCCC AAAAGCTTGT  1100
GATGGCATTG GCACAGGATC ATTGATGTCA GCTCAGACTG TGGATTCCAG  1150
TAACATTGAC AAATTCATAA ACTGTACCAA GATCAATGGG AATTTGATCT  1200
TTCTAGTCAC TGGTATTCAT GGGGACCCTT ACAATGCAAT TGAAGCCATA  1250
GACCCAGAGA AACTGAACGT CTTTCGGACA GTCAGAGAGA TAACAGGTTT  1300
CCTGAACATA CAGTCATGGC CACCAAACAT GACTGACTTC AGTGTTTTTT  1350
CTAACCTGGT GACCATTGGT GGAAGAGTAC TCTATAGTGG CCTGTCCTTG  1400
CTTATCCTCA AGCAACAGGG CATCACCTCT CTACAGTTCC AGTCCCTGAA  1450
GGAAATCAGC GCAGGAAACA TCTATATTAC TGACAACAGC AACCTGTGTT  1500
ATTATCATAC CATTAACTGG ACAACACTCT TCAGCACAAT CAACCAGAGA  1550
ATAGTAATCC GGGACAACAG AAAAGCTGAA AATTGTACTG CTGAAGGAAT  1600
GGTGTGCAAC CATCTGTGTT CCAGTGATGG CTGTTGGGGA CCTGGGCCAG  1650
ACCAATGTCT GTCGTGTCGC CGCTTCAGTA GAGGAAGGAT CTGCATAGAG  1700
TCTTGTAACC TCTATGATGG TGAATTTCGG GAGTTTGAGA ATGGCTCCAT  1750
CTGTGTGGAG TGTGACCCCC AGTGTGAGAA GATGGAAGAT GGCCTCCTCA  1800
CATGCCATGG ACCGGGTCCT GACAACTGTA CAAAGTGCTC TCATTTTAAA  1850
GATGGCCCAA ACTGTGTGGA AAAATGTCCA GATGGCTTAC AGGGGCAAA   1900
CAGTTTCATT TTCAAGTATG CTGATCCAGA TCGGGAGTGC CACCCATGCC  1950
ATCCAAACTG CACCCAAGGG TGTAACGGTC CCACTAGTCA TGACTGCATT  2000
TACTACCCAT GGACGGGCCA TTCCACTTTA CCACAACATG CTAGAACTCC  2050
CCTGATTGCA GCTGGAGTAA TTGGTGGGCT CTTCATTCTG GTCATTGTGG  2100
GTCTGACATT TGCTGTTTAT GTTAGAAGGA AGAGCATCAA AAAGAAAGA   2150
GCCTTGAGAA GATTCTTGGA AACAGAGTTG GTGGAACCAT TAACTCCCAG  2200
TGGCACAGCA CCCAATCAAG CTCAACTTCG TATTTTGAAA GAAACTGAGC  2250
TGAAGAGGGT AAAAGTCCTT GGCTCAGGTG CTTTTGGAAC GGTTTATAAA  2300
GGTATTTGGG TACCTGAAGG AGAAACTGTG AAGATTCCTG TGGCTATTAA  2350
GATTCTTAAT GAGACAACTG GTCCCAAGGC AAATGTGGAG TTCATGGATG  2400
AAGCTCTGAT CATGGCAAGT ATGGATCATC CACACCTAGT CCGGTTGCTG  2450
GGTGTGTGTC TGAGCCCAAC CATCCAGCTG GTTACTCAAC TTATGCCCCA  2500
TGGCTGCCTG TTGGAGTATG TCCACGAGCA CAAGGATAAC ATTGGATCAC  2550
```

FIG. 27B

```
AACTGCTGCT TAACTGGTGT GTCCAGATAG CTAAGGGAAT GATGTACCTG  2600
GAAGAAAGAC GACTCGTTCA TCGGGATTTG GCAGCCCGTA ATGTCTTAGT  2650
GAAATCTCCA AACCATGTGA AAATCACAGA TTTTGGGCTA GCCAGACTCT  2700
TGGAAGGAGA TGAAAAAGAG TACAATGCTG ATGGAGGAAA GATGCCAATT  2750
AAATGGATGG CTCTGGAGTG TATACATTAC AGGAAATTCA CCCATCAGAG  2800
TGACGTTTGG AGCTATGGAG TTACTATATG GGAACTGATG ACCTTTGGAG  2850
GAAAACCCTA TGATGGAATT CCAACGCGAG AAATCCCTGA TTTATTAGAG  2900
AAAGGAGAAC GTTTGCCTCA GCCTCCCATC TGCACTATTG ACGTTACAT   2950
GGTCATGGTC AAATGTTGGA TGATTGATGC TGACAGTAGA CCTAAATTTA  3000
AGGAACTGGC TGCTGAGTTT TCAAGGATGG CTCGAGACCC TCAAAGATAC  3050
CTAGTTATTC AGGGTGATGA TCGTATGAAG CTTCCCAGTC CAAATGACAG  3100
CAAGTTCTTT CAGAATCTCT TGGATGAAGA GGATTTGGAA GATATGATGG  3150
ATGCTGAGGA GTACTTGGTC CCTCAGGCTT TCAACATCCC ACCTCCCATC  3200
TATACTTCCA GAGCAAGAAT TGACTCGAAT AGGAGTGAAA TTGGACACAG  3250
CCCTCCTCCT GCCTACACCC CCATGTCAGG AAACCAGTTT GTATACCGAG  3300
ATGGAGGTTT TGCTGCTGAA CAAGGAGTGT CTGTGCCCTA CAGAGCCCCA  3350
ACTAGCACAA TTCCAGAAGC TCCTGTGGCA CAGGGTGCTA CTGCTGAGAT  3400
TTTTGATGAC TCCTGCTGTA ATGGCACCCT ACGCAAGCCA GTGGCACCCC  3450
ATGTCCAAGA GGACAGTAGC ACCCAGAGGT ACAGTGCTGA CCCCACCGTG  3500
TTTGCCCCAG AACGGAGCCC ACGAGGAGAG CTGGATGAGG AAGGTTACAT  3550
GACTCCTATG CGAGACAAAC CCAAACAAGA ATACCTGAAT CCAGTGGAGG  3600
AGAACCCTTT TGTTTCTCGG AGAAAAAATG GAGACCTTCA AGCATTGGAT  3650
AATCCCGAAT ATCACAATGC ATCCAATGGT CCACCCAAGG CCGAGGATGA  3700
GTATGTGAAT GAGCCACTGT ACCTCAACAC CTTTGCCAAC ACCTTGGGAA  3750
AAGCTGAGTA CCTGAAGAAC AACATACTGT CAATGCCAGA GAAGGCCAAG  3800
AAAGCGTTTG ACAACCCTGA CTACTGGAAC CACAGCCTGC CACCTCGGAG  3850
CACCCTTCAG CACCCAGACT ACCTGCAGGA GTACAGCACA AAATATTTTT  3900
ATAAACAGAA TGGGCGGATC CGGCCTATTG TGGCAGAGAA TCCTGAATAC  3950
CTCTCTGAGT TCTCCCTGAA GCCAGGCACT GTGCTGCCGC CTCCACCTTA  4000
CAGACACCGG AATACTGTGG TGTAAGCTCA GTTGTGGTTT TTAGGTGGA   4050
GAGACACACC TGCTCCAATT TCCCCACCCC CCTCTCTTTC TCTGGTGGTC  4100
TTCCTTCTAC CCCAAGGCCA GTAGTTTGA CACTTCCCAG TGGAAGATAC   4150
AGAGATGCAA TGATAGTTAT GTGCTTACCT AACTTGAACA TTAGAGGGAA  4200
AGACTGAAAG AGAAAGATAG GAGGAACCAC AATGTTTCTT CATTTCTCTG  4250
CATGGGTTGG TCAGGAGAAT GAAACAGCTA GAGAAGGACC AGAAAATGTA  4300
AGGCAATGCT GCCTACTATC AAACTAGCTG TCACTTTTT TCTTTTTCTT   4350
TTTCTTTCTT TGTTTCTTTC TTCCTCTTCT TTTTTTTTTT TTTTTTAAA   4400
GCAGATGGTT GAAACACCCA TGCTATCTGT TCCTATCTGC AGGAACTGAT  4450
GTGTGCATAT TTAGCATCCC TGGAAATCAT AATAAAGTTT CCATTAGAAC  4500
AAAAGAATAA CATTTCTAT AACATATGAT GGTGTCTGAA ATTGAGAATC   4550
CAGTTTCTTT CCCCAGCAGT TTCTGTCCTA GCAAGTAAGA ATGGCCAACT  4600
CAACTTTCAT AATTTAAAAA TCTCCATTAA AGTTATAACT AGTAATTATG  4650
TTTTCAACAC TTTTTGGTTT TTTTCATTTT GTTTGCTCT GACCGATTCC   4700
TTTATATTTG CTCCCCTATT TTTGGCTTTA ATTTCTAATT GCAAAGATGT  4750
TTACATCAAA GCTTCTTCAC AGAATTTAAG CAAGAAATAT TTTAATATAG  4800
TGAAATGGCC ACTACTTTAA GTATACAATC TTTAAAATAA GAAAGGGAGG  4850
CTAATATTTT TCATGCTATC AAATTATCTT CACCCTCATC CTTTACATTT  4900
TTCAACATTT TTTTTCTCC ATAAATGACA CTACTTGATA GGCCGTTGGT   4950
TGTCTGAAGA GTAGAAGGGA AACTAAGAGA CAGTTCTCTG TGGTTCAGGA  5000
AAACTACTGA TACTTTCAGG GGTGGCCCAA TGAGGGAATC CATTGAACTG  5050
GAAGAAACAC ACTGGATTGG GTATGTCTAC CTGGCAGATA CTCAGAAATG  5100
```

FIG. 27C

```
TAGTTTGCAC TTAAGCTGTA ATTTTATTTG TTCTTTTTCT GAACTCCATT  5150
TTGGATTTTG AATCAAGCAA TATGGAAGCA ACCAGCAAAT TAACTAATTT  5200
AAGTACATTT TTAAAAAAAG AGCTAAGATA AAGACTGTGG AAATGCCAAA  5250
CCAAGCAAAT TAGGAACCTT GCAACGGTAT CCAGGGACTA TGATGAGAGG  5300
CCAGCACATT ATCTTCATAT GTCACCTTTG CTACGCAAGG AAATTTGTTC  5350
AGTTCGTATA CTTCGTAAGA AGGAATGCGA GTAAGGATTG GCTTGAATTC  5400
CATGGAATTT CTAGTATGAG ACTATTTATA TGAAGTAGAA GGTAACTCTT  5450
TGCACATAAA TTGGTATAAT AAAAGAAAA ACACAAACAT TCAAAGCTTA   5500
GGGATAGGTC CTTGGGTCAA AAGTTGTAAA TAAATGTGAA ACATCTTCTC  5550
ATGCAATTAT TTTATTATCC AACACACTAA TCTTTTGATA CTTTATATAA  5600
TTCCCTTTCT TCATATACTG CATCCAGTAC TAGAACCATC ATTATTATGT  5650
ATCATTTTGA AAGAATACCT GATGAGATGA AGGATGAGAA CAAATGACAG  5700
AGATGAGTCT CCAAGTAAAG GGGGCCTCAC ATCAATAATT AGGAAACTTA  5750
GATATAAGTC GCCCTTTCT GAAAATTCTA CCCCAAGTCA TTTAGATTTT   5800
TAAAAAATAT TTCTAATGTT AAAATATTGG GACCAAATTA GAATCAATAG  5850
TATAAGATTA ATTAATTAGA GTAAAAATAT CTATTAAGGC AGAGAAAGTT  5900
TAGAGAAAAA AATCCAAAGA AATTTGTGTT TCTTCCTATT CTGAACAAGT  5950
AAATCCATCC ATCCATCCAT CCAAACCTCC TTTATCTAAC TGTGTCTACT  6000
AAAAGCACCA TGTTTTGTGG GGAACACTCA GATAAATGGA ATATCATCCT  6050
CAACTTCAAA ATTCTATGAT CTAGGAGATT TAATTAAAAT GACATTTTAA  6100
TTTTTCTATG CGTTCCAACA ATCAGATTGC ATAGTCTCTT TTGTGAATAG  6150
CTGTCATATA ATCAGTTGTA CTGTAAGATA TCTCCTTTAA ACTCATTTGG  6200
GATATAAGTT AAACATCCTT CAAATTGTTG ATGTTGACAA ACAGGATAAT  6250
TTCAATAATA TTATTCAAAC ATAAACTGGT CTAGGAGAAT ATTGCATCAC  6300
TGACTAATTA GCCTATCTAG AGTCTAACTT CACCATTAAA CCAAAAGCAG  6350
ATGGTGGTCC TTGGCCAAGA ATATTGGAGA CATTGGAGTT GGTTTTTTTC  6400
TAAGCTATAA GAAGTGAGGC GAGCTGAAAA AGTATGGTAG AGCAGGAGAA  6450
GGGTTTGTGA GATTCCTTCT AGTGAAGTTC ACCCTCAAAC TTTTCAGGGG  6500
TAAAGACACA GAGTGATTCA GGGGCCACAA TCTAATAGCT CAGGGCTCTC  6550
CTATCCATTC AGAGAAGTCT CTAGGAAAAG GGATCTCATA TCAGTACTTA  6600
TGAAAAATTG AATATAAGCC TCCCTTTCTA AATAAATCTG CATCGAGTCA  6650
TCACAGCCCT CTTTTGGAT ACTATACCTT GATTTTTTT TTCTGATTTA    6700
CAATATGCAT ATGGTTTCTA CTGGGCTATA GAAAGCAGAA TCACTCATTT  6750
TGGAGAAGGA AAAAATGAAT AGTTAAAACA AACTTTTAAC TGTTAAGGTA  6800
ACAGAAATGT ATTTAGTGAA TGTCTCTTTC CTCCTAAGAA CACAAGACTT  6850
CTACATGTTG GGTAATACCT AGAGATGCAT GTAGGAATAA TCCAAAATGA  6900
CCCAAATGCT TTATAATAGC ACCACTTTAT AATTCTTTTG AATGATTTCT  6950
GTAGTATATA ATTGACTTCA GTTGTTTGAG TGTTTTTTGT TTTATTTTTG  7000
TCCCCCCTGG GAAAACATAT TTCAGCATGT ATAAGAGGGA GAAAAAAAGT  7050
TTCATTCCTT CCAGAGAATA ACTTATTTAG TCCAGTAGGG TAGAATTTTA  7100
AAATGTCAGT TAAAGTCTTC AAAGTGCTTG GGGGGATATC AGATTCCAGA  7150
GGCCAATTGT AGCAATTGAA ATTTGCAGAA TCAATTATGT AAATCTGAGA  7200
CAAATTAGTA TTAAAATTAC ACGGAGTATA TTTTTTAAAT CACCCAACTT  7250
TGTAGATTAT ACCTATTTTG GGCAGGTATG GAAAAATTTT GCAGTTAAAT  7300
GATTGCCTAA AGAAAGTGGT AAACAGGTGA GGAAAGATGG CCTCTGATCT  7350
AGGATAGATC CAGAACCACA AAGCATCTGC ACCACAAAAG GTGTTAGACT  7400
ACCAAGCAGC TCCTGGTTTT CTGCATAGTA TTAGTAGCAC AGCTTAGGAT  7450
GAGAATCCTT TCTCCAGTAA CATTCTTAAA ATAGCATGAA AAACAACGCA  7500
AAACTCAAAT TTCTATTAAA ACACACAAAC TAAAATCAAG TGATTCTTTT  7550
TTGTAGATTA GGGAGAAGGA CTGAATATCT AATTTAAGAG AAGGAATAGT  7600
GTTTAAGTGT TATAGTGTGT GAGCTAATAC CTTCTAAAGG AAAGACATGG  7650
```

FIG. 27D

```
CATGAAGATT GTGCATACTT ACAATGCTAA GGAAAAATCA AGAAAAGGAC   7700
TGTGTGAGGC TCTGCTACTA GATGAAGTTG GAAGGACTAT TAATGTGCTT   7750
CTTGAAGTAT CAAAAATGAA AAGAAAATTA AAATTGTTTA AGCCTGACAG   7800
GGAAGGATGT AAATACAAGT TTTTCTAGAG CTCTCTAACC TTTATTTCAA   7850
AACTGGAATT ATTCATCCAT CTGTAATTGT TGATAATTTA ACTAGTATAT   7900
GTAGTTCATA AGGTAATAGA AAAGGTGATC ATGAAAGCAT GTATATAACT   7950
GGACAGAACC ACGATAATGC TATAAGATGT AGATTTAGTT AGGTTATCAG   8000
ATGTTAAATG ATTTTAATAT TATTAAATAA ATCAAACTAG AAAACTAACC   8050
ACAAGTATAA TGTAACAAAG TTAAATGCAG GATATAAAAA TGTAGGATGG   8100
ATTTTGCATA GTAAAAAGAT AAGTTTGCCA TTTAAAATTG TTGTTTGTTG   8150
GGTTTAGCTG AAAGTAGGCA TATATGGTTC CACTTGGGAA AACTTGCTTT   8200
AAAGCATTAC AATGAACAAT TTTTTCTCAT TCTCTTATTC CTTTATCACT   8250
TTTTAAATGT AAAGAAAATT GTATTTATTT ATTTTTTAA ATAAACACCA   8300
CCTTGCAGAA TTTAATAGGC AAACATGTTA CATATGACTA AGTAAGGGTC   8350
TTCAAGATGA AGTAAAGAAA ATGTAAATGT TCTATTACCT TATGCAGAGA   8400
CAAAAAAAAA AAGGAGTGGT GTCATTTAGC TAGCAAACAA ACAAAATACA   8450
GTTAATTGGT GATATGTCCT TTCTTTTCTC ACTATGCCCT CTTGCCTCCA   8500
AAAATGACAA CAAAGAATCA CAATTTTTCT GATAAATAAA TGCTAAACCA   8550
AGCGTTTCAA ACTATTGCAT TGCCATTCTT TTGGACTTTA GTTATTAGAA   8600
TGATGATTGT TATAGGGCAA ATGAGAAATC CATGTGCATC AGCTTCTAGT   8650
TGTTAAAAAA ACCAGATAAA TTAACTTCTA CTGTATACTG TGGGCAGAGG   8700
ATCCTAGAGC TGATCCTACA ACATCAGCTT CTAGTTGTTA AAAAAAAAAA   8750
AAGAAACAGA TAAATTAACT TCTACTGTAT ATACTGTGGG CAGAGGATCT   8800
TACTGTGCCT CTGTTTGTGT ACATGGACTT CGGTGTGTAT CAGTTTGAAG   8850
GACAGCCTTG CCCCATGTAA ACATATAAAT GCAGATTGGT ATCGCCTGGT   8900
TGCTATTTGC TTAAGAACAA ATATTATACA GATGAGATCA GGCATAATTT   8950
TAAAAGATCA TTATCAGTGG AGACCTCATT ATTACTGATA TTACAATGGG   9000
GCCAGTTTTT ATACTTCTGG GTAGAATTAA TAAAATTTTT CTGATCCCAG   9050
AGATCTGAGT TCTCTCTGCA GTTGGAAACA AGAAGCTGTT GTGGGCATTG   9100
TGTCGGGCCA GGGGCCCTTG TGTTTGTGTG GGCAAATATC TTTTAGCAGT   9150
GTGAGCTGCT TTTTTCTTTT CATTAAAAGT CTCTCTAAAA TAATAGAAAT   9200
TTCAGATACT CGGTTCAAGT CTCACTGATT TTGTAGAGGT CCAAAAATGT   9250
AGGATCTGTC ACTTTTGCAG GCCCCTGCCT CACCTAATTC CTGGCCAGGT   9300
GACATTTTGG GCAGAAGTAA ATGCTTCTAT AGTCACAAGC TAAAATGACT   9350
CTAAGCCCCA ATTTCACGGG GGGTATTCAC ATGCTTCCTC TGGAAAATAC   9400
TCTTTGACAG TCAGCTTTGC AAGTAAGTGA TTACCTTGTT AGGAATCAAA   9450
GAAAAATGTA TTTCTCTCTG ACCTTTAGAG GAAAATAGAA TCCTTCCCTT   9500
TTTTGCCCAT TGACACAACT GGCACTGCTC TCTTCCCTTT CTACCACCCT   9550
GGTTCAAAGT AGTCCCCCGA TGCTGTCCTG TTCCTTTCTT AAGCCATAGT   9600
GGATCTCTGA GATCCTACAC CCCACTTTGT GAAACACTGA CTTCATCTTT   9650
GCCCTCGAAT GCCTGATTTT TTCATAAGAG ATTCTAGCAA TTTGGACACT   9700
GTTAAGTGA ACTATCAAAC TACCGCATAG AGAATATTTA AGCTATTAAA   9750
ATTATGGTTT CCCATGAAGA TCAATTCTCT GTGTCCTTCC CTATAGGAAT   9800
TTGAGACGAG TTAGCCCTGT GATGAATCTT GAAACTCACA TATGTCCACA   9850
TACACTTGGT AGAACTTCGA TTTAATCTTT ACATAAAAGC TGTACATATA   9900
ACCAAGAAGT TATTTTGCC AGTAAATTAA CTTATTTGCT TTATTCATCT   9950
TATTTGGTTC CTAATCGTAA ATATTTTGTA GCTGCTGTAA ATTTTTTTCT  10000
CCCAAATGAG GAGTCTTATT ATCATAAAGG TAAAGGCTAT TCAGCTTTGA  10050
TAACCACCTG CAATTCTTTT TTGGATCATT CATCCATCTA ACAAATACAT  10100
AATGAGGACA GTTCATGTTA ATGAAAATCC ATGTTGTTTA ATAGAATGCC  10150
ATCCTTTACC TACTTTGCT CTTTATGGAC GTTTTCTTT TCATGCTCTA   10200
```

FIG. 27E

```
GTGAGCTTTC CCTATATCAT GAGAAGTGGT TATATTTGTG CAAATATACA 10250
AATATAGGAA AACAAAGATT CATACCTGTA GGCAATAGTC TAACTTGTCC 10300
AAACCACTTT GCCTTTACTG CTATTTTTAT CCCCAATGCG TAGATATTTC 10350
CCCCAGGCCT ATAGCCTTTG TGAAGGAAAG CAAATCATAC CTCCTGTATA 10400
TTGACACGAA TCTGGTTTTC AAATGTCATT TCCAGATTTT TTAGTTAATT 10450
GGGGGTTGTC CTTTTCCCTT AATGTGAGAG TCATTTTCCT GTATATTTCT 10500
GGATCTCTCA GGGGCTGGGA GGGGGGAGTG AGGGGACTAC AACCATAGCA 10550
CTCCAAGAAC CCTTTTGGGA TTACTCCAGT AATCAACTAC GAAAGTTATT 10600
TTCTAAATGT AGATATGTAA GGTGTTCTTT TAAAGTAAGG TACTTTGAAA 10650
TATGTAGCAT AAACTGGTAC TGCTGTTAAA TGGGTCGATT ATTAAACGGA 10700
GCAGCTGTGT GAGGGCAGCT AACTTTGAAT GCCTGTCTCC CTGGCTGGTG 10750
TGTCTCCTTC TCATGTTGAG AGCACCAGGG ATTGCGTGGC TGCATGCTGA 10800
AACCGCATTT TCCCATGGTG TATGACTAGT TCATCTCTTT CTTGAGCACC 10850
ATTACAAGAA GATCAAATGA AAATGAGATC AATGTGGAAG ACAATTCATA 10900
GCACAAAAAA AGTCATCTTA AATCTACTCT CAAACATTCA TCTTATACAT 10950
GCATCAAAGT AATTTACTGA CATCAGTTTG GGTGAGAGAG GGAGTCACTT 11000
TACTGAAAAG GCAGAGGCTT AAGGTGTATA CATTTGTACT CACTTCCTTA 11050
TTTTCTTAAC TTGTAAGCAG AAAACAAGCC CTCTCTCTTG TGAAGTATCT 11100
TCAAAGGATT GGGGTGCAAA AATACCTTGC TGGTAAGCCA TCAATGTTTT 11150
ATTTAAATCC CTGCATTCAA AGTTAGCTGC CTTTTGAAA TAAACAAACA 11200
AAAAATACTA CTGTATGTTT GAAAATGTGA ATAGTATTTT TATAGCTTGT 11250
TAAAGACATG GCTAGTTCA TTTGTAAATA AGTATAATGT TGCTTTGATT 11300
TTCTTTTGTG GACATCTTTA TTTGGAACAT AATTGTCTTT AGGGTTGATT 11350
TGTATATAAG TAATTGGCCT GTGATTGTTT CTTTTTTGGT TGGAAGTTAT 11400
CATTTTGACA TTACTTGTGA TTCTGTGTTC AGCACTATTG TGATGTGTTC 11450
AACCTCTGCA CTCGCTTACA CAATAGGATA TGCCAATTGT GTGTGGTGTA 11500
ATGTTATTTT GATTTTTTTC CATGTTATTG ATGAAGGATC ATGCACCTAA 11550
CACATACTAA CTTTTTTAAT GTTAGGCATA TTTTTAGTAT ACTTTCTCTT 11600
ATTCTTTCTT CTCCTCCAAC CTTTTACCCA TCCTCCTTCC TTTCCCTCAT 11650
TCCTGTTGTT ATTTGAGAAT GAGGGAGAAA CAGTATTTTA CATTTATGTA 11700
ATTAGGCTTT TCCGTTAGTT CTCAAGGATC CTCTTTTGGC TCTTGGGAAA 11750
GAATTGTACC TGTACAAGGC AATTATAGAA TGCGAACTGC TTTGCCTCAT 11800
TCCATACTGA TCATCCCAGC TGAACAATTT GAAAACTGTT CTGCCTTTTT 11850
GTTACATGAA TCTGTCAGAA ATATATTTTT AATTTAATAT AAATGAAATT 11900
CAATAAAATA TGAAACAAAC GTTaaaaaaa aaaaaaaaa a
(SEQ ID NO: 27)
```

FIG. 28

```
MKPATGLWVWVSLLVAAGTVQPSDSQSVCAGTENKLSSLSDLEQQYRALRKYYENCEVVM
GNLEITSIEHNRDLSFLRSVREVTGYVLVALNQFRYLPLENLRIIRGTKLYEDRYALAIF
LNYRKDGNFGLQELGLKNLTEILNGGVYVDQNKFLCYADTIHWQDIVRNPWPSNLTLVST
NGSSGCGRCHKSCTGRCWGPTENHCQTLTRTVCAEQCDGRCYGPYVSDCCHRECAGGCSG
PKDTDCFACMNFNDSGACVTQCPQTFVYNPTTFQLEHNFNAKYTYGAFCVKKCPHNFVVD
SSSCVRACPSSKMEVEENGIKMCKPCTDICPKACDGIGTGSLMSAQTVDSSNIDKFINCT
KINGNLIFLVTGIHGDPYNAIEAIDPEKLNVFRTVREITGFLNIQSWPPNMTDFSVFSNL
VTIGGRVLYSGLSLLILKQQGITSLQFQSLKEISAGNIYITDNSNLCYYHTINWTTLFST
INQRIVIRDNRKAENCTAEGMVCNHLCSSDGCWGPGPDQCLSCRRFSRGRICIESCNLYD
GEFREFENGSICVECDPQCEKMEDGLLTCHGPGPDNCTKCSHFKDGPNCVEKCPDGLQGA
NSFIFKYADPDRECHPCHPNCTQGCNGPTSHDCIYYPWTGHSTLPQHARTPLIAAGVIGG
LFILVIVGLTFAVYVRRKSIKKKRALRRFLETELVEPLTPSGTAPNQAQLRILKETELKR
VKVLGSGAFGTVYKGIWVPEGETVKIPVAIKILNETTGPKANVEFMDEALIMASMDHPHL
VRLLGVCLSPTIQLVTQLMPHGCLLEYVHEHKDNIGSQLLLNWCVQIAKGMMYLEERRLV
HRDLAARNVLVKSPNHVKITDFGLARLLEGDEKEYNADGGKMPIKWMALECIHYRKFTHQ
SDVWSYGVTIWELMTFGGKPYDGIPTREIPDLLEKGERLPQPPICTIDVYMVMVKCWMID
ADSRPKFKELAAEFSRMARDPQRYLVIQGDDRMKLPSPNDSKFFQNLLDEEDLEDMMDAE
EYLVPQAFNIPPPIYTSRARIDSNRSEIGHSPPPAYTPMSGNQFVYRDGGFAAEQGVSVP
YRAPTSTIPEAPVAQGATAEIFDDSCCNGTLRKPVAPHVQEDSSTQRYSADPTVFAPERS
PRGELDEEGYMTPMRDKPKQEYLNPVEENPFVSRRKNGDLQALDNPEYHNASNGPPKAED
EYVNEPLYLNTFANTLGKAEYLKNNILSMPEKAKKAFDNPDYWNHSLPPRSTLQHPDYLQ
EYSTKYFYKQNGRIRPIVAENPEYLSEFSLKPGTVLPPPPYRHRNTVV-
(SEQ ID NO: 28)
```

FIG. 29A

```
AGTCCCGCGA CCGAAGCAGG GCGCGCAGCA GCGCTGAGTG CCCCGGAACG  50
TGCGTCGCGC CCCCAGTGTC CGTCGCGTCC GCCGCGCCCC GGGCGGGGAT  100
GGGGCGGCCA GACTGAGCGC CGCACCCGCC ATCCAGACCC GCCGGCCCTA  150
GCCGCAGTCC CTCCAGCCGT GGCCCCAGCG CGCACGGGCG ATGGCGAAGG  200
CGACGTCCGG TGCCGCGGGG CTGCGTCTGC TGTTGCTGCT GCTGCTGCCG  250
CTGCTAGGCA AAGTGGCATT GGGCCTCTAC TTCTCGAGGG ATGCTTACTG  300
GGAGAAGCTG TATGTGGACC AGGCgGCCGG CACGCCCTTG CTGTACGTCC  350
ATGCCCTGCG GGACGCCCCT GAGGAGGTGC CCAGCTTCCG CCTGGGCCAG  400
CATCTCTACG GCACGTACCG CACACGGCTG CATGAGAACA ACTGGATCTG  450
CATCCAGGAG GACACCGGCC TCCTCTACCT TAACCGGAGC CTGGACCATA  500
GCTCCTGGGA GAAGCTCAGT GTCCGCAACC GCGGCTTTCC CCTGCTCACC  550
GTCTACCTCA AGGTCTTCCT GTCACCCACA TCCCTTCGTG AGGGCGAGTG  600
CCAGTGGCCA GGCTGTGCCC GCGTATACTT CTCCTTCTTC AACACCTCCT  650
TCCAGCCTG CAGCTCCCTC AAGCCCCGGG AGCTCTGCTT CCCAGAGACA  700
AGGCCCTCCT TCCGCATTCG GGAGAACCGA CCCCCAGGCA CCTTCCACCA  750
GTTCCGCCTG CTGCCTGTGC AGTTCTTGTG CCCCAACATC AGCGTGGCCT  800
ACAGGCTCCT GGAGGGTGAG GGTCTGCCCT TCCGCTGCGC CCCGGACAGC  850
CTGGAGGTGA GCACGCGCTG GGCCCTGGAC CGCGAGCAGC GGGAGAAGTA  900
CGAGCTGGTG GCCGTGTGCA CCGTGCACGC CGGCGCGCGC GAGGAGGTGG  950
TGATGGTGCC CTTCCCGGTG ACCGTGTACG ACGAGGACGA CTCGGCGCCC  1000
ACCTTCCCCG CGGGCGTCGA CACCGCCAGC GCCGTGGTGG AGTTCAAGCG  1050
GAAGGAGGAC ACCGTGGTGG CCACGCTGCG TGTCTTCGAT GCAGACGTGG  1100
TACCTGCATC AGGGGAGCTG GTGAGGCGGT ACACAAGCAC GCTGCTCCCC  1150
GGGGACACCT GGGCCCAGCA GACCTTCCGG GTGGAACACT GGCCCAACGA  1200
GACCTCGGTC CAGGCCAACG GCAGCTTCGT GCGGGCGACC GTACATGACT  1250
ATAGGCTGGT TCTCAACCGG AACCTCTCCA TCTCGGAGAA CCGCACCATG  1300
CAGCTGGCGG TGCTGGTCAA TGACTCAGAC TTCCAGGGCC AGGAGCGGG  1350
CGTCCTCTTG CTCCACTTCA ACGTGTCGGT GCTGCCGGTC AGCCTGCACC  1400
TGCCCAGTAC CTACTCCCTC TCCGTGAGCA GGAGGGCTCG CCGATTTGCC  1450
CAGATCGGGA AAGTCTGTGT GGAAAACTGC CAGGCATTCA GTGGCATCAA  1500
CGTCCAGTAC AAGCTGCATT CCTCTGGTGC CAACTGCAGC ACGCTAGGGG  1550
TGGTCACCTC AGCCGAGGAC ACCTCGGGGA TCCTGTTTGT GAATGACACC  1600
AAGGCCCTGC GGCGGCCCAA GTGTGCCGAA CTTCACTACA TGGTGGTGGC  1650
CACCGACCAG CAGACCTCTA GGCAGGCCCA GGCCCAGCTG CTTGTAACAG  1700
TGGAGGGGTC ATATGTGGCC GAGGAGGCGG GCTGCCCCCT GTCCTGTGCA  1750
GTCAGCAAGA GACGGCTGGA GTGTGAGGAG TGTGGCGGCC TGGGCTCCCC  1800
AACAGGCAGG TGTGAGTGGA GGCAAGGAGA TGGCAAAGGG ATCACCAGGA  1850
ACTTCTCCAC CTGCTCTCCC AGCACCAAGA CCTGCCCCGA CGGCCACTGC  1900
GATGTTGTGG AGACCCAAGA CATCAACATT TGCCCTCAGG ACTGCCTCCG  1950
GGGCAGCATT GTTGGGGGAC ACGAGCCTGG GGAGCCCCGG GGGATTAAAG  2000
CTGGCTATGG CACCTGCAAC TGCTTCCCTG AGGAGGAGAA GTGCTTCTGC  2050
GAGCCCGAAG ACATCCAGGA TCCACTGTGC GACGAGCTGT GCCGCACGGT  2100
GATCGCAGCC GCTGTCCTCT TCTCCTTCAT CGTCTCGGTG CTGCTGTCTG  2150
CCTTCTGCAT CCACTGCTAC CACAAGTTTG CCCACAAGCC ACCCATCTCC  2200
TCAGCTGAGA TGACCTTCCG GAGGCCCGCC CAGGCCTTCC CGGTCAGCTA  2250
CTCCTCTTCC GGTGCCCGCC GGCCCTCGCT GGACTCCATG GAGAACCAGG  2300
TCTCCGTGGA TGCCTTCAAG ATCCTGGAGG ATCCAAAGTG GGAATTCCCT  2350
CGGAAGAACT TGGTTCTTGG AAAAACTCTA GGAGAAGGCG AATTTGGAAA  2400
AGTGGTCAAG GCAACGGCCT TCCATCTGAA AGGCAGAGCA GGGTACACCA  2450
CGGTGGCCGT GAAGATGCTG AAAGAGAACG CCTCCCCGAG TGAGCTtCGA  2500
GACCTGCTGT CAGAGTTCAA CGTCCTGAAG CAGGTCAACC ACCCACATGT  2550
```

FIG. 29B

```
CATCAAATTG TATGGGGCCT GCAGCCAGGA TGGCCCGCTC CTCCTCATCG  2600
TGGAGTACGC CAAATACGGC TCCCTGCGGG GCTTCCTCCG CGAGAGCCGC  2650
AAAGTGGGGC CTGGCTACCT GGGCAGTGGA GGCAGCCGCA ACTCCAGCTC  2700
CCTGGACCAC CCGGATGAGC GGGCCCTCAC CATGGGCGAC CTCATCTCAT  2750
TTGCCTGGCA GATCTACAG GGGATGCAGT ATCTGGCCGA GATGAAGCTC  2800
GTTCATCGGG ACTTGGCAGC CAGAAACATC CTGGTAGCTG AGGGGCGGAA  2850
GATGAAGATT TCGGATTTCG GCTTGTCCCG AGATGTTTAT GAAGAGGATT  2900
CCTACGTGAA GAGGAGCCAG GGTCGGATTC CAGTTAAATG GATGGCAATT  2950
GAATCCCTTT TTGATCATAT CTACACCACG CAAAGTGATG TATGGTCTTT  3000
TGGTGTCCTG CTGTGGGAGA TCGTGACCCT AGGGGGAAAC CCCTATCCTG  3050
GGATTCCTCC TGAGCGGCTC TTCAACCTTC TGAAGACCGG CCACCGGATG  3100
GAGAGGCCAG ACAACTGCAG CGAGGAGATG TACCGCCTGA TGCTGCAATG  3150
CTGGAAGCAG GAGCCGGACA AAAGGCCGGT GTTTGCGGAC ATCAGCAAAG  3200
ACCTGGAGAA GATGATGGTT AAGAGGAGAG ACTACTTGGA CCTTGCGGCG  3250
TCCACTCCAT CTGACTCCCT GATTTATGAC GACGGCCTCT CAGAGGAGGA  3300
GACACCGCTG GTGGACTGTA ATAATGCCCC CCTCCCTCGA GCCCTCCCTT  3350
CCACATGGAT TGAAAACAAA CTCTATGGTA GAATTTCCCA TGCATTTACT  3400
AGATTCTAGC ACCGCTGTCC CCTcTGCACT ATCCTTCCTC TCTGTGATGC  3450
TTTTTAAAAA TGTTTCTGGT CTGAACAAAA CCAAAGTCTG CTCTGAACCT  3500
TTTTATTTGT AAATGTCTGA CTTTGCATCC AGTTTACATT TAGGCATTAT  3550
TGCAACTATG TTTTTCTAAA AGGAaGTGAA AATAAGTGTA ATTACCACAT  3600
TGCCCAGCAA CTTAGGATGG TAGAGGAAAA AACAGATCAG GGCGGAACTC  3650
TCAGGGGAGA CCAAGAACAG GTTGAATAAG GCGCTTCTGG GGTGGGAATC  3700
AAGTCATAGT ACTTCTACTT TAACTAAGTG GATAAATATA CAAATCTGGG  3750
GAGGTATTCA GTTGAGAAAG GAGCCACCAG CACCACTCAG CCTGCACTGG  3800
GAGCACAGCC AGGTTCCCCC AGACCCCTCC TGGGCAGGCA GGTGCCTCTC  3850
AGAGGCCACC CGGCACTGGC GAGCAGCCAC TGGCCAAGCC TCAGCCCCAG  3900
TCCCAGCCAC ATGTCCTCCA TCAGGGGTAG CGAGGTTGCA GGAGCTGGCT  3950
GGCCCTGGGA GGACGCACCC CCACTGCTGT TTTCACATCC TTTCCCTTAC  4000
CCACCTTCAG GACGGTTGTC ACTTATGAAG TCAGTGCTAA AGCTGGAGCA  4050
GTTGCTTTTT GAAAGAACAT GGTCTGTGGT GCTGTGGTCT TACAATGGAC  4100
AGTAAATATG GTTCTTGCCA AAACTCCTTC TTTTGTCTTT GATTAAATAC  4150
TAGAAATTTa aaaaaaaaaa aaaa (SEQ ID NO: 29)
```

FIG. 30

```
MAKATSGAAGLRLLLLLLLPLLGKVALGLYFSRDAYWEKLYVDQAAGTPLLYVHALRDAP
EEVPSFRLGQHLYGTYRTRLHENNWICIQEDTGLLYLNRSLDHSSWEKLSVRNRGFPLLT
VYLKVFLSPTSLREGECQWPGCARVYFSFFNTSFPACSSLKPRELCFPETRPSFRIRENR
PPGTFHQFRLLPVQFLCPNISVAYRLLEGEGLPFRCAPDSLEVSTRWALDREQREKYELV
AVCTVHAGAREEVVMVPFPVTVYDEDDSAPTFPAGVDTASAVVEFKRKEDTVVATLRVFD
ADVVPASGELVRRYTSTLLPGDTWAQQTFRVEHWPNETSVQANGSFVRATVHDYRLVLNR
NLSISENRTMQLAVLVNDSDFQGPGAGVLLLHFNVSVLPVSLHLPSTYSLSVSRRARRFA
QIGKVCVENCQAFSGINVQYKLHSSGANCSTLGVVTSAEDTSGILFVNDTKALRRPKCAE
LHYMVVATDQQTSRQAQAQLLVTVEGSYVAEEAGCPLSCAVSKRRLECEECGGLGSPTGR
CEWRQGDGKGITRNFSTCSPSTKTCPDGHCDVVETQDINICPQDCLRGSIVGGHEPGEPR
GIKAGYGTCNCFPEEEKCFCEPEDIQDPLCDELCRTVIAAAVLFSFIVSVLLSAFCIHCY
HKFAHKPPISSAEMTFRRPAQAFPVSYSSSGARRPSLDSMENQVSVDAFKILEDPKWEFP
RKNLVLGKTLGEGEFGKVVKATAFHLKGRAGYTTVAVKMLKENASPSELRDLLSEFNVLK
QVNHPHVIKLYGACSQDGPLLLIVEYAKYGSLRGFLRESRKVGPGYLGSGGSRNSSSLDH
PDERALTMGDLISFAWQISQGMQYLAEMKLVHRDLAARNILVAEGRKMKISDFGLSRDVY
EEDSYVKRSQGRIPVKWMAIESLFDHIYTTQSDVWSFGVLLWEIVTLGGNPYPGIPPERL
FNLLKTGHRMERPDNCSEEMYRLMLQCWKQEPDKRPVFADISKDLEKMMVKRRDYLDLAA
STPSDSLIYDDGLSEEETPLVDCNNAPLPRALPSTWIENKLYGRISHAFTRF-
(SEQ ID NO: 30)
```

FIG. 31A

| | | | | | |
|---|---|---|---|---|---|
| AGATGCAGGG | GCGCAAACGC | CAAAGGAGAC | CAGGCTGTAG | GAAGAGAAGG | 50 |
| GCAGAGCGCC | GGACAGCTCG | GCCCGCTCCC | CGTCCTTTGG | GGCCGCGGCT | 100 |
| GGGGAACTAC | AAGGCCCAGC | AGGCAGCTGC | AGGGGGCGGA | GGCGGAGGAG | 150 |
| GGACCAGCGC | GGGTGGGAGT | GAGAGAGCGA | GCCCTCGCGC | CCCGCCGGCG | 200 |
| CATAGCGCTC | GGAGCGCTCT | TGCGGCCACA | GGCGCGGCGT | CCTCGGCGGC | 250 |
| GGGCGGCAGC | TAGCGGGAGC | CGGGACGCCG | GTGCAGCCGC | AGCGCGCGGA | 300 |
| GGAACCCGGG | TGTGCCGGGA | GCTGGGCGGC | CACGTCCGGA | CGGGACCGAG | 350 |
| ACCCCTCGTA | GCGCATTGCG | GCGACCTCGC | CTTCCCCGGC | CGCGAGCGCG | 400 |
| CCGCTGCTTG | AAAAGCCGCG | GAACCCAAGG | ACTTTTCTCC | GGTCCGAGCT | 450 |
| CGGGGCGCCC | CGCAGGGCGC | ACGGTACCCG | TGCTGCAGTC | GGGCACGCCG | 500 |
| CGGCGCCGGG | GCCTCCGCAG | GGCGATGGAG | CCCGGTCTGC | AAGGAAAGTG | 550 |
| AGGCGCCGCC | GCTGCGTTCT | GGAGGAGGGG | GGCACAAGGT | CTGGAGACCC | 600 |
| CGGGTGGCGG | ACGGGAGCCC | TCCCCCCGCC | CCGCCTCCGG | GGCACCAGCT | 650 |
| CCGGCTCCAT | TGTTCCCGCC | CGGGCTGGAG | GCGCCGAGCA | CCGAGCGCCG | 700 |
| CCGGGAGTCG | AGCGCCGGCC | GCGGAGCTCT | TGCGACCCCG | CCAGGACCCG | 750 |
| AACAGAGCCC | GGGGGCGGCG | GGCCGGAGCC | GGGGACGCGG | GCACACGCCC | 800 |
| GCTCGCACAA | GCCACGGCGG | ACTCTCCCGA | GGCGGAACCT | CCACGCCGAG | 850 |
| CGAGGGTCAG | TTTGAAAAGG | AGGATCGAGC | TCACTGTGGA | GTATCCATGG | 900 |
| AGATGTGGAG | CCTTGTCACC | AACCTCTAAC | TGCAGAACTG | GG*ATG*TGGAG | 950 |
| CTGGAAGTGC | CTCCTCTTCT | GGGCTGTGCT | GGTCACAGCC | ACACTCTGCA | 1000 |
| CCGCTAGGCC | GTCCCCGACC | TTGCCTGAAC | AAGCCCAGCC | CTGGGGAGCC | 1050 |
| CCTGTGGAAG | TGGAGTCCTT | CCTGGTCCAC | CCCGGTGACC | TGCTGCAGCT | 1100 |
| TCGCTGTCGG | CTGCGGGACG | ATGTGCAGAG | CATCAACTGG | CTGCGGGACG | 1150 |
| GGGTGCAGCT | GGCGGAAAGC | AACCGCACCC | GCATCACAGG | GGAGGAGGTG | 1200 |
| GAGGTGCAGG | ACTCCGTGCC | CGCAGACTCC | GGCCTCTATG | CTTGCGTAAC | 1250 |
| CAGCAGCCCC | TCGGGCAGTG | ACACCACCTA | CTTCTCCGTC | AATGTTTCAG | 1300 |
| ATGCTCTCCC | CTCCTCGGAG | GATGATGATG | ATGATGATGA | CTCCTCTTCA | 1350 |
| GAGGAGAAAG | AAACAGATAA | CACCAAACCA | AACCCCGTAG | CTCCATATTG | 1400 |
| GACATCCCCA | GAAAAGATGG | AAAAGAAATT | GCATGCAGTG | CCGGCTGCCA | 1450 |
| AGACAGTGAA | GTTCAAATGC | CCTTCCAGTG | GGACCCCAAA | CCCCACACTG | 1500 |
| CGCTGGTTGA | AAAATGGCAA | AGAATTCAAA | CCTGACCACA | GAATTGGAGG | 1550 |
| CTACAAGGTC | CGTTATGCCA | CCTGGAGCAT | CATAATGGAC | TCTGTGGTGC | 1600 |
| CCTCTGACAA | GGGCAACTAC | ACCTGCATTG | TGGAGAATGA | GTACGGCAGC | 1650 |
| ATCAACCACA | CATACCAGCT | GGATGTCGTG | GAGCGGTCCC | CTCACCGGCC | 1700 |
| CATCCTGCAA | GCAGGGTTGC | CCGCCAACAA | AACAGTGGCC | CTGGGTAGCA | 1750 |
| ACGTGGAGTT | CATGTGTAAG | GTGTACAGTG | ACCCGCAGCC | GCACATCCAG | 1800 |
| TGGCTAAAGC | ACATCGAGGT | GAATGGGAGC | AAGATTGGCC | CAGACAACCT | 1850 |
| GCCTTATGTC | CAGATCTTGA | AGACTGCTGG | AGTTAATACC | ACCGACAAAG | 1900 |
| AGATGGAGGT | GCTTCACTTA | AGAAATGTCT | CCTTTGAGGA | CGCAGGGGAG | 1950 |
| TATACGTGCT | TGGCGGGTAA | CTCTATCGGA | CTCTCCCATC | ACTCTGCATG | 2000 |
| GTTGACCGTT | CTGGAAGCCC | TGGAAGAGAG | GCCGGCAGTG | ATGACCTCGC | 2050 |
| CCCTGTACCT | GGAGATCATC | ATCTATTGCA | CAGGGGCCTT | CCTCATCTCC | 2100 |
| TGCATGGTGG | GGTCGGTCAT | CGTCTACAAG | ATGAAGAGTG | GTACCAAGAA | 2150 |
| GAGTGACTTC | CACAGCCAGA | TGGCTGTGCA | CAAGCTGGCC | AAGAGCATCC | 2200 |
| CTCTGCGCAG | ACAGGTAACA | GTGTCTGCTG | ACTCCAGTGC | ATCCATGAAC | 2250 |
| TCTGGGGTTC | TTCTGGTTCG | GCCATCACGG | CTCCTCCA | GTGGGACTCC | 2300 |
| CATGCTAGCA | GGGGTCTCTG | AGTATGAGCT | TCCCGAAGAC | CCTCGCTGGG | 2350 |
| AGCTGCCTCG | GGACAGACTG | GTCTTAGGCA | AACCCCTGGG | AGAGGGCTGC | 2400 |
| TTTGGGCAGG | TGGTGTTGGC | AGAGGCTATC | GGGCTGGACA | AGGACAAACC | 2450 |
| CAACCGTGTG | ACCAAAGTGG | CTGTGAAGAT | GTTGAAGTCG | GACGCAACAG | 2500 |
| AGAAAGACTT | GTCAGACCTG | ATCTCAGAAA | TGGAGATGAT | GAAGATGATC | 2550 |

FIG. 31B

```
GGGAAGCATA AGAATATCAT CAACCTGCTG GGGGCCTGCA CGCAGGATGG  2600
TCCCTTGTAT GTCATCGTGG AGTATGCCTC CAAGGGCAAC CTGCGGGAGT  2650
ACCTGCAGGC CCGGAGGCCC CCAGGGCTGG AATACTGCTA CAACCCCAGC  2700
CACAACCCAG AGGAGCAGCT CTCCTCCAAG GACCTGGTGT CCTGCGCCTA  2750
CCAGGTGGCC CGAGGCATGG AGTATCTGGC CTCCAAGAAG TGCATACACC  2800
GAGACCTGGC AGCCAGGAAT GTCCTGGTGA CAGAGGACAA TGTGATGAAG  2850
ATAGCAGACT TTGGCCTCGC ACGGGACATT CACCACATCG ACTACTATAA  2900
AAAGACAACC AACGGCCGAC TGCCTGTGAA GTGGATGGCA CCCGAGGCAT  2950
TATTTGACCG GATCTACACC CACCAGAGTG ATGTGTGGTC TTTCGGGGTG  3000
CTCCTGTGGG AGATCTTCAC TCTGGGCGGC TCCCCATACC CCGGTGTGCC  3050
TGTGGAGGAA CTTTTCAAGC TGCTGAAGGA GGGTCACCGC ATGGACAAGC  3100
CCAGTAACTG CACCAACGAG CTGTACATGA TGATGCGGGA CTGCTGGCAT  3150
GCAGTGCCCT CACAGAGACC CACCTTCAAG CAGCTGGTGG AAGACCTGGA  3200
CCGCATCGTG GCCTTGACCT CCAACCAGGA GTACCTGGAC CTGTCCATGC  3250
CCCTGGACCA GTACTCCCCC AGCTTTCCCG ACACCCGGAG CTCTACGTGC  3300
TCCTCAGGGG AGGATTCCGT CTTCTCTCAT GAGCCGCTGC CGAGGAGCC   3350
CTGCCTGCCC CGACACCCAG CCCAGCTTGC AATGGCGGA CTCAAACGCC   3400
GCTGACTGCC ACCCACACGC CCTCCCCAGA CTCCACCGTC AGCTGTAACC  3450
CTCACCCACA GCCCTGCTG GGCCCACCAC CTGTCCGTCC CTGTCCCCTT   3500
TCCTGCTGGC AGGAGCCGGC TGCCTACCAG GGGCCTTCCT GTGTGGCCTG  3550
CCTTCACCCC ACTCAGCTCA CCTCTCCCTC CACCTCCTCT CCACCTGCTG  3600
GTGAGAGGTG CAAAGAGGCA GATCTTTGCT GCCAGCCACT TCATCCCCTC  3650
CCAGATGTTG GACCAACACC CCTCCCTGCC ACCAGGCACT GCCTGGAGGG  3700
CAGGGAGTGG GAGCCAATGA ACAGGCATGC AAGTGAGAGC TTCCTGAGCT  3750
TTCTCCTGTC GGTTTGGTCT GTTTTGCCTT CACCCATAAG CCCCTCGCAC  3800
TCTGGTGGCA GGTGCCTTGT CCTCAGGGCT ACAGCAGTAG GGAGGTCAGT  3850
GCTTCGTGCC TCGATTGAAG GTGACCTCTG CCCCAGATAG GTGGTGCCAG  3900
TGGCTTATTA ATTCCGATAC TAGTTTGCTT TGCTGACCAA ATGCCTGGTA  3950
CCAGAGGATG GTGAGGCGAA GGCCAGGTTG GGGGCAGTGT TGTGGCCCTG  4000
GGGCCCAGCC CCAAACTGGG GGCTCTGTAT ATAGCTATGA AGAAAACACA  4050
AAGTGTATAA ATCTGAGTAT ATATTTACAT GTCTTTTAA AAGGGTCGTT   4100
ACCAGAGATT TACCCATCGG GTAAGATGCT CCTGGTGGCT GGGAGGCATC  4150
AGTTGCTATA TATTAAAAAC AAAAAAGAAA AAAAAGGAAA ATGTTTTTAA  4200
AAAGGTCATA TATTTTTGC TACTTTTGCT GTTTTATTTT TTTAAATTAT   4250
GTTCTAAACC TATTTTCAGT TTAGGTCCCT CAATAAAAAT TGCTGCTGCT  4300
TCATTTATCT ATGGGCTGTA TGAAAAGGGT GGGAATGTCC ACTGGAAAGA  4350
AGGGACACCC ACGGGCCCTG GGCTAGGTC TGTCCCGAGG GCACCGCATG   4400
CTCCCGGCGC AGGTTCCTTG TAACCTCTTC TTCCTAGGTC CTGCACCCAG  4450
ACCTCACGAC GCACCTCCTG CCTCTCCGCT GCTTTTGGAA AGTCAGAAAA  4500
AGAAGATGTC TGCTTCGAGG GCAGGAACCC CATCCATGCA GTAGAGGCGC  4550
TGGGCAGAGA GTCAAGGCCC AGCAGCCATC GACCATGGAT GGTTTCCTCC  4600
AAGGAAACCG GTGGGGTTGG GCTGGGGAGG GGGCACCTAC CTAGGAATAG  4650
CCACGGGGTA GAGCTACAGT GATTAAGAGG AAAGCAAGGG CGCGGTTGCT  4700
CACGCCTGTA ATCCAGCAC TTTGGGACAC CGAGGTGGGC AGATCACTTC   4750
AGGTCAGGAG TTTGAGACCA GCCTGGCCAA CTTAGTGAAA CCCCATCTCT  4800
ACTAAAAATG CAAAAATTAT CCAGGCATGG TGGCACACGC CTGTAATCCC  4850
AGCTCCACAG GAGGCTGAGG CAGAATCCCT TGAAGCTGGG AGGCGGAGGT  4900
TGCAGTGAGC CGAGATTGCG CCATTGCACT CCAGCCTGGG CAACAGAGAA  4950
AACAAAAGG AAAACAAATG ATGAAGGTCT GCAGAAACTG AAACCCAGAC   5000
ATGTGTCTGC CCCCTCTATG TGGGCATGGT TTTGCCAGTG CTTCTAAGTG  5050
CAGGAGAACA TGTCACCTGA GGCTAGTTTT GCATTCAGGT CCCTGGCTTC  5100
```

FIG. 31C

```
GTTTCTTGTT GGTATGCCTC CCCAGATCGT CCTTCCTGTA TCCATGTGAC    5150
CAGACTGTAT TTGTTGGGAC TGTCGCAGAT CTTGGCTTCT TACAGTTCTT    5200
CCTGTCCAAA CTCCATCCTG TCCCTCAGGA ACGGGGGGAA AATTCTCCGA    5250
ATGTTTTGG  TTTTTGGCT  GCTTGGAATT TACTTCTGCC ACCTGCTGGT    5300
CATCACTGTC CTCACTAAGT GGATTCTGGC TCCCCCGTAC CTCATGGCTC    5350
AAACTACCAC TCCTCAGTCG CTATATTAAA GCTTATATTT TGCTGGATTA    5400
CTGCTAAATA CAAAAGAAAG TTCAATATGT TTTCATTTCT GTAGGGAAAA    5450
TGGGATTGCT GCTTTAAATT TCTGAGCTAG GGATTTTTTG GCAGCTGCAG    5500
TGTTGGCGAC TATTGTAAAA TTCTCTTTGT TTCTCTCTGT AAATAGCACC    5550
TGCTAACATT ACAATTTGTA TTTATGTTTA AAGAAGGCAT CATTTGGTGA    5600
ACAGAACTAG GAAATGAATT TTTAGCTCTT AAAAGCATTT GCTTTGAGAC    5650
CGCACAGGAG TGTCTTTCCT TGTAAAACAG TGATGATAAT TTCTGCCTTG    5700
GCCCTACCTT GAAGCAATGT TGTGTGAAGG GATGAAGAAT CTAAAAGTCT    5750
TCATAAGTCC TTGGGAGAGG TGCTAGAAAA ATATAAGGCA CTATCATAAT    5800
TACAGTGATG TCCTTGCTGT TACTACTCAA ATCACCCACA AATTTCCCCA    5850
AAGACTGCGC TAGCTGTCAA ATAAAGACA  GTGAAATTGA CCTGAaaaaa    5900
aaaaaaaaaa a (SEQ ID NO: 31)
```

FIG. 32

```
MWSWKCLLFWAVLVTATLCTARPSPTLPEQAQPWGAPVEVESFLVHPGDLLQLRCRLRDD
VQSINWLRDGVQLAESNRTRITGEEVEVQDSVPADSGLYACVTSSPSGSDTTYFSVNVSD
ALPSSEDDDDDDSSSEEKETDNTKPNPVAPYWTSPEKMEKKLHAVPAAKTVKFKCPSSG
TPNPTLRWLKNGKEFKPDHRIGGYKVRYATWSIIMDSVVPSDKGNYTCIVENEYGSINHT
YQLDVVERSPHRPILQAGLPANKTVALGSNVEFMCKVYSDPQPHIQWLKHIEVNGSKIGP
DNLPYVQILKTAGVNTTDKEMEVLHLRNVSFEDAGEYTCLAGNSIGLSHHSAWLTVLEAL
EERPAVMTSPLYLEIIIYCTGAFLISCMVGSVIVYKMKSGTKKSDFHSQMAVHKLAKSIP
LRRQVTVSADSSASMNSGVLLVRPSRLSSSGTPMLAGVSEYELPEDPRWELPRDRLVLGK
PLGEGCFGQVVLAEAIGLDKDKPNRVTKVAVKMLKSDATEKDLSDLISEMEMMKMIGKHK
NIINLLGACTQDGPLYVIVEYASKGNLREYLQARRPPGLEYCYNPSHNPEEQLSSKDLVS
CAYQVARGMEYLASKKCIHRDLAARNVLVTEDNVMKIADFGLARDIHHIDYYKKTTNGRL
PVKWMAPEALFDRIYTHQSDVWSFGVLLWEIFTLGGSPYPGVPVEELFKLLKEGHRMDKP
SNCTNELYMMMRDCWHAVPSQRPTFKQLVEDLDRIVALTSNQEYLDLSMPLDQYSPSFPD
TRSSTCSSGEDSVFSHEPLPEEPCLPRHPAQLANGGLKRR-    (SEQ ID NO: 32)
```

FIG. 33A

```
GCGGCCGCAG CGCGCATTTG GGCTCCGAGG AAGTTGACCG AGGCGGCTGC    50
CGCAGGATCC CGGGCCCGGA TCGCACGAAG CCCGCGCGGC CGTCTCCTCC   100
GCGCGCCACC CCTGCGCCTC CCGCGAGCTC CACTTCCCAT CTGCTATTGT   150
TTCCGATTGT TTTCCGGTGG CGAGCCCGGC TCCGAAACTT ACAAAGTGTT   200
GGATGTCCCC CGTTCGAACT GAGGGACTGC AGACCGCCTC TGGGTAGCTG   250
GATGAAGCCC ACCCCGTCCC CTTCTGGTAC CAAAGTGCTT ACTCCTCTCC   300
AAAGTGCCGT GTCTGAACTG CCGCTGGGAA GAAGCGGCTC CTGAGACGCG   350
CCCACACCTT TCACCTGCCG CGCGCTTCCC CCTCCTCGGC CACCTTCCCG   400
GCGGAAGCAG CGAGGAGGGA GCCCCCTTTG GCCGTCCTCC GTGGAACCGG   450
TTTTCCGAGG CTGGCAAAAG CCGAGGCTGG ATTTGGGGGA GGAATATTAG   500
ACTCGGAGGA GTCTGCGCGC TTTTCTCCTC CCCGCGCCTC CCGGTCGCCG   550
CGGGTTCACC GCTCAGTCCC CGCGCTCGCT CCGCACCCCA CCCACTTCCT   600
GTGCTCGCCC GGGGGGCGTG TGCCGTGCGG CTGCCGGAGT TCGGGGAAGT   650
TGTGGCTGTC GAGA*ATG*GGG GTCTGTGGT ACCTGTTCCT GCCCTGGAAG   700
TGCCTCGTGG TCGTGTCTCT CAGGCTGCTG TTCCTTGTAC CCACAGGAGT   750
GCCCGTGCGC AGCGGAGATG CCACCTTCCC CAAAGCTATG ACAACGTGA   800
CGGTCCGGCA GGGGGAGAGC GCCACCCTCA GGTGCACTAT TGACAACCGG   850
GTCACCCGGG TGGCCTGGCT AAACCGCAGC ACCATCCTCT ATGCTGGGAA   900
TGACAAGTGG TGCCTGGATC CTCGCGTGGT CCTTCTGAGC AACACCCAAA   950
CGCAGTACAG CATCGAGATC CAGAACGTGG ATGTGTATGA CGAGGGCCCT  1000
TACACCTGCT CGGTGCAGAC AGACAACCAC CCAAAGACCT CTAGGGTCCA  1050
CCTCATTGTG CAAGTATCTC CCAAAATTGT AGAGATTTCT TCAGATATCT  1100
CCATTAATGA AGGGAACAAT ATTAGCCTCA CCTGCATAGC AACTGGTAGA  1150
CCAGAGCCTA CGGTTACTTG GAGACACATC TCTCCCAAAG CGGTTGGCTT  1200
TGTGAGTGAA GACGAATACT TGGAAATTCA GGGCATCACC AGGGAGCAGT  1250
CAGGGGACTA CGAGTGCAGT GCCTCCAATG ACGTGGCCGC GCCCGTGGTA  1300
CGGAGAGTAA AGGTCACCGT GAACTATCCA CCATACATTT CAGAAGCCAA  1350
GGGTACAGGT GTCCCCGTGG GACAAAAGGG GACACTGCAG TGTGAAGCCT  1400
CAGCAGTCCC CTCAGCAGAA TTCCAGTGGT ACAAGGATGA CAAAAGACTG  1450
ATTGAAGGAA AGAAAGGGGT GAAAGTGGAA AACAGACCTT TCCTCTCAAA  1500
ACTCATCTTC TTCAATGTCT CTGAACATGA CTATGGGAAC TACACTTGCG  1550
TGGCCTCCAA CAAGCTGGGC CACACCAATG CCAGCATCAT GCTATTTGGT  1600
CCAGGCGCCG TCAGCGAGGT GAGCAACGGC ACGTCGAGGA GGGCAGGCTG  1650
CGTCTGGCTG CTGCCTCTTC TGGTCTTGCA CCTGCTTCTC AAATTT*TGA*T  1700
GTGAGTGCCA CTTCCCCACC CGGGAAAGGC TGCCGCCACC ACCACCACCA  1750
ACACAACAGC AATGGCAACA CCGACAGCAA CCAATCAGAT ATATACAAAT  1800
GAAATTAGAA GAAACACAGC CTCATGGGAC AGAAATTTGA GGGAGGGGAA  1850
CAAAGAATAC TTTGGGGGGA AAAAGTTTT AAAAAAGAAA TTGAAAATTG  1900
CCTTGCAGAT ATTTAGGTAC AATGGAGTTT TCTTTTCCCA AACGGGAAGA  1950
ACACAGCACA CCCGGCTTGG ACCCACTGCA AGCTGCATCG TGCAACCTCT  2000
TTGGTGCCAG TGTGGGCAAG GGCTCAGCCT CTCTGCCCAC AGAGTGCCCC  2050
CACGTGGAAC ATTCTGGAGC TGGCCATCCC AAATTCAATC AGTCCATAGA  2100
GACGAACAGA ATGAGACCTT CCGGCCCAAG CGTGGCGCTG CGGGCACTTT  2150
GGTAGACTGT GCCACCACGG CGTGTGTTGT GAAACGTGAA ATAAAAAGAG  2200
CAAGAAAGAA AAAGGAAACA AAATAAGACC GTCTGACAGC AACAACGGTC  2250
CCACAAACAA GTCACAAAAG ATACCGTTAA ACTTTTTTT TTTTTATCA  2300
TTTTACTACA TGAACATCAT GGATAACAAG GGATTCTGAT TCATTATTAA  2350
TTTCATTAAT TATATTTCT GATATGAGTC TAGAACTTAC TGCAAAACA  2400
AGACAAAACT AAAAAAATAC AACTGAGAAG GGTGAAGAGA AGTATGTTTG  2450
TTAAACAGTA AAAATGAATA GTATACTTCT TAACTAGGTT TACAACTGGT  2500
GGACCACACA CCAGGCACTA ATCACCTGGT GAGGATTTGG CATATCCACC  2550
```

FIG. 33B

```
AAAAAATGCA TCCGATTTAA CCAACATCTC CACCAGCGCT ACGGACTCCT 2600
CCCAATTCTG ACATCTCTTG CAGACAATAC TATGCTCTCT ACACACTGTT 2650
TAGAAATGGA AAGGTGATCT GCACTGTATC TTGGGTTTGT TGGCTATGCT 2700
TCCTTTGATG ACATATATTA TACAGTATAT ATATACATAT ATTTTTTTG  2750
TTAGAGTTCT AGCCATTTTA TTTCTCCGCA GGGTCCTTTC TCAGACATTA 2800
CTGCATGCTG TATATGGCGT TAGCTGTGTG TTGATCTTCT AAAAGATGAT 2850
AGAGTTTACT GGTAATTGTG TAATCAGCTC CTGCCTTTTT ATTTCTTGG  2900
GTTATTTACA TGTCAGAGAC ATTTATAAAA AGTGAAAGGA TAAAAAAAAA 2950
AAAAAACAAC TAATACCGGG CGCAGCATCT TTCCAGGTGT GGCTCTGCGC 3000
TAGGCCACCC CAGGTGGCCC CGCTTCTCC  ATTCTGCCCT GTGGCGTTAA 3050
CAGACAGCAA GCAGCTGAAC AAGCAGTACC GTCAGTACCC ACTTGCTTTA 3100
GCCCATTATG GGAATCTCTG ATGCCTTTGT GACCACTGGA GAGTTTAATC 3150
CTCTTGGTTT ATTTTATTTC CCACCTTTGT GTGAGTGTGT ATGAAAGAGA 3200
AGAAAATGCA ATTTTTAGGT AATCTTTTTT TTTTTTCCCC TCCCCTGAAA 3250
GTCTGGGAAC CTGAGAGTCC TCGGGGAGGG GTCCTGGATG TGATGAGGGA 3300
AAGGGGGATT GGGGGATCCG GGAGGGTGGG GTTGTCTCTG ACTTGACATT 3350
AAAAAGTGTT CCATGTCCCT CTTCAaaaaa a (SEQ ID NO: 33)
```

FIG. 34

```
MGVCGYLFLPWKCLVVVSLRLLFLVPTGVPVRSGDATFPKAMDNVTVRQGESATLRCTID
NRVTRVAWLNRSTILYAGNDKWCLDPRVVLLSNTQTQYSIEIQNVDVYDEGPYTCSVQTD
NHPKTSRVHLIVQVSPKIVEISSDISINEGNNISLTCIATGRPEPTVTWRHISPKAVGFV
SEDEYLEIQGITREQSGDYECSASNDVAAPVVRRVKVTVNYPPYISEAKGTGVPVGQKGT
LQCEASAVPSAEFQWYKDDKRLIEGKKGVKVENRPFLSKLIFFNVSEHDYGNYTCVASNK
LGHTNASIMLFGPGAVSEVSNGTSRRAGCVWLLPLLVLHLLLKF- (SEQ ID NO: 34)
```

FIG. 35A

| | | | | | |
|---|---|---|---|---|---|
| ATCATTCATT | CTTTTGCCTG | GAGTTTTGTG | AGGTACCCGC | TTGCTTTATG | 50 |
| GGAAAAGGCT | GCTCCGGAAC | TGCCCTACTT | TAGACTTTTT | CATGGTTATC | 100 |
| AATCTGTACA | AAGAATCACC | AAACTGATAA | AGCAGGAACC | AGAGGGCAAA | 150 |
| TCACGCTGCC | AAGACAACTG | TGTAATTCGC | TCGAAAAAGA | AACGATGGAG | 200 |
| TCTCGCTCTG | TCACCCAGGC | TGGAGTATAG | TGGTGTGATC | TTGGCTCACT | 250 |
| GCAACCTCTG | CCTCCCAGGT | TCAAGCGATT | CTCCTGCCTC | AGCCTCTCGA | 300 |
| GTAGCTGGAA | TTACAGGTCT | GGCAGAAGGA | ACAGTATCAA | CTGACTGAGT | 350 |
| AGGTCTCATT | GGCAGTTGTG | ATTCAGAGAC | CTAGAAAGCT | GAACCCACGG | 400 |
| CTGGCAAGAA | GAGGATGGTT | TGTGGGACCT | GGGCTGATGT | CTGATGAAAT | 450 |
| TTTAAGCCCC | AGCTATAGCT | ACTACAAAGA | AAAGTGGCTG | ATGATAAGCA | 500 |
| TGTAACTCAA | AAAGACAATG | TATATAAAAA | T*ATG*CAAGAA | TCACAGGAAA | 550 |
| CCCACATATC | CAACCACCTA | GATGAAGTTG | TTGCTGCTGT | TAGCATCACT | 600 |
| CATAGAAAGA | AGTTCCAAAA | CAAGCTGCTT | CAGACAGCAC | TATTCCAGCC | 650 |
| TCCTCGAGAG | AAACTCCACC | TCTGTGAAGA | GAAAGCAAAG | TCCTATTCCA | 700 |
| ACAGTCATGA | GTACAAACAG | GCCGTCCATG | AGCTTGTGCG | TTGCGTAGCA | 750 |
| CTGACAAGAA | TTTGCTATGG | AGACTCACAT | TGGAAACTAG | CAGAGGCACA | 800 |
| TGTTAATCTG | GCTCAAGGCT | ACCTCCAGCT | GAAAGGACTG | TCACTGCAAG | 850 |
| CAAAACAACA | TGCAGAAAAA | GCCAGACAAA | TCCTCGCCAA | CTCCATTGTG | 900 |
| CCTCCCTATA | GTGAGAATAC | AGATGTTTC | AAGTTTCCA | TTGAGCTTTT | 950 |
| CCATACCATG | GGCAGAGCTT | TACTCTCCCT | TCAAAAATTT | AAGGAAGCTG | 1000 |
| CAGAGAATTT | GACAAAAGCA | GAGAGACTTT | CAAAGGAGCT | GCTACAATGT | 1050 |
| GGAAGAATTA | TAAAGGAAGA | ATGGATAGAA | ATTGAAGCAC | GGATCAGATT | 1100 |
| ATCATTTGCA | CAGGTGTATC | AAGGTCAGAA | GAAGTCAAAA | GAAGCTTTGT | 1150 |
| CCCACTATCA | AGCAGCTTTG | GAATATGTTG | AGATCAGTAA | AGGTGAAACA | 1200 |
| AGTCGTGAGT | GTGTACCCAT | ATTGAGAGAA | TTAGCAGGTG | TAGAGCAAGC | 1250 |
| CCTGGGACTC | CACGATGTAT | CCATCAACCA | CTTCCTCCAG | GCACATCTTA | 1300 |
| TCATCCTGAG | TAGAAGCCCC | TCTCAAGTGG | AGGCAGCAGA | CTCGGCACAC | 1350 |
| ATCGTCGCCC | ATGCTGCTGT | CGCTTCAGGG | AGACACGAGC | ACCATGATGT | 1400 |
| AGCTGAGCAG | TATTTTCAAG | AGAGCATGGC | TCATCTTAAG | GATTCTGAAG | 1450 |
| GGATGGGAAG | AACCAAATTT | CTTTCAATTC | AAGATGAATT | TTGCCATTTT | 1500 |
| CTACAAATGA | CTGGACAAAA | AGAGAGAGCA | ACCTCGATCC | TGAGAGAGTC | 1550 |
| CCTGGAAGCC | AAAGTGGAAG | CATTTGGCGA | TTTCAGTCCC | GAGGTGGCAG | 1600 |
| AGACATACCG | GCTCCTGGGA | GGAGCAGACC | TGGCGCAGGG | GAACCACAGT | 1650 |
| GGGGCCCGCA | AGAAACTGAA | GAAGTGTCTC | CAGATCCAGA | CCCTCTTATA | 1700 |
| TGGACCGCAG | GACAAAAGGA | CTCTGGCCAC | CCAGCAGGCC | ATGGGCATGC | 1750 |
| TGTCCACGGC | CCCCAAGGTT | GCTTCGAAGC | CAAGGCAGGC | ATCAAAAGCC | 1800 |
| AAAGTGGCCT | TCTGCACCAG | CATCCCTCAG | GACACCCTGC | TGGGGAAGGC | 1850 |
| CCGGCCCGGC | ACAACAGCAG | AC*TGA*GGCCC | CCACCCTGAA | AAAGCCTAGG | 1900 |
| ACATTCCTGG | GCACTGTCAT | TTAGGGTGCT | GTACAAATCA | CCTCCGCCTA | 1950 |
| GAAAATGGAA | TTCAACAGTC | AGGATACAGA | TTTCAAGGC | CAACTGTTGG | 2000 |
| CCCCAACATG | CAACAGTGAG | ACCATAAGCC | TCCCGTGGGC | CACATTTTGA | 2050 |
| CAGTGGATGC | CCTTCAGGGT | GATATATGCT | ATAAAGCAGT | TTTCTATCAC | 2100 |
| CTAAGTGGTT | TTTCTTGCCA | ACAAGAATTT | TTACCCATCA | GCACTACTGT | 2150 |
| GGCTGAAAAA | CTTCTCTTCA | ACAGTTCAGT | GCGCCCTGTG | CAGGAGTCAG | 2200 |
| CCCGGCATCT | GCTTGTACAC | ACAGCTCCTT | GCATAGGTGT | GGAGTTAGAT | 2250 |
| CTGGACAGTG | AACTTCAGGA | AGTCCTTTCT | TATAGGAGGC | TAATAGGGAT | 2300 |
| TGAGAATAAC | ATGAGAAGAA | AACGCTAATA | AAGGGAAACC | TGAACACGCT | 2350 |
| GCTGTCAGCA | TGTGTTTTCA | AAGTGCAGCC | TGCCTCAGAG | TTCTTCGGAG | 2400 |
| CCTGAAAAGG | GGTTTGAGAA | AGAGCCCAGT | AGGAGGGGCA | GGAGGCCGAC | 2450 |
| ACACCTGACT | TGGCCTGGGG | CCCAGGAGGC | AGGTGTAAGG | GAGTGAAAAG | 2500 |
| AAAGGCTAGC | CGGAGGCTGC | GGGGGGAAGA | CCGCAGACTC | CCTGCTGCTT | 2550 |

FIG. 35B

```
CGCATCCCTC CTGTGGCCTC CACTGCAGGC AGGACAAACC TGGATGCCAC  2600
CTGGAGCTGC TTCCTGAGTT GGCACACTAT CGTGTACACA GCAGTCTTCA  2650
GCCCCCTGGA AGGAGGCCAT AGTCGTGTGA GGATGGCAAA GTCGAACAGG  2700
AAGCTTTGAG TGCCTTCCTC CACGATGTCA ACGAGGAGAT CCAGTGCCAG  2750
ATCGAGGTGG ATGGAACACC CAGGGGTAGG GGTGCAGGTG TGGGCAGTGA  2800
TGTCCCTTCC CCTCCCTCCC CTGGTCCCAC AGACTGTGGC CATGAGGCTG  2850
CAGGCTGGTG CTATGACAGC AGATTGCAGC ACAGGGCCCT CCCCTCCAGC  2900
CCCCAGTGGG ACATCAAAAC CACCCTGGGG CCATTTGTGC AGGGCACCAC  2950
CTCCAGTATT GATGGGGAAA ATAAACTCAG TAGAGCCACG ACAGGGTGGA  3000
GAGAAGCAGG GACCATTGTC TTCCTCAGGA GCGTGACAGC TGACCCCACA  3050
GACCATGCTT GCTGGTACAC ACTGGTCCCA GACCCAGGCC TGTCGGACAT  3100
CAGCAGTGTG CTAAAAACGT GTAAGATGTC ACTACTCACC GTGTGTCCTA  3150
TCTAGTTGAC ATGGGTGGAG TCAGCTAAGG GGTGAATGTT CATATGCTCC  3200
CAATTCACGT TGAAGCCCTA ATCCCCAAAG GGATGGTATT GGGGGTGGGG  3250
TCTTGGAGAG GTGATTAGGT TATGAGGGTG GAGCCCTGAT GAATGGGATT  3300
AGTGCTTTAT AAGGAGAGAC ACCAGAGAGA TGATCTCTCT CTCCACCATG  3350
TGAGGACACA GTGAGAAGAC AGCCGTCTGC AGGCCCGGAA GAGAGCCCTC  3400
ACCAGGAAAT GAAACTGTTG GCACCTTGAG ACTTCCCAGC TTCCAGAACT  3450
GTAAGAAATA AATGTTTGTT GTTTAAGCCT TTCAGGCTAC GGCTTTCTGT  3500
TACAGCAGCC TGAACTGAGA GTCCATGCCG AGTTTTTGAA ATAAATGTGA  3550
ATTCTGATGT TA (SEQ ID NO: 35)
```

FIG. 36

```
MQESQETHISNHLDEVVAAVSITHRKKFQNKLLQTALFQPPREKLHLCEEKAKSYSNSHE
YKQAVHELVRCVALTRICYGDSHWKLAEAHVNLAQGYLQLKGLSLQAKQHAEKARQILAN
SIVPPYSENTDVFKFSIELFHTMGRALLSLQKFKEAAENLTKAERLSKELLQCGRIIKEE
WIEIEARIRLSFAQVYQGQKKSKEALSHYQAALEYVEISKGETSRECVPILRELAGVEQA
LGLHDVSINHFLQAHLIILSRSPSQVEAADSAHIVAHAAVASGRHEHHDVAEQYFQESMA
HLKDSEGMGRTKFLSIQDEFCHFLQMTGQKERATSILRESLEAKVEAFGDFSPEVAETYR
LLGGADLAQGNHSGARKKLKKCLQIQTLLYGPQDKRTLATQQAMGMLSTAPKVASKPRQA
SKAKVAFCTSIPQDTLLGKARPGTTAD- (SEQ ID NO: 36)
```

FIG. 37A

```
TTTTTTTTTT TTTTTTTTGA GAAAGGGGAA TTTCATCCCA AATAAAAGGA   50
ATGAAGTCTG GCTCCGGAGG AGGGTCCCCG ACCTCGCTGT GGGGGCTCCT  100
GTTTCTCTCC GCCGCGCTCT CGCTCTGGCC GACGAGTGGA GAAATCTGCG  150
GGCCAGGCAT CGACATCCGC AACGACTATC AGCAGCTGAA GCGCCTGGAG  200
AACTGCACGG TGATCGAGGG CTACCTCCAC ATCCTGCTCA TCTCCAAGGC  250
CGAGGACTAC CGCAGCTACC GCTTCCCCAA GCTCACGGTC ATTACCGAGT  300
ACTTGCTGCT GTTCCGAGTG GCTGGCCTCG AGAGCCTCGG AGACCTCTTC  350
CCCAACCTCA CGGTCATCCG CGGCTGGAAA CTCTTCTACA ACTACGCCCT  400
GGTCATCTTC GAGATGACCA ATCTCAAGGA TATTGGGCTT TACAACCTGA  450
GGAACATTAC TCGGGGGGCC ATCAGGATTG AGAAAAATGC TGACCTCTGT  500
TACCTCTCCA CTGTGGACTG GTCCCTGATC CTGGATGCGG TGTCCAATAA  550
CTACATTGTG GGGAATAAGC CCCCAAAGGA ATGTGGGGAC CTGTGTCCAG  600
GGACCATGGA GGAGAAGCCG ATGTGTGAGA AGACCACCAT CAACAATGAG  650
TACAACTACC GCTGCTGGAC CACAAACCGC TGCCAGAAAA TGTGCCCAAG  700
CACGTGTGGG AAGCGGGCGT GCACCGAGAA CAATGAGTGC TGCCACCCCG  750
AGTGCCTGGG CAGCTGCAGC GCGCCTGACA ACGACACGGC CTGTGTAGCT  800
TGCCGCCACT ACTACTATGC CGGTGTCTGT GTGCCTGCCT GCCCGCCCAA  850
CACCTACAGG TTTGAGGGCT GGCGCTGTGT GGACCGTGAC TTCTGCGCCA  900
ACATCCTCAG CGCCGAGAGC AGCGACTCCG AGGGGTTTGT GATCCACGAC  950
GGCGAGTGCA TGCAGGAGTG CCCCTCGGGC TTCATCCGCA ACGGCAGCCA 1000
GAGCATGTAC TGCATCCCTT GTGAAGGTCC TTGCCCGAAG GTCTGTGAGG 1050
AAGAAAAGAA AACAAAGACC ATTGATTCTG TTACTTCTGC TCAGATGCTC 1100
CAAGGATGCA CCATCTTCAA GGGCAATTTG CTCATTAACA TCCGACGGGG 1150
GAATAACATT GCTTCAGAGC TGGAGAACTT CATGGGGCTC ATCGAGGTGG 1200
TGACGGGCTA CGTGAAGATC CGCCATTCTC ATGCCTTGGT CTCCTTGTCC 1250
TTCCTAAAAA ACCTTCGCCT CATCCTAGGA GAGGAGCAGC TAGAAGGGAA 1300
TTACTCCTTC TACGTCCTCG ACAACCAGAA CTTGCAGCAA CTGTGGGACT 1350
GGGACCACCG CAACCTGACC ATCAAAGCAG GAAAATGTA CTTTGCTTTC 1400
AATCCCAAAT TATGTGTTTC CGAAATTTAC CGCATGGAGG AAGTGACGGG 1450
GACTAAAGGG CGCCAAAGCA AAGGGGACAT AAACACCAGG AACAACGGGG 1500
AGAGAGCCTC CTGTGAAAGT GACGTCCTGC ATTTCACCTC CACCACCACG 1550
TCGAAGAATC GCATCATCAT AACCTGGCAC CGGTACCGGC CCCCTGACTA 1600
CAGGGATCTC ATCAGCTTCA CCGTTACTA CAAGGAAGCA CCCTTTAAGA 1650
ATGTCACAGA GTATGATGGG CAGGATGCCT GCGGCTCCAA CAGCTGGAAC 1700
ATGGTGGACG TGGACCTCCC GCCCAACAAG GACGTGGAGC CCGGCATCTT 1750
ACTACATGGG CTGAAGCCCT GGACTCAGTA CGCCGTTTAC GTCAAGGCTG 1800
TGACCCTCAC CATGGTGGAG AACGACCATA TCCGTGGGGC CAAGAGTGAG 1850
ATCTTGTACA TTCGCACCAA TGCTTCAGTT CCTTCCATTC CCTTGGACGT 1900
TCTTTCAGCA TCGAACTCCT CTTCTCAGTT AATCGTGAAG TGGAACCCTC 1950
CCTCTCTGCC CAACGGCAAC CTGAGTTACT ACATTGTGCG CTGGCAGCGG 2000
CAGCCTCAGG ACGGCTACCT TTACCGGCAC AATTACTGCT CCAAAGACAA 2050
AATCCCCATC AGGAAGTATG CCGACGGCAC CATCGACATT GAGGAGGTCA 2100
CAGAGAACCC CAAGACTGAG GTGTGTGGTG GGGAGAAAGG GCCTTGCTGC 2150
GCCTGCCCCA AAACTGAAGC CGAGAAGCAG GCCGAGAAGG AGGAGGCTGA 2200
ATACCGCAAA GTCTTTGAGA ATTTCCTGCA CAACTCCATC TTCGTGCCCA 2250
GACCTGAAAG GAAGCGGAGA GATGTCATGC AAGTGGCCAA CACCACCATG 2300
TCCAGCCGAA GCAGGAACAC CACGGCCGCA GACACCTACA ACATCACCGA 2350
CCCGGAAGAG CTGGAGACAG AGTACCCTTT CTTTGAGAGC AGAGTGGATA 2400
ACAAGGAGAG AACTGTCATT TCTAACCTTC GGCCTTTCAC ATTGTACCGC 2450
ATCGATATCC ACAGCTGCAA CCACGAGGCT GAGAAGCTGG GCTGCAGCGC 2500
CTCCAACTTC GTCTTTGCAA GGACTATGCC CGCAGAAGGA GCAGATGACA 2550
```

FIG. 37B

```
TTCCTGGGCC AGTGACCTGG GAGCCAAGGC CTGAAAACTC CATCTTTTTA 2600
AAGTGGCCGG AACCTGAGAA TCCCAATGGA TTGATTCTAA TGTATGAAAT 2650
AAAATACGGA TCACAAGTTG AGGATCAGCG AGAATGTGTG TCCAGACAGG 2700
AATACAGGAA GTATGGAGGG GCCAAGCTAA ACCGGCTAAA CCCGGGGAAC 2750
TACACAGCCC GGATTCAGGC CACATCTCTC TCTGGGAATG GGTCGTGGAC 2800
AGATCCTGTG TTCTTCTATG TCCAGGCCAA AACAGGATAT GAAAACTTCA 2850
TCCATCTGAT CATCGCTCTG CCCGTCGCTG TCCTGTTGAT CGTGGGAGGG 2900
TTGGTGATTA TGCTGTACGT CTTCCATAGA AAGAGAAATA ACAGCAGGCT 2950
GGGGAATGGA GTGCTGTATG CCTCTGTGAA CCCGGAGTAC TTCAGCGCTG 3000
CTGATGTGTA CGTTCCTGAT GAGTGGGAGG TGGCTCGGGA GAAGATCACC 3050
ATGAGCCGGG AACTTGGGCA GGGGTCGTTT GGGATGGTCT ATGAAGGAGT 3100
TGCCAAGGGT GTGGTGAAAG ATGAACCTGA AACCAGAGTG GCCATTAAAA 3150
CAGTGAACGA GGCCGCAAGC ATGCGTGAGA GGATTGAGTT TCTCAACGAA 3200
GCTTCTGTGA TGAAGGAGTT CAATTGTCAC CATGTGGTGC GATTGCTGGG 3250
TGTGGTGTCC CAAGGCCAGC CAACACTGGT CATCATGGAA CTGATGACAC 3300
GGGGCGATCT CAAAAGTTAT CTCCGGTCTC TGAGGCCAGA AATGGAGAAT 3350
AATCCAGTCC TAGCACCTCC AAGCCTGAGC AAGATGATTC AGATGGCCGG 3400
AGAGATTGCA GACGGCATGG CATACCTCAA CGCCAATAAG TTCGTCCACA 3450
GAGACCTTGC TGCCCGGAAT TGCATGGTAG CCGAAGATTT CACAGTCAAA 3500
ATCGGAGATT TTGGTATGAC GCGAGATATC TATGAGACAG ACTATTACCG 3550
GAAAGGAGGG AAAGGGCTGC TGCCCGTGCG CTGGATGTCT CCTGAGTCCC 3600
TCAAGGATGG AGTCTTCACC ACTTACTCGG ACGTCGGTC CTTCGGGGTC 3650
GTCCTCTGGG AGATCGCCAC ACTGGCCGAG CAGCCCTACC AGGGCTTGTC 3700
CAACGAGCAA GTCCTTCGCT TCGTCATGGA GGGCGGCCTT CTGGACAAGC 3750
CAGACAACTG TCCTGACATG CTGTTTGAAC TGATGCGCAT GTGCTGGCAG 3800
TATAACCCCA AGATGAGGCC TTCCTTCCTG GAGATCATCA GCAGCATCAA 3850
AGAGGAGATG GAGCCTGGCT TCCGGGAGGT CTCCTTCTAC TACAGCGAGG 3900
AGAACAAGCT GCCCGAGCCG GAGGAGCTGG ACCTGGAGCC AGAGAACATG 3950
GAGAGCGTCC CCCTGGACCC CTCGGCCTCC TCGTCCTCCC TGCCACTGCC 4000
CGACAGACAC TCAGGACACA AGGCCGAGAA CGGCCCCGGC CCTGGGGTGC 4050
TGGTCCTCCG CGCCAGCTTC GACGAGAGAC AGCCTTACGC CCACATGAAC 4100
GGGGGCCGCA AGAACGAGCG GGCCTTGCCG CTGCCCCAGT CTTCGACCTG 4150
CTGATCCTTG GATCCTGAAT CTGTGCAAAC AGTAACGTGT GCGCACGCGC 4200
AGCGGGGTGG GGGGGGAGAG AGAGTTTTAA CAATCCATTC ACAAGCCTCC 4250
TGTACCTCAG TGGATCTTCA GAACTGCCCT TGCTGCCCGC GGGAGACAGC 4300
TTCTCTGCAG TAAAACACAT TTGGGATGTT CCTTTTTTCA ATATGCAAGC 4350
AGCTTTTTAT TCCCTGCCCA AACCCTTAAC TGACATGGGC CTTTAAGAAC 4400
CTTAATGACA ACACTTAATA GCAACAGAGC ACTTGAGAAC CAGTCTCCTC 4450
ACTCTGTCCC TGTCCTTCCC TGTTCTCCCT TTCTCTCTCC TCTCTGCTTC 4500
ATAACGGAAA AATAATTGCC ACAAGTCCAG CTGGGAAGCC CTTTTTATCA 4550
GTTTGAGGAA GTGGCTGTCC CTGTGGCCCC ATCCAACCAC TGTACACACC 4600
CGCCTGACAC CGTGGGTCAT TACAAAAAAA CACGTGGAGA TGGAAATTTT 4650
TACCTTTATC TTTCACCTTT CTAGGGACAT GAAATTTACA AAGGGCCATC 4700
GTTCATCCAA GGCTGTTACC ATTTTAACGC TGCCTAATTT TGCCAAAATC 4750
CTGAACTTTC TCCCTCATCG GCCCGGCGCT GATTCCTCGT GTCCGGAGGC 4800
ATGGGTGAGC ATGGCAGCTG GTTGCTCCAT TTGAGAGACA CGCTGGCGAC 4850
ACACTCCGTC CATCCGACTG CCCCTGCTGT GCTGCTCAAG GCCACAGGCA 4900
CACAGGTCTC ATTGCTTCTG ACTAGATTAT TATTTGGGGG AACTGGACAC 4950
AATAGGTCTT TCTCTCAGTG AAGGTGGGGA GAAGCTGAAC CGGCTTCCCT 5000
GCCCTGCCTC CCCAGCCCCC TGCCCAACCC CCAAGAATCT GGTGGCCATG 5050
GGCCCCGAAG CAGCCTGGCG GACAGGCTTG GAGTCAAGGG GCCCCATGCC 5100
```

FIG. 37C

```
TGCTTCTCTC CCAGCCCCAG CTCCCCCGCC CGCCCCCAAG GACACAGATG  5150
GGAAGGGGTT TCCAGGGACT CAGCCCCACT GTTGATGCAG GTTTGCAAGG  5200
AAAGAAATTC AAACACCACA ACAGCAGTAA GAAGAAAAGC AGTCAATGGA  5250
TTCAAGCATT CTAAGCTTTG TTGACATTTT CTCTGTTCCT AGGACTTCTT  5300
CATGGGTCTT ACAGTTCTAT GTTAGACCAT GAAACATTTG CATACACATC  5350
GTCTTTAATG TCACTTTTAT AACTTTTTA CGGTTCAGAT ATTCATCTAT   5400
ACGTCTGTAC AGAAAAAAAA AAGCTGCTAT TTTTTTGTT CTTGATCTTT   5450
GTGGATTTAA TCTATGAAAA CCTTCAGGTC CACCCTCTCC CCTTTCTGCT  5500
CACTCCAAGA AACTTCTTAT GCTTTGTACT AGAGTGCGTG ACTTCTTCC   5550
TCTTTTCCCG GTAATGGATA CTTCTATCAC ATAATTTGCC ATGAACTGTT  5600
GGATGCCTTT TTATAAATAC ATCCCCCATC CCTGCTCCCA CCTGCCCCTT  5650
TAGTTGTTTT CTAACCCGTA GGCTCTCTGG GCACGAGGCA GAAAGCAGGC  5700
CGGGCACCCA TCCTGAGAGG GCCGCGCTCC TCTCCCCAGC CTGCCCTCAC  5750
AGCATTGGAG CCTGTTACAG TGCAAGACAT GATACAAACT CAGGTCAGAA  5800
AAACAAAGGT TAAATATTTC ACACGTCTTT GTTCAGTGTT CCACTCACC   5850
GTGGTTGAGA AGCCTCACCC TCTCTTTCCC TTGCCTTTGC TTAGGTTGTG  5900
ACACACATAT ATATATATTT TTTTAATTCT TGGGTACAAC AGCAGTGTTA  5950
ACCGCAGACA CTAGGCATTT GGATTACTAT TTTTCTTAAT GGCTATTTAA  6000
TCCTTCCATC CCACGAAAAA CAGCTGCTGA GTCCAAGGGA GCAGCAGAGC  6050
GTGGTCCGGC AGGGCCTGTT GTGGCCCTCG CCACCCCCCT CACCGGACCG  6100
ACTGACCTGT CTTTGGAACC AGAACATCCC AAGGGAACTC CTTCGCACTG  6150
GCGTTGAGTG GGACCCCGGG ATCCAGGCTG GCCCAGGGCG GCACCCTCAG  6200
GGCTGTGCCC GCTGGAGTGC TAGGTGGAGG CAGCACAGAC GCCACGGTGG  6250
CCCAAGAGCC CCTTTGCTTC TTGCTGGGGG ACCAGGGCTG TGGTGCTGGC  6300
CCACTTTCCC TCGGCCAGGA ATCCAGGTCC TTGGGGCCCA GGGGTCTTGT  6350
CTTGTTTCAT TTTTAGCACT TCTCACCAGA GAGATGACAG CACAAGAGTT  6400
GCTTCTGGGA TAGAAATGTT TAGGAGTAAG AACAAAGCTG GGATACGGTG  6450
ATTGCTAGTT GTGACTGAAG ATTCAACACA GAAAAGAAAG TTTATACGGC  6500
TTTTTTGCTG GTCAGCAGTT TGTCCCACTG CTTTCTCTAG TCTCTATCCC  6550
ATAGCGTGTT CCCTTTAAAA AAAAAAAAAA GGTATTATAT GTAGGAGTTT  6600
TCTTTTAATT TATTTGTGA TAAATTACCA GTTCAATCA CTGTAGAAAA    6650
GCCCCATTAT GAATTTAAAT TTCAAGGAAA GGGTGTGTGT GTGTGTATGT  6700
GTGGGGTGTG TGTGTGTGAG AGTGATGGGA CAGTTCTTGA TTTTTTGGGT  6750
TTTTTTCCC CCAAACATTT ATCTACCTCA CTCTTATTTT TTATATGTGT   6800
ATATAGACAA AAGAATACAT CTCACCTTTC TCAGCACCTG ACAATAGGCC  6850
GTTGATACTG GTAACCTCAT CCACGCCACA GGCGCCACAC CCAGGTGATG  6900
CAGGGGGAAG CCAGGCTGTA TTCCGGGGTC AAAGCAACAC TAACTCACCT  6950
CTCTGCTCAT TTCAGACAGC TTGCCTTTTT CTGAGATGTC CTGTTTTGTG  7000
TTGCTTTTTT TGTTTTGTTT CTATCTTGG TTTCCACCAA GGTGTTAGAT   7050
TTCTCCTCCT CCTAGCCAGG TGGCCCTGTG AGGCCAACGA GGGCACCAGA  7100
GCACACCTGG GGGAGCCACC AGGCTGTCCC TGGCTGGTTG TCTTTGGAAC  7150
AAACTGCTTC TGTGCAGATG GAATGACCAA CACATTTCGT CCTTAAGAGA  7200
GCAGTGGTTC CTCAGGTTCT GAGGAGAGGA AGGTGTCCAG GCAGCACCAT  7250
CTCTGTGCGA ATCCCCAGGG TAAAGGCGTG GGGCATTGGG TTTGCTCCCC  7300
TTGCTGCTGC TCCATCCCTG CAGGAGGCTC GCGCTGAGGC AGGACCGTGC  7350
GGCCATGGCT GCTGCATTCA TTGAGCACAA AGGTGCAGCT GCAGCAGCAG  7400
CTGGAGAGCA AGAGTCACCC AGCCTGTGCG CCAGAATGCA GAGGCTCCTG  7450
ACCTCACAGC CAGTCCCTGA TAGAACACAC GCAGGAGCAG AGTCCCTCC   7500
CCCTCCAGGC TGCCCTCTCA ACTTCTCCCT CACCTCCTTC CCTAGGGGTA  7550
GACAGAGATG TACCAAACCT TCCGGCTGGA AAGCCCAGTG GCCGGCGCCG  7600
AGGCTCGTGG CGTCACGCCC CCCCGCCAG GGCTGTACCT CCGTCTCCCT   7650
```

FIG. 37D

```
GGTCCTGCTG CTCACAGGAC AGACGGCTCG CTCCCCTCTT CCAGCAGCTG 7700
CTCTTACAGG CACTGATGAT TTCGCTGGGA AGTGTGGCGG GCAGCTTTGC 7750
CTAAGCGTGG ATGGCTCCTC GGCAATTCCA GCCTAAGTGA AGGCGCTCAG 7800
GAGCCTCCTG CTGGAACGCG ACCCATCTCT CCCAGGACCC CGGGGATCTT 7850
AAGGTCATTG AGAAATACTG TTGGATCAGG GTTTTGTTCT TCCACACTGT 7900
AGGTGACCCC TTGGAATAAC GGCCTCTCCT CTCGTGCACA TACCTACCGG 7950
TTTCCACAAC TGGATTTCTA CAGATCATTC AGCTGGTTAT AAGGGTTTTG 8000
TTTAAACTGT CCGAGTTACT GATGTCATTT TGTTTTGTT TTATGTAGGT 8050
AGCTTTTAAG TAGAAAACAC TAACAGTGTA GTGCCCATCA TAGCAAATGC 8100
TTCAGAAACA CCTCAATAAA AGAGAAAACT TGGCTTGTGT GATGGTGCAG 8150
TCACTTTACT GGACCAACCC ACCCACCTTG ACTATACCAA GGCATCATCT 8200
ATCCACAGTT CTAGCCTAAC TTCATGCTGA TTTCTCTGCC TCTTGATTTT 8250
TCTCTGTGTG TTCCAAATAA TCTTAAGCTG AGTTGTGGCA TTTTCCATGC 8300
AACCTCCTTC TGCCAGCAGC TCACACTGCT TGAAGTCATA TGAACCACTG 8350
AGGCACATCA TGGAATTGAT GTGAGCATTA AGACGTTCTC CCACACAGCC 8400
CTTCCCTGAG GCAGCAGGAG CTGGTGTGTA CTGGAGACAC TGTTGAACTT 8450
GATCAAGACC CAGACCACCC CAGGTCTCCT TCGTGGGATG TCATGACGTT 8500
TGACATACCT TTGGAACGAG CCTCCTCCTT GGAAGATGGA AGACCGTGTT 8550
CGTGGCCGAC CTGGCCTCTC CTGGCCTGTT TCTTAAGATG CGGAGTCACA 8600
TTTCAATGGT ACGAAAAGTG GCTTCGTAAA ATAGAAGAGC AGTCACTGTG 8650
GAACTACCAA ATGGCGAGAT GCTCGGTGCA CATTGGGGTG CTTTGGGATA 8700
AAAGATTTAT GAGCCAACTA TTCTCTGGCA CCAGATTCTA GGCCAGTTTG 8750
TTCCACTGAA GCTTTTCCCA CAGCAGTCCA CCTCTGCAGG CTGGCAGCCG 8800
AATGGCTTGC CAGTGGCTCT GTGGCAAGAT CACACTGAGA TCGATGGGTG 8850
AGAAGGCTAG GATGCTTGTC TAGTGTTCTT AGCTGTCACG TTGGCTCCTT 8900
CCAGGGTGGC CAGACGGTGT TGGCCACTCC CTTCTAAAAC ACAGGCGCCC 8950
TCCTGGTGAC AGTGACCCGC CGTGGTATGC CTTGGCCCAT TCCAGCAGTC 9000
CCAGTTATGC ATTTCAAGTT TGGGGTTTGT TCTTTTCGTT AATGTTCCTC 9050
TGTGTTGTCA GCTGTCTTCA TTTCCTGGGC TAAGCAGCAT TGGGAGATGT 9100
GGACCAGAGA TCCACTCCTT AAGAACCAGT GGCGAAAGAC ACTTTCTTTC 9150
TTCACTCTGA AGTAGCTGGT GGTACAAATG AGAACTTCAA GAGAGGATGT 9200
TATTTAGACT GAACCTCTGT TGCCAGAGAT GCTGAAGATA CAGACCTTGG 9250
ACAGGTCAGA GGGTTTCATT TTTGGCCTTC ATCTTAGATG ACTGGTTGCG 9300
TCATTTGGAG AAGTGAGTGC TCCTTGATGG TGGAATGACC GGGTGGTGGG 9350
TACAGAACCA TTGTCACAGG GATCCTGGCA CAGAGAAGAG TTACGAGCAG 9400
CAGGGTGCAG GGCTTGGAAG GAATGTGGGC AAGGTTTTGA ACTTGATTGT 9450
TCTTGAAGCT ATCAGACCAC ATCGAGGCTC AGCAGTCATC CGTGGGCATT 9500
TGGTTTCAAC AAAGAAACCT AACATCCTAC TCTGGAAACT GATCTCGGAG 9550
TTAAGGCGAA TTGTTCAAGA ACACAAACTA CATCGCACTC GTCAGTTGTC 9600
AGTTCTGGGG CATGACTTTA GCGTTTTGTT TCTGCGAGAA CATAACGATC 9650
ACTCATTTTT ATGTCCCACG TGTGTGTGTC CGCATCTTTC TGGTCAACAT 9700
TGTTTTAACT AGTCACTCAT TAGCGTTTTC AATAGGGCTC TTAAGTCCAG 9750
TAGATTACGG GTAGTCAGTT GACGAAGATC TGGTTTACAA GAACTAATTA 9800
AATGTTTCAT TGCATTTTTG TAAGAACAGA ATAATTTAT AAAATGTTTG 9850
TAGTTTATAA TTGCCGAAAA TAATTTAAAG ACACTTTTT TTTCTCTGTG 9900
TGTGCAAATG TGTGTTTGTG ATCCATTTTT TTTTTTTTT TTAGGACAC 9950
CTGTTTACTA GCTAGCTTTA CAATATGCCA AAAAGGATT TCTCCCTGAC 10000
CCCATCCGTG GTTCACCCTC TTTTCCCCCC ATGCTTTTG CCCTAGTTTA 10050
TAACAAAGGA ATGATGATGA TTTAAAAGT AGTTCTGTAT CTTCAGTATC 10100
TTGGTCTTCC AGAACCCTCT GGTTGGGAAG GGGATCATTT TTACTGGTC 10150
ATTTCCCTTT GGAGTGTAGC TACTTTAACA GATGGAAAGA ACCTCATTGG 10200
```

FIG. 37E

```
CCATGGAAAC AGCCGAGGTG TTGGAGCCCA GCAGTGCATG GCACCGTTCG  10250
GCATCTGGCT TGATTGGTCT GGCTGCCGTC ATTGTCAGCA CAGTGCCATG  10300
GACATGGGAA GACTTGACTG CACAGCCAAT GGTTTTCATG ATGATTACAG  10350
CATACACAGT GATCACATAA ACGATGACAG CTATGGGGCA CACAGGCCAT  10400
TTGCTTACAT GCCTCGTATC ATGACTGATT ACTGCTTTGT TAGAACACAG  10450
AAGAGACCCT ATTTTATTTA AGGCAGAACC CCGAAGATAC GTATTCCAA   10500
TACAGAAAAG AATTTTTAAT AAAAACTATA ACATACACAA AAATTGGTTT  10550
TAAAGTTGAC TCCACTTCCT CTAACTCCAG TGGATTGTTG GCCATGTCTC  10600
CCCAACTCCA CAATATCTCT ATCATGGGAA ACACCTGGGG TTTTTGCGCT  10650
ACATAGGAGA AAGATCTGGA AACTATTTGG GTTTTGTTTT CAACTTTTCA  10700
TTTGGATGTT TGGCGTTGCA CACACACATC CACCGGTGGA AGAGACGCCC  10750
GGTGAAAACA CCTGTCTGCT TTCTAAGCCA GTGAGGTTGA GGTGAGAGGT  10800
TTGCCAGAGT TTGTCTACCT CTGGGTATCC CTTTGTCTGG GATAAAAAAA  10850
ATCAAACCAG AAGGCGGGAT GGAATGGATG CACCGCAAAT AATGCATTTT  10900
CTGAGTTTTC TTGTTAAAAA AAAATTTTTT TAAGTAAGAA AAAAAAGGT   10950
AATAACATGG CCAATTTGTT ACATAAAATG ACTTCTGTG  TATAAATTAT  11000
TCCTAAAAAA TCCTGTTTAT ATAAAAAATC AGTAGATGAA AAAAATTTCA  11050
AAATGTTTTT GTATATTCTG TTGTAAGAAT TTATTCCTGT TATTGCGATA  11100
TACTCTGGAT TCTTTACATA ATGGAAAAAA GAAACTGTCT ATTTTGAATG  11150
GCTGAAGCTA AGGCAACGTT AGTTTCTCTT ACTCTGCTTT TTTCTAGTAA  11200
AGTACTACAT GGTTTAAGTT AAATAAAATA ATTCTGTATG CA
(SEQ ID NO: 37)
```

FIG. 38

```
MKSGSGGGSPTSLWGLLFLSAALSLWPTSGEICGPGIDIRNDYQQLKRLENCTVIEGYLH
ILLISKAEDYRSYRFPKLTVITEYLLLFRVAGLESLGDLFPNLTVIRGWKLFYNYALVIF
EMTNLKDIGLYNLRNITRGAIRIEKNADLCYLSTVDWSLILDAVSNNYIVGNKPPKECGD
LCPGTMEEKPMCEKTTINNEYNYRCWTTNRCQKMCPSTCGKRACTENNECCHPECLGSCS
APDNDTACVACRHYYYAGVCVPACPPNTYRFEGWRCVDRDFCANILSAESSDSEGFVIHD
GECMQECPSGFIRNGSQSMYCIPCEGPCPKVCEEEKKTKTIDSVTSAQMLQGCTIFKGNL
LINIRRGNNIASELENFMGLIEVVTGYVKIRHSHALVSLSFLKNLRLILGEEQLEGNYSF
YVLDNQNLQQLWDWDHRNLTIKAGKMYFAFNPKLCVSEIYRMEEVTGTKGRQSKGDINTR
NNGERASCESDVLHFTSTTTSKNRIIITWHRYRPPDYRDLISFTVYYKEAPFKNVTEYDG
QDACGSNSWNMVDVDLPPNKDVEPGILLHGLKPWTQYAVYVKAVTLTMVENDHIRGAKSE
ILYIRTNASVPSIPLDVLSASNSSSQLIVKWNPPSLPNGNLSYYIVRWQRQPQDGYLYRH
NYCSKDKIPIRKYADGTIDIEEVTENPKTEVCGGEKGPCCACPKTEAEKQAEKEEAEYRK
VFENFLHNSIFVPRPERKRRDVMQVANTTMSSRSRNTTAADTYNITDPEELETEYPFFES
RVDNKERTVISNLRPFTLYRIDIHSCNHEAEKLGCSASNFVFARTMPAEGADDIPGPVTW
EPRPENSIFLKWPEPENPNGLILMYEIKYGSQVEDQRECVSRQEYRKYGGAKLNRLNPGN
YTARIQATSLSGNGSWTDPVFFYVQAKTGYENFIHLIIALPVAVLLIVGGLVIMLYVFHR
KRNNSRLGNGVLYASVNPEYFSAADVYVPDEWEVAREKITMSRELGQGSFGMVYEGVAKG
VVKDEPETRVAIKTVNEAASMRERIEFLNEASVMKEFNCHHVVRLLGVVSQGQPTLVIME
LMTRGDLKSYLRSLRPEMENNPVLAPPSLSKMIQMAGEIADGMAYLNANKFVHRDLAARN
CMVAEDFTVKIGDFGMTRDIYETDYYRKGGKGLLPVRWMSPESLKDGVFTTYSDVWSFGV
VLWEIATLAEQPYQGLSNEQVLRFVMEGGLLDKPDNCPDMLFELMRMCWQYNPKMRPSFL
EIISSIKEEMEPGFREVSFYYSEENKLPEPEELDLEPENMESVPLDPSASSSSLPLPDRH
SGHKAENGPGPGVLVLRASFDERQPYAHMNGGRKNERALPLPQSSTC-
(SEQ ID NO: 38)
```

FIG. 39A

```
CCCGCCTAGC ATGGTGCGGC GGCCGCGCGC GCGGACATGG GGGAGAAGCT   50
GGAGCTGAGA CTGAAGTCGC CCGTGGGGGC TGAGCCCGCC GTCTACCCGT  100
GGCCGCTGCC GGTCTACGAT AAACATCACG ATGCTGCTCA TGAAATCATC  150
GAGACCATCC GATGGGTCTG TGAAGAAATC CCGGATCTCA AGCTCGCTAT  200
GGAGAATTAC GTTTTAATTG ACTATGACAC CAAAAGCTTC GAGAGCATGC  250
AGAGGCTCTG CGACAAGTAC AACCGTGCCA TCGACAGCAT CCACCAGCTG  300
TGGAAGGGCA CCACGCAGCC CATGAAGCTG AACACGCGGC CGTCCACTGG  350
ACTCCTGCGC CATATCCTGC AGCAGGTCTA CAACCACTCG GTGACCGACC  400
CCGAGAAGCT CAACAACTAC GAGCCCTTCT CCCCCGAGGT GTACGGGGAG  450
ACCTCCTTCG ACCTGGTGGC CCAGATGATT GATGAGATCA AGATGACCGA  500
CGACGACCTG TTTGTGGACT TGGGGAGCGG TGTGGGCCAG GTCGTGCTCC  550
AGGTTGCTGC TGCCACCAAC TGCAAACATC ACTATGGCGT CGAGAAAGCA  600
GACATCCCGG CCAAGTATGC GGAGACCATG GACCGCGAGT TCAGGAAGTG  650
GATGAAATGG TATGGAAAAA AGCATGCAGA ATACACATTG GAGAGAGGCG  700
ATTTCCTCTC AGAAGAGTGG AGGGAGCGAA TCGCCAACAC GAGTGTTATA  750
TTTGTGAATA ATTTTGCCTT TGGTCCTGAG GTGGATCACC AGCTGAAGGA  800
GCGGTTTGCA AACATGAAGG AAGGTGGCAG AATCGTGTCC TCGAAACCCT  850
TTGCACCTCT GAACTTCAGA ATAAACAGTA GAAACTTGAG TGACATCGGC  900
ACCATCATGC GCGTGGTGGA GCTCTCGCCC CTGAAGGGCT CGGTGTCGTG  950
GACGGGGAAG CCAGTCTCCT ACTACCTGCA CACTATCGAC CGCACCATAC 1000
TTGAAAACTA TTTTCTAGT CTGAAAAACC CAAAACTCAG GGAGGAACAG 1050
GAGGCAGCCC GGCGCCGCCA GCAGCGCGAG AGCAAGAGCA ACGCGGCCAC 1100
GCCCACTAAG GGCCCAGAGG GCAAGGTGGC CGGCCCCGCC GACGCCCCA  1150
TGGACTCTGG TGCTGAGGAA GAGAAGGCGG GAGCAGCCAC CGTGAAGAAG 1200
CCGTCTCCCT CCAAAGCCCG CAAGAAGAAG CTAAACAAGA AGGGGAGGAA 1250
GATGGCTGGC CGCAAGCGCG GCGCCCCAA GAAGATGAAC ACTGCGAACC  1300
CCGAGCGGAA GCCCAAGAAG AACCAAACTG CACTGGATGC CCTGCACGCT 1350
CAGACCGTGT CTCAGACGGC GGCCTCCTCA CCCCAGGATG CCTACAGATC 1400
CCCTCACAGC CCGTTCTACC AGCTACCTCC GAGCGTGCAG CGGCACTCCC 1450
CCAACCCGCT GCTGGTGGCG CCCACCCCGC CCGCGCTGCA GAAGCTTCTA 1500
GAGTCCTTCA AGATCCAGTA CCTGCAGTTC CTGGCATACA CAAAGACCCC 1550
CCAGTACAAG GCCAGCCTGC AGGAGCTGCT GGGCCAGGAG AAGGAGAAGA 1600
ACGCCCAGCT CCTGGGTGCG GCTCAGCAGC TCCTCAGCCA CTGCCAGGCC 1650
CAGAAGGAGG AGATCAGGAG GCTGTTTCAG CAAAAATTGG ATGAGCTGGG 1700
TGTGAAGGCG CTGACCTACA ACGACCTGAT TCAAGCGCAG AAGGAGATCT 1750
CCGCCCATAA CCAGCAGCTG CGGGAGCAGT CGGAGCAGCT GGAGCAGGAC 1800
AACCGCGCGC TCCGCGGCCA GAGCTTGCAG CTGCTCAAGG CTCGCTGCGA 1850
GGAGCTGCAG CTGGACTGGG CCACGCTGTC GCTGGAGAAG CTGTTGAAGG 1900
AGAAGCAGGC CCTGAAGAGC CAGATCTCGG AGAAGCAGAG GCACTGCCTG 1950
GAGCTGCAGA TCAGCATTGT GGAGCTAGAG AAGAGCCAGC GGCAGCAGGA 2000
GCTCCTGCAG CTCAAGTCCT GTGTGCCGCC TGACGACGCC CTGTCCCTGC 2050
ACCTGCGTGG GAAGGGCGCC CTGGGCCGCG AGCTGGAGCC TGACGCCAGC 2100
CGGCTGCACC TGGAGCTGGA CTGCACCAAG TTCTCGCTGC CTCACTTGAG 2150
CAGCATGAGC CCGGAGCTCT CCATGAACGG CCAGGCTGCT GGCTATGAGC 2200
TCTGCGGTGT GCTGAGCCGG CCTTCGTCGA AGCAGAACAC GCCCCAGTAC 2250
CTGGCCTCAC CCCTGGACCA GGAGGTGGTG CCCTGTACCC CTAGCCACGT 2300
CGGCCGGCCG CGCCTGGAGA AGCTGTCTGG CCTAGCCGCA CCCGACTACA 2350
CTAGGCTGTC CCCGGCCAAG ATTGTGCTGA GGCGGCACCT GAGCCAGGAC 2400
CACACGGTGC CCGGCAGGCC GGCTGCCAGT GAGCTGCATT CGAGAGCTGA 2450
GCACACCAAG GAGAACGGCC TTCCCTACCA GAGCCCCAGC GTGCCTGGCA 2500
GCATGAAGCT GAGCCCTCAG GACCCGCGGC CCCTGTCCCC TGGGGCCTTG 2550
```

FIG. 39B

```
CAGCTTGCTG GAGAGAAGAG CAGTGAGAAG GGCCTGAGAG AGCGCGCCTA  2600
CGGCAGCAGC GGGGAGCTCA TCACCAGCCT GCCCATCAGC ATCCCGCTCA  2650
GCACCGTGCA GCCCAACAAG CTCCCGGTCA GCATTCCCCT GGCCAGCGTG  2700
GTGCTGCCCA GCCGCGCCGA GAGGGCGAGG AGCACCCCCA GTCCCGTGCT  2750
GCAGCCCCGT GACCCCTCGT CCACACTTGA AAAGCAGATT GGTGCTAATG  2800
CCCACGGTGC TGGGAGCAGA AGCCTTGCCC TGGCCCCCGC AGGCTTCTCC  2850
TACGCTGGCT CGGTGGCCAT CAGCGGGGCC TTGGCGGGCA GCCCGGCCTC  2900
TCTCACACCT GGAGCCGAGC CGGCCACCTT GGATGAGTCC TCCAGCTCTG  2950
GGAGCCTTTT TGCCACCGTG GGGTCCCGCA GCTCCACGCC ACAGCACCCC  3000
CTGCTGCTGG CACAGCCCCG GAACTCGCTT CCTGCCTCTC CCGCCCACCA  3050
GCTCTCCTCC AGTCCCCGGC TTGGTGGGGC CGCCCAGGGC CCGTTGCCCG  3100
AGGCCAGCAA GGGAGACCTG CCCTCCGATT CCGGCTTCTC AGATCCTGAG  3150
AGTGAAGCCA AGAGGAGGAT TGTGTTCACC ATCACCACTG GTGCGGGCAG  3200
TGCCAAGCAG TCGCCCTCCA GCAAGCACAG CCCCCTGACC GCCAGCGCCC  3250
GTGGGGACTG TGTGCCGAGC CACGGGCAGG ACAGTCGCAG GCGCGGCCGG  3300
CGGAAGCGAG CATCTGCGGG GACGCCCAGC TTGAGCGCAG GCGTGTCCCC  3350
CAAGCGCCGA GCCCTGCCGT CCGTCGCTGG CCTTTTCACA CAGCCTTCGG  3400
GGTCTCCCCT CAACCTCAAC TCCATGGTCA GTAACATCAA CCAGCCCCTG  3450
GAGATTACAG CCATCTCGTC CCCGGAGACC TCCCTGAAGA GCTCCCTGT   3500
GCCCTACCAG GACCACGACC AGCCCCCCGT GCTCAAGAAG GAGCGGCCTC  3550
TGAGCCAGAC CAATGGGCA  CACTACTCCC CACTCACCTC AGACGAGGAG  3600
CCAGGCTCTG AGGACGAGCC CAGCAGTGCT CGAATTGAGA GAAAAATTGC  3650
AACAATCTCC TTAGAAAGCA AATCTCCCCC GAAAACCTTG GAAAATGGTG  3700
GTGGCTTGGC GGGAAGGAAG CCCGCGCCCG CCGGCGAGCC AGTCAATAGC  3750
AGCAAGTGGA AGTCCACCTT CTCGCCCATC TCCGACATCG GCCTGGCCAA  3800
GTCGGCGGAC AGCCCGCTGC AGGCCAGCTC CGCCCTCAGC CAGAACTCCC  3850
TGTTCACGTT CCGGCCCGCC CTGGAGGAGC CCTCTGCCGA TGCCAAGCTG  3900
GCCGCTCACC CCAGGAAAGG CTTTCCCGGC TCCCTGTCGG GGGCTGACGG  3950
ACTCAGCCCG GGCACCAACC CTGCCAACGG CTGCACCTTC GGCGGGGGCC  4000
TGGCCGCGGA CCTGAGTTTA CACAGCTTCA GTGATGGTGC TTCTCTTCCC  4050
CACAAGGGCC CCGAGGCGGC CGGCCTGAGC TCCCCGCTGA GCTTCCCCTC  4100
GCAGCGCGGC AAGGAGGGCT CGGACGCCAA CCCTTTCCTG AGCAAGAGGC  4150
AGCTGGACGG CCTGGCTGGG CTGAAGGGCG AGGGCAGCCG CGGCAAGGAG  4200
GCAGGGGAGG GCGGCCTACC GCTGTGCGGG CCCACGGACA AGACCCCACT  4250
GCTGAGCGGC AAGGCCGCCA AGGCCCGGGA CCGCGAGGTC GACCTCAAGA  4300
ATGGCCACAA CCTCTTCATC TCTGCGGCGG CCGTGCCTCC CGGAAGCCTC  4350
CTCAGCGGCC CCGGCCTGGC CCCGGCGGCG TCCTCCGCAG GCGGCGCGGC  4400
GTCCTCCGCC CAGACGCACC GGTCCTTCCT GGGCCCCTTC CCGCCGGGAC  4450
CGCAGTTCGC GCTCGGCCCC ATGTCCCTGC AGGCCAACCT CGGCTCCGTG  4500
GCCGGCTCCT CCGTGCTGCA GTCGCTGTTC AGCTCTGTGC CGGCCGCCGC  4550
AGGCCTGGTG CACGTGTCGT CCGCTGCCAC CAGACTGACC AACTCGCACG  4600
CCATGGGCAG CTTTTCCGGG GTGGCAGGCG GCACAGTTGG AGGTAACTAG  4650
GATTTCTACC TCAACCGCGA GACCTATGCA AGGACGGTGT GGACCAACTC  4700
GCGCCCGCGG CATGGTGCCC GCCGGCCTGC CGGGCTCCCA CCCTGGACG   4750
GCAGAGGCAA GGACGGACGG GAGCTCCACT GTGAATCGGC GGCACGCGCC  4800
GCAGGAGGCT GGGACTGGTC CAGTTTGTAC TGTCGATAGT TTTAGATAAA  4850
GTATTTATCA TTTTTAAAA  AGTATAAACA ATTCTGACTT ATTTTATTCC  4900
ATCTAAGTGG TAAAAGGCAA CTTATTGAGA AATATAAATA TCTATATATG  4950
AGAGCTCTAT ATAAAGACAC GTGTCTGCAG GGCGGGCCCG CCAGCGGATT  5000
CGCCACAGCC TGCCCCGGTG CTATCTCGTC CCCAGGCCCG CGCCTGCCTC  5050
CACCCGCTTG GTGCTGACTA GACGCTGACA ACGCCGAACC CCGTTCTCGG  5100
```

FIG. 39C

```
AAACGCCGCC CGGCCGGCTC CCCCGACGCG CTGCTCCCGT ACCAAAGGCA  5150
GGCCCGTCGC CACCACATTC CTCGGAGGCC TCCCCGCGGC CTGAGCCCCT  5200
TCCTGAGCGC CCTGGCGCCT GCCCTGAGCT CTTCACCTTT ACCCCGGCAC  5250
TGTGAACCCC CAGACTGTTC ACCCTCCGGG GCGTGGGTTG CGCCCTTGCA  5300
TGTGAAGGGG CCTGCGCGGT GACGCAGCTG GCCATGTGCT GCGCGATGGT  5350
GCTGTGAGGA CGGCGCGGGC ACGTTAACAA AGTGCATTTA CTTTTGTATT  5400
TCTCGGCTGT CCATGGCTCG CAGCATGCCC TGCGATGCGG GGCAGGCCTG  5450
TCGTGGGTCC CTTGGTGTTT CTGTACAGGA GAGAGTCACA CTAATGAGTG  5500
GCAGTATTTT ATAGAGATGT GATGAGAATT TATAAATTTC ATAGATTTGA  5550
CAGCTTTTAT TTTTAGATGG TATAATGCAC AGTGAAGAGG AAAGAAAAGC  5600
GAGGGGAAAA AACCTTATTT ATTCAAACAG TGCACAAAAT GGCCCCAGCG  5650
TCAGCCCCGA CCCTAGACCC CTCAGTTGCA GCTCCCAGCA GCCCAGACAG  5700
AGCTGCCGGC GCCCCTGCCT GCCCCACATC CCTTCCTGTC AGGGCCACGC  5750
CTGGCACCCA TCCCTTGGAG CCTGTGCTGG TTCTCCCAGC TGCTGTGGGT  5800
GTGCTGGGGC CAGGGTGCAC TGCTGAAACC TGGCCTCTCT GGCCCTAGGC  5850
CCCAGGGTGA CGTCGGCCCC CCACTCTGCA GCCTTGGCGG GTGCCTGGGA  5900
CTGGGTGTGG AAGGAGAGGA GCTGAGGCCG GGGTGTAGCA GGCAGGCAGG  5950
GCCACTCCAG TGCTTCTGGA GCCCTGAGCA GTCAGGGCCT GGGTTGTCTG  6000
AGCAGTGGTG GCTCTGTGCC CTCCCTGGAG GATGGGATCT GGGAGTCTGA  6050
GCTCCCCGCA TCTGGCCCTG GGCTGTGTGG CACTTGCTGA GCCCACCTTC  6100
TCAAGTGCTT GCTCCTGTGA GATGGCATCG GGGAGCCCCT TCCCCAAGGT  6150
GCCACAGATC CACCCTCCAG GGAGCTGCCA GCCCTGTGTT CTGGTTCCCA  6200
AGGGCAGGAT GGACACACGT CACATCCCTA CCACGTGGCC TCCAAAGGGA  6250
GCCACGGAGG AAAGGCTTCT GTGGTTGCTA GGTGGGGGAG TCCTGTGTGG  6300
GAGGGCCTGA AGACCCCTGC TTGTGCCTGG TGAGGGGGT GCTGCCTCCC  6350
CCAGCCCCCA ACAACCTCTC AGACCCCCAC CCTCCAACAT AGCTGAGTTC  6400
TGAAGATGGT GCTCCGGACC TGTCCTCTTA AGTGGTGCCC AGTGCCTCC  6450
CCACCCCACG TTGGTGCTCT CAGCTAGAAG GTGCTGTGCC TCTGCCTGAG  6500
CCCCAAGCCC CGAGCCTGGC CTTCAGGACA GGCAGCCTGC TCTGTGTCGC  6550
CACGGGCCGG ATACGCCACA GGGTTGATGG CAGAGACGGC CGAGTCCCTG  6600
GTCTAGAACA AGACACATTC TTTAAACACT GTATTACTTC TGCCTCCCTC  6650
TAGGTGACAG TGGCAGTCCG GGTGCCATCA CGGGTCCTGC AGATGGCCAT  6700
GCAGGGCTCC TGCCCACGCA GGCCACCGTA TGTTCAGGAC ACGCACTGGG  6750
TCTCAGAGCC ACTGGCCCAG GCAGAAGTCT CCTTGAGCCC ACTGGGTCAT  6800
ATGCGTGTCA CCACACGTGA ACTAGTGTGG TGGCTGCCTG CGGACACCCT  6850
CCTGTTCTGA GCCCTGGGCC TGTGTTCTTC TCAGACACTC CCAGACTGAG  6900
GGGTGGTGTG TGGCGGGTGG CAGGGTGGCT GTGGAGACTG GGATCTGGA  6950
GCCTGGTGCT GGCACCTGGC CTGAGTTTCC GTGGGCAGCT GGCGGGGACC  7000
TGTGCTGCTG CTGCTGACTG TGGGTGGGCG GGCGGCGCCT GGGAGTGGCT  7050
CTTGCTCAGG AATTGATAGG AACCCTAAAA ACTAGGATAC CCCTCCTCG  7100
GCCCATGAGG CACGCACAGT GACTTATTTA AGACTTCCCC CTTAATTTAT  7150
CTGCCCCCAG GATGCGTCAG TCTGTTCAGT GGTCAGCAGG CCCCCCACCC  7200
CCCGCCGACT GCCCTCGCCA TCGTGGTCAG ACCCCCCTCC CAACACAACA  7250
CGCTGCTGGT CTGTGTCAGC CTTTGTAACG TGGGAGGCTC TGCCGTGTCT  7300
TCCGGGTGAA CTGTATTTGG ATTGCGCGCA TTGTCACGGT CCGCCCCTGG  7350
GCTGCAGGCG CCCCTTCCTC TGGGCACCCC TGCATTCTGC ATCCCCACCT  7400
CTAGACGCTG TAATAAACAG ACTGTTTTCA CTCGGAaaaa aaaaaaaaa  7450
aaaaa (SEQ ID NO: 39)
```

FIG. 40

```
MGEKLELRLKSPVGAEPAVYPWPLPVYDKHHDAAHEIIETIRWVCEEIPDLKLAMENYVL
IDYDTKSFESMQRLCDKYNRAIDSIHQLWKGTTQPMKLNTRPSTGLLRHILQQVYNHSVT
DPEKLNNYEPFSPEVYGETSFDLVAQMIDEIKMTDDDLFVDLGSGVGQVVLQVAAATNCK
HHYGVEKADIPAKYAETMDREFRKWMKWYGKKHAEYTLERGDFLSEEWRERIANTSVIFV
NNFAFGPEVDHQLKERFANMKEGGRIVSSKPFAPLNFRINSRNLSDIGTIMRVVELSPLK
GSVSWTGKPVSYYLHTIDRTILENYFSSLKNPKLREEQEAARRQQRESKSNAATPTKGP
EGKVAGPADAPMDSGAEEEKAGAATVKKPSPSKARKKKLNKKGRKMAGRKRGRPKKMNTA
NPERKPKKNQTALDALHAQTVSQTAASSPQDAYRSPHSPFYQLPPSVQRHSPNPLLVAPT
PPALQKLLESFKIQYLQFLAYTKTPQYKASLQELLGQEKEKNAQLLGAAQQLLSHCQAQK
EEIRRLFQQKLDELGVKALTYNDLIQAQKEISAHNQQLREQSEQLEQDNRALRGQSLQLL
KARCEELQLDWATLSLEKLLKEKQALKSQISEKQRHCLELQISIVELEKSQRQQELLQLK
SCVPPDDALSLHLRGKGALGRELEPDASRLHLELDCTKFSLPHLSSMSPELSMNGQAAGY
ELCGVLSRPSSKQNTPQYLASPLDQEVVPCTPSHVGRPRLEKLSGLAAPDYTRLSPAKIV
LRRHLSQDHTVPGRPAASELHSRAEHTKENGLPYQSPSVPGSMKLSPQDPRPLSPGALQL
AGEKSSEKGLRERAYGSSGELITSLPISIPLSTVQPNKLPVSIPLASVVLPSRAERARST
PSPVLQPRDPSSTLEKQIGANAHGAGSRSLALAPAGFSYAGSVAISGALAGSPASLTPGA
EPATLDESSSSGSLFATVGSRSSTPQHPLLLAQPRNSLPASPAHQLSSSPRLGGAAQGPL
PEASKGDLPSDSGFSDPESEAKRRIVFTITTGAGSAKQSPSSKHSPLTASARGDCVPSHG
QDSRRRGRRKRASAGTPSLSAGVSPKRRALPSVAGLFTQPSGSPLNLNSMVSNINQPLEI
TAISSPETSLKSSPVPYQDHDQPPVLKKERPLSQTNGAHYSPLTSDEEPGSEDEPSSARI
ERKIATISLESKSPPKTLENGGGLAGRKPAPAGEPVNSSKWKSTFSPISDIGLAKSADSP
LQASSALSQNSLFTFRPALEEPSADAKLAAHPRKGFPGSLSGADGLSPGTNPANGCTFGG
GLAADLSLHSFSDGASLPHKGPEAAGLSSPLSFPSQRGKEGSDANPFLSKRQLDGLAGLK
GEGSRGKEAGEGGLPLCGPTDKTPLLSGKAAKARDREVDLKNGHNLFISAAAVPPGSLLS
GPGLAPAASSAGGAASSAQTHRSFLGPFPPGPQFALGPMSLQANLGSVAGSSVLQSLFSS
VPAAAGLVHVSSAATRLTNSHAMGSFSGVAGGTVGGN- (SEQ ID NO: 40)
```

FIG. 41A

| | | | | | |
|---|---|---|---|---|---|
| ACTGTCTCCA | AGATGGCGGC | CGTGTCAGTT | TGGGGCATCT | CCGCGGTCCG | 50 |
| GCCCGGGGCC | CCGGGATCTC | GGCTGTCCTT | CCTCCCGGCA | TAAGATGCAC | 100 |
| ATTTTTCTGC | TCTGGAGCCG | GGAATGAAAT | ATTCTTGAGT | TCTTACAACT | 150 |
| TTATGACGAG | ACCCATGTGT | GGTGCTATTG | AGAAATTCAT | TGGGAAGTTG | 200 |
| GAAGACATTT | CAATCAACAG | GTTGTTTTGG | TTTCTATAGT | ACAATTGGGG | 250 |
| TGGCATTCTG | TTTTGTGAAA | GGAGGAAGGA | CTTAGGCCAG | AAAACTCATA | 300 |
| TGCTATGGTT | AACTGGTTCC | CAGCCTCCGA | GAATCTTGTT | TTCCATGGTG | 350 |
| TAAAACTTAC | TCAGCATCAG | GATAAGGGAT | AACGACTCTA | TGGATATACA | 400 |
| GAATCCTTCA | CC*ATG*GTAAA | ACTCGCAAAC | CCGCTTTATA | CTGAGTGGAT | 450 |
| TTTGGAGGCC | ATCAAAAAAG | TGAAAAAGCA | GAAACAGCGT | CCTTCAGAAG | 500 |
| AAAGGATATG | CAATGCTGTG | TCTTCATCCC | ATGGCTTGGA | TCGTAAAACT | 550 |
| GTTTTAGAAC | AATTGGAGTT | GAGTGTTAAA | GATGGAACAA | TTTTAAAAGT | 600 |
| CTCAAATAAA | GGACTCAATT | CCTATAAAGA | TCCTGATAAT | CCTGGGCGAA | 650 |
| TAGCACTTCC | TAAGCCTCGG | AACCATGGAA | AATTGGATAA | TAAACAAAAT | 700 |
| GTGGATTGGA | ATAAACTGAT | AAAGCGGGCA | GTTGAGGGCT | TGGCAGAGTC | 750 |
| TGGTGGCTCA | ACTTTGAAAA | GCATTGAACG | TTTTTTGAAA | GGTCAGAAGG | 800 |
| ATGTGTCTGC | ATTATTCGGA | GGCAGTGCTG | CCTCTGGCTT | TCACCAGCAG | 850 |
| TTACGATTGG | CTATCAAACG | TGCCATTGGC | CACGGCAGAC | TCCTTAAAGA | 900 |
| TGGACCTCTT | TATCGGCTCA | ACACTAAAGC | AACCAACGTG | GATGGGAAAG | 950 |
| AGAGTTGTGA | GTCTCTTTCC | TGTTTACCTC | CAGTGTCCCT | TCTTCCACAT | 1000 |
| GAAAAGGATA | AGCCGGTTGC | TGAACCAATC | CCCATCTGTA | GTTTCTGTCT | 1050 |
| TGGTACAAAA | GAACAAAACC | GAGAAAAGAA | GCCAGAGGAA | CTCATCTCCT | 1100 |
| GTGCCGACTG | TGGCAACAGT | GGCCATCCAT | CCTGTTTAAA | GTTTTCCCCT | 1150 |
| GAACTAACGG | TTCGAGTGAA | GGCCTTACGG | TGGCAGTGCA | TCGAGTGTAA | 1200 |
| AACATGCAGC | TCCTGTCGAG | ATCAAGGCAA | AAATGCGGAT | AACATGCTCT | 1250 |
| TTTGTGATTC | ATGTGACCGA | GGTTTTCACA | TGGAGTGTTG | TGATCCGCCA | 1300 |
| CTCACCCGTA | TGCCAAAAGG | CATGTGGATA | TGTCAAATAT | GTCGACCTAG | 1350 |
| GAAAAAAGGA | CGAAAACTTC | TACAAAAGAA | GGCAGCACAG | ATAAAACGGC | 1400 |
| GCTATACTAA | TCCAATAGGA | CGTCCAAAAA | ACAGGTAAA | GAAACAAAAC | 1450 |
| ACGGTATCAA | AAGGTCCCTT | CAGCAAAGTT | CGAACTGGCC | CTGGAAGGGG | 1500 |
| TAGGAAACGA | AAAATCACTC | TTTCCAGCCA | ATCAGCATCA | TCATCATCAG | 1550 |
| AAGAAGGATA | TTTAGAGCGG | ATAGATGGCT | TGGACTTCTG | CAGAGATAGC | 1600 |
| AATGTCTCCT | TGAAGTTCAA | CAAGAAAACC | AAAGGGCTCA | TTGATGGCCT | 1650 |
| TACCAAATTT | TTTACCCCTT | CCCCTGATGG | GCGGAAAGCT | CGGGGGGAAG | 1700 |
| TGGTGGACTA | CTCTGAGCAA | TATCGAATCA | GAAAGAGGGG | CAACAGGAAA | 1750 |
| TCAAGCACTT | CAGATTGGCC | CACAGACAAT | CAGGATGGCT | GGGATGGCAA | 1800 |
| ACAAGAAAAT | GAGGAGCGAC | TTTTTGGGAG | CCAGGAAATC | ATGACTGAGA | 1850 |
| AAGATATGGA | ATTATTTCGT | GATATCCAAG | AACAAGCACT | GCAGAAAGTT | 1900 |
| GGAGTGACTG | GTCCCCCTGA | TCCACAAGTC | CGCTGTCCCT | CTGTCATTGA | 1950 |
| GTTTGGGAAG | TATGAAATTC | ACACCTGGTA | CTCCTCCCCA | TATCCTCAAG | 2000 |
| AATACTCAAG | GCTGCCCAAA | TTGTATCTTT | GTGAATTTTG | TCTAAAATAT | 2050 |
| ATGAAAAGTA | GAACTATTCT | GCAGCAGCAC | ATGAAGAAAT | GTGGTTGGTT | 2100 |
| CCATCCTCCT | GCCAATGAGA | TTTACAGAAA | GAATAATATT | TCTGTCTTTG | 2150 |
| AGGTTGATGG | GAATGTGAGT | ACCATTTATT | GTCAAACCT | GTGTCTTTTG | 2200 |
| GCAAAGTTGT | TTCTTGACCA | CAAAACCCTC | TATTACGATG | TGGAGCCATT | 2250 |
| TCTTTTTTAT | GTACTAACAC | AGAATGATGT | CAAGGGCTGC | CACCTTGTTG | 2300 |
| GCTACTTTTC | TAAGGAAAAG | CACTGCCAAC | AGAAGTACAA | TGTTTCCTGT | 2350 |
| ATAATGATTC | TTCCTCAATA | CCAGCGTAAG | GGCTATGGCA | GGTTTCTCAT | 2400 |
| CGATTTCAGT | TATTTGTTAT | CAAAGCGTGA | AGGCCAAGCA | GGGTCTCCAG | 2450 |
| AGAAACCGTT | ATCTGATCTG | GGTCGTCTTT | CCTACATGGC | ATATTGGAAA | 2500 |

FIG. 41B

```
AGTGTAATAT TGGAGTGCCT TTATCACCAA AATGACAAGC AGATCAGCAT  2550
TAAGAAGTTA AGCAAGTTGA CTGGAATCTG CCCTCAAGAC ATCACTTCCA  2600
CACTCCACCA CCTACGAATG CTGGACTTCC GTAGTGACCA ATTTGTGATT  2650
ATCCGCCGGG AAAAACTTAT CCAGGATCAC ATGGCAAAGC TTCAGCTGAA  2700
TTTGCGACCT GTAGATGTAG ATCCAGAATG TTTGCGCTGG ACTCCAGTCA  2750
TAGTGTCCAA CTCTGTGGTC TCAGAGGAGG AAGAAGAGGA GGCTGAGGAA  2800
GGAGAAAACG AAGAGCCACA GTGCCAGGAA AGAGAATTAG AGATCAGTGT  2850
GGGAAAGTCT GTGTCTCATG AGAACAAAGA ACAAGATTCT TATTCAGTAG  2900
AAAGTGAAAA GAAACCAGAA GTTATGGCTC CAGTCAGTTC TACACGTTTG  2950
AGCAAACAAG TCCTTCCTCA TGATAGTCTT CCTGCAAATA GCCAGCCATC  3000
TCGGAGGGGC CGCTGGGGGA GGAAGAACAG AAAAACCCAG GAACGTTTTG  3050
GTGATAAAGA TTCTAAACTG CTCTTGGAAG AGACGTCTTC AGCTCCTCAG  3100
GAACAATATG GAGAATGTGG GGAGAAATCA GAAGCCACCC AGGAACAATA  3150
CACTGAAAGT GAAGAACAGC TGGTGGCTTC TGAGGAGCAG CCAAGCCAGG  3200
ACGGGAAACC TGACCTTCCC AAGAGAAGAC TCAGTGAGGG GGTTGAGCCC  3250
TGGCGAGGAC AGCTCAAGAA AAGCCCTGAG GCTCTGAAGT GCAGATTAAC  3300
AGAAGGAAGT GAGAGGCTGC CCCGTCGCTA CAGTGAGGGT GACAGGGCTG  3350
TCCTCAGGGG CTTCAGTGAG AGCAGCGAGG AGGAGGAGGA GCCGGAAAGC  3400
CCTCGGTCAA GCTCGCCACC AATTCTCACA AAGCCCACGC TGAAGCGAAA  3450
GAAACCATTT CTCCACCGAA GGAGGAGAGT CCGAAAGCGC AAACACCACA  3500
ATAGCAGTGT AGTCACAGAA ACTATTCTG AGACCACTGA AGTGTTAGAT  3550
GAACCTTTTG AAGATTCTGA CTCCGAGAGG CCAATGCCAA GATTAGAACC  3600
CACGTTTGAG ATCGATGAAG AAGAGGAGGA AGAGGATGAA AATGAACTTT  3650
TCCCTAGAGA ATACTTCCGT CGTTTGTCTT CGCAGGATGT ACTCAGGTGT  3700
CAGTCCTCTT CTAAGAGGAA GTCTAAAGAT GAAGAAGAAG ATGAAGAGTC  3750
AGATGATGCT GATGACACTC CTATCTTAAA GCCAGTATCT CTTTTGCGAA  3800
AACGTGATGT GAAGAATTCT CCTCTTGAGC CAGATACATC CACACCTTTG  3850
AAAAAGAAAA AGGGATGGCC CAAAGGCAAG AGCCGCAAAC CAATCCACTG  3900
GAAGAAAAGA CCTGGTCGAA AACCAGGATT TAAGTTGAGT CGGGAAATCA  3950
TGCCAGTTTC TACTCAAGCA TGCGTCATTG AGCCCATCGT TTCCATTCCT  4000
AAAGCTGGAC GTAAACCCAA GATCCAGGAG AGTGAAGAAA CTGTTGAGCC  4050
AAAAGAAGAC ATGCCCCTAC CCGAGGAGAG GAAGGAGGAG GAGGAGATGC  4100
AAGCAGAGGC AGAAGAGGCT GAAGAGGGTG AGGAAGAGGA TGCAGCCAGC  4150
AGTGAAGTCC CAGCAGCCTC TCCAGCAGAC AGCAGCAATA GTCCTGAGAC  4200
CGAAACCAAG GAGCCTGAGG TGGAGGAGGA AGAAGAGAAG CCCCGTGTCT  4250
CAGAGGAGCA GAGGCAGTCA GAGGAGGAGC AGCAGGAATT AGAGGAGCCA  4300
GAGCCAGAGG AGGAGGAAGA TGCAGCTGCA GAGACTGCCC AGAATGACGA  4350
CCACGACGCT GATGATGAGG ATGATGGCCA CCTGGAGTCC ACAAAGAAAA  4400
AGGAGCTAGA GGAACAGCCC ACGAGGGAAG ATGTCAAGGA GGAGCCTGGT  4450
GTTCAAGAGT CTTTTTTAGA TGCTAATATG CAGAAGAGTA GGGAAAAGAT  4500
AAAGGATAAA GAGGAAACCG AGCTGGATTC CGAAGAGGAG CAGCCTTCCC  4550
ATGACACGTC CGTGGTGTCA GAGCAGATGG CTGGGTCTGA GGACGACCAC  4600
GAAGAAGACT CCCACACTAA GGAAGAGTTA ATCGAATTAA AGAGGAGGA   4650
AGAGATTCCT CATAGTGAGC TGGATCTGGA AACTGTACAG GCAGTGCAGT  4700
CTTTGACTCA AGAAGAAAGC AGTGAGCATG AGGGCGCCTA CCAGGACTGT  4750
GAGGAAACTC TTGCGGCGTG TCAGACCCTG CAGAGTTACA CCCAGGCTGA  4800
CGAGGACCCT CAGATGTCCA TGGTTAAGA CTGTCATGCG TCAGAACATA  4850
ATAGCCCTAT CTCCTCCGTT CAGTCTCACC CCAGCCAGTC AGTCCGTTCG  4900
GTCAGCAGTC CCAACGTGCC TGCCCTTGAG AGTGGCTACA CCCAGATCAG  4950
CCCAGAACAA GGATCCCTGT CCGCACCCTC TATGCAGAAC ATGGAGACCA  5000
GCCCCATGAT GGATGTGCCT TCCGTATCAG ACCACTCTCA GCAGGTGGTG  5050
```

FIG. 41C

```
GACAGCGGCT TCAGTGACCT GGGCAGCATT GAGAGCACCA CTGAAAACTA  5100
TGAGAACCCA AGCAGTTACG ACTCCACGAT GGGCGGCAGC ATCTGTGGGA  5150
ACAGCTCTTC CCAGAGCAGC TGCTCCTACG GTGGGCTGTC GTCCTCCAGC  5200
AGCCTCACCC AGAGCAGCTG TGTGGTCACT CAGCAGATGG CCAGCATGGG  5250
CAGCAGCTGC AGCATGATGC AGCAGAGCAG CGTCCAGCCT GCTGCCAACT  5300
GCAGCATCAA GTCACCTCAG AGCTGCGTGG TGGAGAGGCC TCCCAGTAAC  5350
CAGCAGCAGC AGCCGCCACC ACCGCCTCCA CAGCAGCCAC AGCCGCCGCC  5400
GCCACAACCA CAACCAGCAC CACAGCCTCC ACCACCCCAG CAGCAGCCGC  5450
AACAGCAGCC GCAGCCTCAG CCCCAGCAGC CTCCACCCCC ACCCCCTCCC  5500
CAGCAGCAGC CCCCGCTGTC ACAGTGTAGT ATGAATAACA GTTTCACCCC  5550
AGCTCCTATG ATCATGGAGA TACCAGAATC TGGAAGCACT GGGAACATAA  5600
GTATCTATGA GAGGATTCCA GGGGATTTTG GTGCCGGCAG CTACTCTCAA  5650
CCATCAGCCA CCTTCAGCCT AGCCAAGCTG CAGCAGCTGA CCAACACCAT  5700
TATGGACCCT CATGCCATGC CTTATAGCCA TTCTCCTGCT GTGACTTCCT  5750
ATGCAACCAG TGTTTCTCTG TCCAATACAG GACTGGCTCA GCTGGCTCCA  5800
TCTCATCCCT TAGCTGGGAC TCCTCAAGCA CAAGCCACCA TGACGCCACC  5850
CCCAAACTTG GCATCCACTA CCATGAACCT CACATCTCCT CTGCTTCAGT  5900
GCAACATGTC TGCCACCAAC ATTGGCATTC CTCACACGCA GAGATTGCAA  5950
GGGCAAATGC CAGTGAAGGG GCACATTCC ATCCGCTCCA AGTCTGCGCC  6000
ACTGCCCTCT GCGGCTGCTC ACCAGCAGCA GCTGTATGGC CGTAGCCCAT  6050
CGGCAGTTGC CATGCAGGCT GGCCCTCGCG CACTGGCTGT TCAGCGTGGC  6100
ATGAACATGG GGGTTAATCT GATGCCTACT CCCGCCTATA ATGTCAATTC  6150
CATGAATATG AACACCTTGA ATGCCATGAA CAGCTATCGA ATGACACAGC  6200
CCATGATGAA CAGCAGTTAC CATAGTAACC CTGCCTACAT GAACCAGACA  6250
GCACAGTATC CTATGCAGAT GCAGATGGGA ATGATGGGGA GCCAGGCCTA  6300
TACCCAGCAG CCTATGCAGC CTAACCCTCA TGGGAACATG ATGTACACAG  6350
GCCCCTCCCA TCACAGCTAC ATGAACGCTG CTGGCGTGCC CAAGCAGTCA  6400
CTCAACGGAC CTTACATGAG AAGATGAGCA AGATGAACTT GCAATCAAAA  6450
ACTTAAATAT ATATAAATAA AGGAACCTTT TATACTGACA AACCAGAGAA  6500
AAATGGACCT TTTTCCAGTT AAAATATTGC TGTAGATTTA GAGGAATTTT  6550
TCTTTGGTTT ATTTTATTTT TTAGAAAACC TGATCTTCTC TTTTTTTGGG  6600
TTCATTTTGT TCTGGGTTTT GGTTTCTTC ACAATCTTGA ACATTTACA   6650
GTAGAACTCA TCTAAAAATG GATTTGGGGA TGGGGAAACA TGCACAAAAT  6700
CTTTTCATAA TTAAAAGAG CCTTACTTTC TTTACATACC ACATGGACAG   6750
AATTTGTGTA AAAGTGAATT ATCTTTATTT TAAATGTAT GTTTCCCTC    6800
ACTGTTTGCA GCTCCCAATG TTGTCATTTT TAAATGTTAT ATACATCTCA  6850
AGGGTTAACC AGACCCTTTC CTCCAAACCC AACCTTTCAT TTCCTACTTC  6900
ATTCCAGCAG GAGGCACTTA GGGGAGACTC GGATGGGGAC ATGGAGAACA  6950
ACCCAAGCTC CTTAAACTTA TTATTATTGT TAATATTATT ATTATTATTA  7000
TTAATAAAGT GAGGCAGGAA AATGCTTCTC CTTTTAAAAT CCCCTCCACT  7050
CCTCACACAC ACACACCTCT TGAAACCCTT CCCCAAGAAT GTTTCTTTAT  7100
AGACGGACTT CATTGAAATC TTTGTTGTTC TTGAATCAAG TGTAATATAA  7150
TTTTTTTCTT CTTTTTTAAA ATATTCCCAC TCAGCACTCA GAGACACAAA  7200
AATACTGTAA GTCTCAATTA ACAGCAGAAT CTCAGAGAAA AGCTGTTTGC  7250
AATCCAAATC CAGCCTTTGG AGGAATAGAG ATGGTCAATT AACAATCAAA  7300
AAGAGGAGAT TAACCTCTTG TTTTTTACC ACCTGGTGAA TCAGCCATAA   7350
CGCACACACA CGCCACCCAG CCTCTTGTTT CTAGTATGTA CTTTGAAATG  7400
CTAACTGAGG GTCTTGATGC TTGAGCCTTT GACTGATAAA ACTCAAATAG  7450
CAGTCCCCAG TGATTTGCCT CTTAGGTTCT TTCTTAAATT GTTGGTGGAT  7500
GACTGTACAT TTTAGTGATT TGAAAATAA CTGACAAACC ATTGAAACAG   7550
TTTATTTTAT GTTGGAAGAG ATGGCGCAGA TGTGTGTCAG AAGGGAGATC  7600
```

FIG. 41D

```
ACGGTGTGAG TTTCGTAGCT ATTTAAGTGA TACATACCTC TAGTTTTTGT  7650
ATGTCTTTTG AGATCCTGAG TTCATCCCCT GTGAATCAGA GTGCACAAGC  7700
ACCTCTCCTG TGAGTGGCTA ATGAGAAGAG GGACAGACCG ACCACCAGCA  7750
CAGTAGGGCA GATCTGGACA GCAGAATGTT ATAACGCAAG TTCATGTGTT  7800
GCTCCCAACT CCATTCTCTT TTCTCTCGTG CAACCAGTTT GCCCATTCTC  7850
TTCCTATTAC TTGCTCCAGG GATAGGTAAA AAAAAAAAAA AAAAAAAAAA  7900
AAATATATAT ATATATATAT ACACACACAC ACACACACAC ACACACACAT  7950
ATATATATAT ATATATTCCA TCATTAGAAG ATGGAAACTA TTATACCACT  8000
TGGTATGTGC AGTCAAATAT CCAAAAGGGG GAAGTACTGC TTAGAGAAAT  8050
ATCTGTAAGC ATTAAATTCT CTCCTTTATT TGTACATTTT ATATAGATAA  8100
ATTTTTAAAG TACTAATTAG GCATTAACTT TTTTCAAATG CACAGGTTTG  8150
TTGGTTTTTT TAATACACTT TAATTGACTT TCTCAAGCGT GCTAGGTAGA  8200
AACGCAGAAT TCCACATCTT CCCGCTCTCA GCTCTGAGCA TGTGCAAGGC  8250
TGTGTAGGAC CCAGTTTCTC TGTATATACT ATTCCAGTTC CCAGTCATCT  8300
ATGTAGAAAG TGCACTGTGC TGCCATCGCC CTACATCTTC AGCTGTGTCA  8350
TTGCTTCCTG GTTGGGGTGG GGACGGGGTG GGTCGGGAGG GAGGTATATT  8400
GGGAGGAGGG TGGGTCAAGG CAGAAGGAGA AGCTGTTGAA ATGAGGGCCG  8450
TGAAATCAGT TTCTGTTGGT TTGCGGTTGT GTTTGGTTTT GTTTGTTTCT  8500
TTATAAAAAA TTCAATCGGG CAGCTCCCTT TTCCACAAGC CTCTTTGTGA  8550
CTGTAGAACT ATTGTAGAAA AAAAAAGTTC TTTTCTATAT TATAAAAGAA  8600
ATTATCCAAC ACAGTAATAT TGGTACCTGT CATTTTTTCA CTTCTGTTTA  8650
AAAAAAATGT ATTTTAGCA AGATAACTTG GGTAATCTTC TAAAAAAGAA  8700
ATTTAAAAAC TCACTGTTAG TGACTTTGAT GCCTTTAAA ATAAGAGCTT  8750
TTTCATTTCA TTCCATCTTT AAAATTTTTT ATCTTTGTTG TAGAATATTA  8800
AAAACTATTT TAAGAAAGAT AAATTCTCTT TAAAGAGATC TCTAGCGTGT  8850
GTGAATAGAG CTCCAGATGC CTCTAAAAGC CGCATGTACA AAGGAAGCCA  8900
CGTCTATCCT GTCTGTTTAT ATTTGCTTTT CCTGTTTTGT AACCTCTTTG  8950
TACTTTGTTC ATGGTGACTT GTAAGCTAAG GGGAAGGGGT GCCTAGATGC  9000
CTTTGTATCT CTCCATGTCA CGCGCTCCTG GGCCAGCCGG CCTCCCTTCC  9050
TCTCCTTGTA TGTAATACCT TTTTTCCCC TTCTAGCAA GTACTTCAA   9100
AAGAACTCTG TACATTTAA CATAAAAAAT AAATTATGTT GAGCCATTTT  9150
GGA (SEQ ID NO: 41)
```

FIG. 42

```
MVKLANPLYTEWILEAIKKVKKQKQRPSEERICNAVSSSHGLDRKTVLEQLELSVKDGTI
LKVSNKGLNSYKDPDNPGRIALPKPRNHGKLDNKQNVDWNKLIKRAVEGLAESGGSTLKS
IERFLKGQKDVSALFGGSAASGFHQQLRLAIKRAIGHGRLLKDGPLYRLNTKATNVDGKE
SCESLSCLPPVSLLPHEKDKPVAEPIPICSFCLGTKEQNREKKPEELISCADCGNSGHPS
CLKFSPELTVRVKALRWQCIECKTCSSCRDQGKNADNMLFCDSCDRGFHMECCDPPLTRM
PKGMWICQICRPRKKGRKLLQKKAAQIKRRYTNPIGRPKNRLKKQNTVSKGPFSKVRTGP
GRGRKRKITLSSQSASSSEEGYLERIDGLDFCRDSNVSLKFNKKTKGLIDGLTKFFTPS
PDGRKARGEVVDYSEQYRIRKRGNRKSSTSDWPTDNQDGWDGKQENEERLFGSQEIMTEK
DMELFRDIQEQALQKVGVTGPPDPQVRCPSVIEFGKYEIHTWYSSPYPQEYSRLPKLYLC
EFCLKYMKSRTILQQHMKKCGWFHPPANEIYRKNNISVFEVDGNVSTIYCQNLCLLAKLF
LDHKTLYYDVEPFLFYVLTQNDVKGCHLVGYFSKEKHCQQKYNVSCIMILPQYQRKGYGR
FLIDFSYLLSKREGQAGSPEKPLSDLGRLSYMAYWKSVILECLYHQNDKQISIKKLSKLT
GICPQDITSTLHHLRMLDFRSDQFVIIRREKLIQDHMAKLQLNLRPVDVDPECLRWTPVI
VSNSVVSEEEEEEAEEGENEEPQCQERELEISVGKSVSHENKEQDSYSVESEKKPEVMAP
VSSTRLSKQVLPHDSLPANSQPSRRGRWGRKNRKTQERFGDKDSKLLLEETSSAPQEQYG
ECGEKSEATQEQYTESEEQLVASEEQPSQDGKPDLPKRRLSEGVEPWRGQLKKSPEALKC
RLTEGSERLPRRYSEGDRAVLRGFSESSEEEEEPESPRSSSPPILTKPTLKRKKPFLHRR
RRVRKRKHHNSSVVTETISETTEVLDEPFEDSDSERPMPRLEPTFEIDEEEEEDENELF
PREYFRRLSSQDVLRCQSSSKRKSKDEEEDEESDDADDTPILKPVSLLRKRDVKNSPLEP
DTSTPLKKKKGWPKGKSRKPIHWKKRPGRKPGFKLSREIMPVSTQACVIEPIVSIPKAGR
KPKIQESEETVEPKEDMPLPEERKEEEMQAEAEEAEEGEEEDAASSEVPAASPADSSNS
PETETKEPEVEEEEKPRVSEEQRQSEEEQQELEEPEPEEEDAAAETAQNDDHDADDED
DGHLESTKKKELEEQPTREDVKEEPGVQESFLDANMQKSREKIKDKEETELDSEEEQPSH
DTSVVSEQMAGSEDDHEEDSHTKEELIELKEEEEIPHSELDLETVQAVQSLTQEESSEHE
GAYQDCEETLAACQTLQSYTQADEDPQMSMVEDCHASEHNSPISSVQSHPSQSVRSVSSP
NVPALESGYTQISPEQGSLSAPSMQNMETSPMMDVPSVSDHSQQVVDSGFSDLGSIESTT
ENYENPSSYDSTMGGSICGNSSSQSSCSYGGLSSSSSLTQSSCVVTQQMASMGSSCSMMQ
QSSVQPAANCSIKSPQSCVVERPPSNQQQQPPPPPPQQPQPPPPQPQPAPQPPPPQQQPQ
QQPQPQPQQPPPPPPQQQPPLSQCSMNNSFTPAPMIMEIPESGSTGNISIYERIPGDFG
AGSYSQPSATFSLAKLQQLTNTIMDPHAMPYSHSPAVTSYATSVSLSNTGLAQLAPSHPL
AGTPQAQATMTPPPNLASTTMNLTSPLLQCNMSATNIGIPHTQRLQGQMPVKGHISIRSK
SAPLPSAAAHQQQLYGRSPSAVAMQAGPRALAVQRGMNMGVNLMPTPAYNVNSMNMNTLN
AMNSYRMTQPMMNSSYHSNPAYMNQTAQYPMQMQMGMMGSQAYTQQPMQPNPHGNMMYTG
PSHHSYMNAAGVPKQSLNGPYMRR- (SEQ ID NO: 42)
```

FIG. 43A

```
ATGCTCAGTG GCTTCTCGAC AAGTTGGCAG CAACAACACG GCCCTGGTCG  50
TCGTCGCCGC TGCGGTAACG GAGCGGTTTG GGTGGCGGAG CCTGCGTTCG  100
CGCCTTCCCG CTCTCCTCGG GAGGCCCTTC CTGCTCTCCC CTAGGCTCCG  150
CGGCCGCCCA GGGGGTGGGA GCGGGTGAGG GGAGCCAGGC GCCCAGCGAG  200
AGAGGCCCCC CGCCGCAGGG CGGCCCGGGA GCTCGAGGCG GTCCGGCCCG  250
CGCGGGCAGC GGCGCGGCGC TGAGGAGGGG CGGCCTGGCC GGGACGCCTC  300
GGGGCGGGGG CCGAGGAGCT CTCCGGGCCG CCGGGGAAAG CTACGGGCCC  350
GGTGCGTCCG CGGACCAGCA GCGCGGGAGA GCGGACTCCC CTCGCCACCG  400
CCCGAGCCCA GGTTATCCTG AATACATGTC TAACAATTTT CCTTGCAACG  450
TTAGCTGTTG TTTTTCACTG TTTCCAAAGG ATCAAAATTG CTTCAGAAAT  500
TGGAGACATA TTTGATTTAA AAGGAAAAAC TTGAACAAAT GGACAATATG  550
TCTATTACGA ATACACCAAC AAGTAATGAT GCCTGTCTGA GCATTGTGCA  600
TAGTTTGATG TGCCATAGAC AAGGTGGAGA GAGTGAAACA TTTGCAAAAA  650
GAGCAATTGA AAGTTTGGTA AAGAAGCTGA AGGAGAAAAA AGATGAATTG  700
GATTCTTTAA TAACAGCTAT AACTACAAAT GGAGCTCATC CTAGTAAATG  750
TGTTACCATA CAGAGAACAT GGATGGGAG GCTTCAGGTG GCTGGTCGGA  800
AAGGATTTCC TCATGTGATC TATGCCCGTC TCTGGAGGTG GCCTGATCTT  850
CACAAAAATG AACTAAAACA TGTTAAATAT TGTCAGTATG CGTTTGACTT  900
AAAATGTGAT AGTGTCTGTG TGAATCCATA TCACTACGAA CGAGTTGTAT  950
CACCTGGAAT TGATCTCTCA GGATTAACAC TGCAGAGTAA TGCTCCATCA  1000
AGTATGATGG TGAAGGATGA ATATGTGCAT GACTTTGAGG ACAGCCATC  1050
GTTGTCCACT GAAGGACATT CAATTCAAAC CATCCAGCAT CCACCAAGTA  1100
ATCGTGCATC GACAGAGACA TACAGCACCC CAGCTCTGTT AGCCCCATCT  1150
GAGTCTAATG CTACCAGCAC TGCCAACTTT CCCAACATTC CTGTGGCTTC  1200
CACAAGTCAG CCTGCCAGTA TACTGGGGGG CAGCCATAGT GAAGGACTGT  1250
TGCAGATAGC ATCAGGGCCT CAGCCAGGAC AGCAGCAGAA TGGATTTACT  1300
GGTCAGCCAG CTACTTACCA TCATAACAGC ACTACCACCT GGACTGGAAG  1350
TAGGACTGCA CCATACACAC CTAATTTGCC TCACCACCAA AACGGCCATC  1400
TTCAGCACCA CCCGCCTATG CCGCCCCATC CCGGACATTA CTGGCCTGTT  1450
CACAATGAGC TTGCATTCCA GCCTCCCATT TCCAATCATC CTGCTCCTGA  1500
GTATTGGTGT TCCATTGCTT ACTTTGAAAT GGATGTTCAG GTAGGAGAGA  1550
CATTTAAGGT TCCTTCAAGC TGCCCTATTG TTACTGTTGA TGGATACGTG  1600
GACCCTTCTG GAGGAGATCG CTTTTGTTTG GGTCAACTCT CCAATGTCCA  1650
CAGGACAGAA GCCATTGAGA GAGCAAGGTT GCACATAGGC AAAGGTGTGC  1700
AGTTGGAATG TAAAGGTGAA GGTGATGTTT GGGTCAGGTG CCTTAGTGAC  1750
CACGCGGTCT TTGTACAGAG TTACTACTTA GACAGAGAAG CTGGGCGTGC  1800
ACCTGGAGAT GCTGTTCATA AGATCTACCC AAGTGCATAT ATAAAGGTCT  1850
TTGATTTGCG TCAGTGTCAT CGACAGATGC AGCAGCAGGC GGCTACTGCA  1900
CAAGCTGCAG CAGCTGCCCA GGCAGCAGCC GTGGCAGGAA ACATCCCTGG  1950
CCCAGGATCA GTAGGTGGAA TAGCTCCAGC TATCAGTCTG TCAGCTGCTG  2000
CTGGAATTGG TGTTGATGAC CTTCGTCGCT TATGCATACT CAGGATGAGT  2050
TTTGTGAAAG GCTGGGGACC GGATTACCCA AGACAGAGCA TCAAAGAAAC  2100
ACCTTGCTGG ATTGAAATTC ACTTACACCG GGCCCTCCAG CTCCTAGACG  2150
AAGTACTTCA TACCATGCCG ATTGCAGACC CACAACCTTT AGACTGAGGT  2200
CTTTTACCGT TGGGGCCCTT AACCTTATCA GGATGGTGGA CTACAAAATA  2250
CAATCCTGTT TATAATCTGA AGATATATTT CACTTTGTT CTGCTTTATC  2300
TTTTCATAAA GGGTTGAAAA TGTGTTTGCT GCCTTGCTCC TAGCAGACAG  2350
AAACTGGATT AAAACAATTT TTTTTTCCT CTTCAGAACT TGTCAGGCAT  2400
GGCTCAGAGC TTGAAGATTA GGAGAAACAC ATTCTTATTA ATTCTTCACC  2450
TGTTATGTAT GAAGGAATCA TTCCAGTGCT AGAAAATTTA GCCCTTTAAA  2500
ACGTCTTAGA GCCTTTTATC TGCAGAACAT CGATATGTAT ATCATTCTAC  2550
```

FIG. 43B

```
AGAATAATCC AGTATTGCTG ATTTTAAAGG CAGAGAAGTT CTCAAAGTTA 2600
ATTCACCTAT GTTATTTGT  GTACAAGTTG TTATTGTTGA ACATACTTCA 2650
AAAATAATGT GCCATGTGGG TGAGTTAATT TTACCAAGAG TAACTTTACT 2700
CTGTGTTTAA AAAGTAAGTT AATAATGTAT TGTAATCTTT CATCCAAAAT 2750
ATTTTTTGCA AGTTATATTA GTGAAGATGG TTTCAATTCA GATTGTCTTG 2800
CAACTTCAGT TTTATTTTG  CCAAGGCAAA AAACTCTTAA TCTGTGTGTA 2850
TATTGAGAAT CCCTTAAAAT TACCAGACAA AAAAATTTAA AATTACGTTT 2900
GTTATTCCTA GTGGATGACT GTTGATGAAG TATACTTTC  CCCTGTTAAA 2950
CAGTAGTTGT ATTCTTCTGT ATTTCTAGGC ACAAGGTTGG TTGCTAAGAA 3000
GCCTATAAGA GGAATTTCTT TTCCTTCATT CATAGGGAAA GGTTTTGTAT 3050
TTTTAAAAC  ACTAAAGCA  GCGTCACTCT ACCTAATGTC TCACTGTTCT 3100
GCAAAGGTGG CAATGCTTAA ACTAAATAAT GAATAAACTG AATATTTGG  3150
AAACTGCTAA ATTCTATGTT AAATACTGTG CAGAATAATG GAAACATTAC 3200
AGTTCATAAT AGGTAGTTTG GATATTTTG  TACTTGATTT GATGTGACTT 3250
TTTTGGTAT  AATGTTTAAA TCATGTATGT TATGATATTG TTTAAAATTC 3300
AGTTTTGTA  TCTTGGGGCA AGACTGCAAA CTTTTTTATA TCTTTTGGTT 3350
ATTCTAAGCC CTTTGCCATC AATGATCATA TCAATTGGCA GTGACTTTGT 3400
ATAGAGAATT TAAGTAGAAA AGTTGCAGAT GTATTGACTG TACCACAGAC 3450
ACAATATGTA TGCTTTTAC  CTAGCTGGTA GCATAAATAA AACTGAATCT 3500
CAACATACAA AGTTGAATTC TAGGTTTGAT TTTAAGATT  TTTTTTTCT  3550
TTTGCACTTT TGAGTCCAAT CTCAGTGATG AGGTACCTTC TACTAAATGA 3600
CAGGCAACAG CCAGTTCTAT TGGGCAGCTT TGTTTTTTC  CCTCACACTC 3650
TACCGGGACT TCCCCATGGA CATTGTGTAT CATGTGTAGA GTTGGTTTTT 3700
TTTTTTTTA  ATTTTATTT  TACTATAGCA GAAATAGACC TGATTATCTA 3750
CAAGATGATA AATAGATTGT CTACAGGATA AATAGTATGA AATAAAATCA 3800
AGGATTATCT TTCAGATGTG TTTACTTTTG CCTGGAGAAC TTTTAGCTAT 3850
AGAAACACTT GTGTGATGAT AGTCCTCCTT ATATCACCTG GAATGAACAC 3900
AGCTTCTACT GCCTTGCTCA GAAGGTCTTT TAAATAGACC ATCCTAGAAA 3950
CCACTGAGTT TGCTTATTTC TGTGATTTAA ACATAGATCT TGATCCAAGC 4000
TACATGACTT TTGTCTTTAA ATAACTTATC TACCACCTCA TTTGTACTCT 4050
TGATTACTTA CAAATTCTTT CAGTAAACAC CTAATTTCT  TCTGTAAAAG 4100
TTTGGTGATT TAAGTTTTAT TGGCAGTTTT ATAAAAGAC  ATCTTCTCTA 4150
GAAATTGCTA ACTTTAGGTC CATTTACTG  TGAATGAGGA ATAGGAGTGA 4200
GTTTAGAAT  AACAGATTTT TAAAAATCCA GATGATTTGA TTAAAACCTT 4250
AATCATACAT TGACATAATT CATTGCTTCT TTTTTTGAG  ATATGGAGTC 4300
TTGCTGTGTT GCCCAGGCAG GAGTGCAGTG GTATGATCTC AGCTCACTGC 4350
AACCTCTGCC TCCCGGGTTC AACTGATTCT CCTGCCTCAG CCTCCCTGGT 4400
AGCTAGGATT ACAGGTGCCC GCCACCATGC CTGGCTAACT TTTGTAGTTT 4450
TAGTAGAGAC GGGGTTTTGC CTGTTGGCCA GGCTGGTCTT GAACTCCTGA 4500
CCTCAAGTGA TCCATCCACC TTGGCCTCCC AAAGTGCTGG GATTACGGGC 4550
GTGAGCCACT GTCCCTGGCC TCATTGTTCC CTTTTCTACT TTAAGGAAAG 4600
TTTTCATGTT TAATCATCTG GGGAAAGTAT GTGAAAAATA TTTGTTAAGA 4650
AGTATCTCTT TGGAGCCAAG CCACCTGTCT TGGTTTCTTT CTACTAAGAG 4700
CCATAAAGTA TAGAAATACT TCTAGTTGTT AAGTGCTTAT ATTTGTACCT 4750
AGATTTAGTC ACACGCTTTT GAGAAAACAT CTAGTATGTT ATGATCAGCT 4800
ATTCCTGAGA GCTTGGTTGT TAATCTATAT TTCTATTTCT TAGTGGTAGT 4850
CATCTTTGAT GAATAAGACT AAAGATTCTC ACAGGTTTAA AATTTTATGT 4900
CTACTTTAAG GGTAAAATTA TGAGGTTATG GTTCTGGGTG GGTTTTCTCT 4950
AGCTAATTCA TATCTCAAAG AGTCTCAAAA TGTTGAATTT CAGTGCAAGC 5000
TGAATGAGAG ATGAGCCATG TACACCCACC GTAAGACCTC ATTCCATGTT 5050
TGTCCAGTGC CTTTCAGTGC ATTATCAAAG GGAATCCTTC ATGGTGTTGC 5100
```

FIG. 43C

```
CTTTATTTTC CGGGGAGTAG ATCGTGGGAT ATAGTCTATC TCATTTTTAA  5150
TAGTTTACCG CCCCTGGTAT ACAAAGATAA TGACAATAAA TCACTGCCAT  5200
ATAACCTTGC TTTTTCCAGA AACATGGCTG TTTTGTATTG CTGTAACCAC  5250
TAAATAGGTT GCCTATACCA TTCCTCCTGT GAACAGTGCA GATTTACAGG  5300
TTGCATGGTC TGGCTTAAGG AGAGCCATAC TTGAGACATG TGAGTAAACT  5350
GAACTCATAT TAGCTGTGCT GCATTTCAGA CTTAAAATCC ATTTTGTGG   5400
GGCAGGGTGT GGTGTGTAAA GGGGGGTGTT TGTAATACAA GTTGAAGGCA  5450
AAATAAAATG TCCTGTCTCC CAGATGATAT ACATCTTATT ATTTTAAAG   5500
TTTATTGCTA ATTGTAGGAA GGTGAGTTGC AGGTATCTTT GACTATGGTC  5550
ATCTGGGGAA GGAAAATTTT ACATTTACT  ATTAATGCTC CTTAAGTGTC  5600
TATGGAGGTT AAAGAATAAA ATGGTAAATG TTTCTGTGCC TGGTTTGATG  5650
GTAACTGGTT AATAGTTACT CACCATTTTA TGCAGAGTCA CATTAGTTCA  5700
CACCCTTTCT GAGAGCCTTT TGGGAGAAGC AGTTTTATTC TCTGAGTGGA  5750
ACAGAGTTCT TTTTGTTGAT AATTTCTAGT TTGCTCCCTT CGTTATTGCC  5800
AACTTTACTG GCATTTTATT TAATGATAGC AGATTGGGAA AATGGCAAAT  5850
TTAGGTTACG GAGGTAAATG AGTATATGAA AGCAATTACC TCTAAAGCCA  5900
GTTAACAATT ATTTTGTAGG TGGGGTACAC TCAGCTTAAA GTAATGCATT  5950
TTTTTTTCCC GTAAAGGCAG AATCCATCTT GTTGCAGATA GCTATCTAAA  6000
TAATCTCATA TCCTCTTTTG CAAAGACTAC AGAGAATAGG CTATGACAAT  6050
CTTGTTCAAG CCTTTCCATT TTTTTCCCTG ATAACTAAGT AATTTCTTTG  6100
AACATACCAA GAAGTATGTA AAAAGTCCAT GGCCTTATTC ATCCACAAAG  6150
TGGCATCCTA GGCCCAGCCT TATCCCTAGC AGTTGTCCCA GTGCTGCTAG  6200
GTTGCTTATC TTGTTTATCT GGAATCACTG TGGAGTGAAA TTTTCCACAT  6250
CATCCAGAAT TGCCTTATTT AAGAAGTAAA ACGTTTAAT  TTTTAGCCTT  6300
TTTTTGGTGG AGTTATTTAA TATGTATATC AGAGGATATA CTAGATGGTA  6350
ACATTTCTTT CTGTGCTTGG CTATCTTTGT GGACTTCAGG GGCTTCTAAA  6400
ACAGACAGGA CTGTGTTGCC TTTACTAAAT GGTCTGAGAC AGCTATGGTT  6450
TTGAATTTTT AGTTTTTTTT TTTTAACCCA CTTCCCCTCC TGGTCTCTTC  6500
CCTCTCTGAT AATTACCATT CATATGTGAG TGTTAGTGTG CCTCCTTTTA  6550
GCATTTTCTT CTTCTCTTTC TGATTCTTCA TTTCTGACTG CCTAGGCAAG  6600
GAAACCAGAT AACCAAACTT ACTAGAACGT TCTTTAAAAC ACAAGTACAA  6650
ACTCTGGGAC AGGACCCAAG ACACTTTCCT GTGAAGTGCT GAAAAAGACC  6700
TCATTGTATT GGCATTTGAT ATCAGTTTGA TGTAGCTTAG AGTGCTTCCT  6750
GATTCTTGCT GAGTTTCAGG TAGTTGAGAT AGAGAGAAGT GAGTCATATT  6800
CATATTTTCC CCCTTAGAAT AATATTTTGA AAGGTTTCAT TGCTTCCACT  6850
TGAATGCTGC TCTTACAAAA ACTGGGGTTA CAAGGGTTAC TAAATTAGCA  6900
TCAGTAGCCA GAGGCAATAC CGTTGTCTGG AGGACACCAG CAAACAACAC  6950
ACAACAAAGC AAAACAAACC TTGGGAAACT AAGGCCATTT GTTTGTTTT   7000
GGTGTCCCCT TTGAAGCCCT GCCTTCTGGC CTTACTCCTG TACAGATATT  7050
TTTGACCTAT AGGTGCCTTT ATGAGAATTG AGGGTCTGAC ATCCTGCCCC  7100
AAGGAGTAGC TAAAGTAATT GCTAGTGTTT TCAGGGATTT TAACATCAGA  7150
CTGGAATGAA TGAATGAAAC TTTTTGTCCT TTTTTTTTCT GTTTTTTTTT  7200
TTCTAATGTA GTAAGGACTA AGGAAAACCT TGGTGAAGA  CAATCATTTC  7250
TCTCTGTTGA TGTGGATACT TTTCACACCG TTTATTTAAA TGCTTTCTCA  7300
ATAGGTCCAG AGCCAGTGTT CTTGTTCAAC CTGAAAGTAA TGGCTCTGGG  7350
TTGGGCCAGA CAGTTGCACT CTCTAGTTTG CCCTCTGCCA CAAATTTGAT  7400
GTGTGACCTT TGGGCAAGTC ATTTATCTTC TCTGGGCCTT AGTTGCCTCA  7450
TCTGTAAAAT GAGGGAGTTG GAGTAGATTA ATTATTCCAG CTCTGAAATT  7500
CTAAGTGACC TTGGCTACCT TGCAGCAGTT TTGGATTTCT TCCTTATCTT  7550
TGTTCTGCTG TTTGAGGGGG CTTTTACTT  ATTTCCATGT TATTCAAAGG  7600
AGACTAGGCT TGATATTTTA TTACTGTTCT TTTATGGACA AAAGGTTACA  7650
```

FIG. 43D

```
TAGTATGCCC TTAAGACTTA ATTTTAACCA AAGGCCTAGC ACCACCTTAG  7700
GGGCTGCAAT AAACACTTAA CGCGCGTGCG CACGCGCGCG CGCACACACA  7750
CACACACACA CACACACACA CACAGGTCAG AGTTTAAGGC TTTCGAGTCA  7800
TGACATTCTA GCTTTTGAAT TGCGTGCACA CACACACGCA CGCACACACT  7850
CTGGTCAGAG TTTATTAAGG CTTTCGAGTC ATGACATTAT AGCTTTTGAG  7900
TTGGTGTGTG TGACACCACC CTCCTAAGTG GTGTGTGCTT GTAATTTTT   7950
TTTTCAGTGA AAATGGATTG AAAACCTGTT GTTAATGCTT AGTGATATTA  8000
TGCTCAAAAC AAGGAAATTC CCTTGAACCG TGTCAATTAA ACTGGTTTAT  8050
ATGACTCAAG AAAACAATAC CAGTAGATGA TTATTAACTT TATTCTTGGC  8100
TCTTTTTAGG TCCATTTTGA TTAAGTGACT TTTGGCTGGA TCATTCAGAG  8150
CTCTCTTCTA GCCTACCCTT GGATGAGTAC AATTAATGAA ATTCATATTT  8200
TCAAGGACCT GGGAGCCTTC CTTGGGGCTG GGTTGAGGGT GGGGGGTTGG  8250
GGAGTCCTGG TAGAGGCCAG CTTTGTGGTA GCTGGAGAGG AAGGGATGAA  8300
ACCAGCTGCT GTTGCAAAGG CTGCTTGTCA TTGATAGAAG GACTCACGGG  8350
CTTGGATTGA TTAAGACTAA ACATGGAGTT GGCAAACTTT CTTCAAGTAT  8400
TGAGTTCTGT TCAATGCATT GGACATGTGA TTTAAGGGAA AAGTGTGAAT  8450
GCTTATAGAT GATGAAAACC TGGTGGGCTG CAGAGCCCAG TTAGAAGAA   8500
GTGAGTTGGG GGTTGGGGAC AGATTTGGTG GTGGTATTTC CCAACTGTTT  8550
CCTCCCCTAA ATTCAGAGGA ATGCAGCTAT GCCAGAAGCC AGAGAAGAGC  8600
CACTCGTAGC TTCTGCTTTG GGGACAACTG GTCAGTTGAA AGTCCCAGGA  8650
GTTCCTTTGT GGCTTTCTGT ATACTTTGC  CTGGTTAAAG TCTGTGGCTA  8700
AAAAATAGTC GAACCTTTCT TGAGAACTCT GTAACAAAGT ATGTTTTTGA  8750
TTAAAAGAGA AAGCCAACTA Aaaaaaaaaa aaaaaaaaa (SEQ ID NO: 43)
```

FIG. 44

```
MDNMSITNTPTSNDACLSIVHSLMCHRQGGESETFAKRAIESLVKKLKEKKDELDSLITA
ITTNGAHPSKCVTIQRTLDGRLQVAGRKGFPHVIYARLWRWPDLHKNELKHVKYCQYAFD
LKCDSVCVNPYHYERVVSPGIDLSGLTLQSNAPSSMMVKDEYVHDFEGQPSLSTEGHSIQ
TIQHPPSNRASTETYSTPALLAPSESNATSTANFPNIPVASTSQPASILGGSHSEGLLQI
ASGPQPGQQQNGFTGQPATYHHNSTTTWTGSRTAPYTPNLPHHQNGHLQHHPPMPPHPGH
YWPVHNELAFQPPISNHPAPEYWCSIAYFEMDVQVGETFKVPSSCPIVTVDGYVDPSGGD
RFCLGQLSNVHRTEAIERARLHIGKGVQLECKGEGDVWVRCLSDHAVFVQSYYLDREAGR
APGDAVHKIYPSAYIKVFDLRQCHRQMQQQAATAQAAAAAQAAAVAGNIPGPGSVGGIAP
AISLSAAAGIGVDDLRRLCILRMSFVKGWGPDYPRQSIKETPCWIEIHLHRALQLLDEVL
HTMPIADPQPLD- (SEQ ID NO: 44)
```

FIG. 45A

```
GCCTCCTCCC CACACCTGGG AGGGGAGTGG TGCGGCGCGG CCTCCTCCCC    50
CGGCGCTCGC AACTCCTGTC CGGCCGTAGC TGCGCCGCCG CGGCGGGAGT   100
AAAGGTCGCG CCGCCGGGAG CGAGCCGGCC GCGGCGCCTG CGGGAAGCCG   150
GCGGGGCAGG TCGGAGAAGA GCGAGAAGAT CGAGAAACTC CAGGCCAGCC   200
CGGGAACATG GCGCCAGGCG GGCCAGCCGC GGACTGAGAG CCGCGGGGCA   250
GCCAGGAGCC GGGGCCCGAG CCCCGCCCGG CCCGGGCC*AT G*TCGGTGGGC   300
GAGCTCTACA GCCAGTGCAC AAGGGTCTGG ATCCCTGACC CTGATGAGGT   350
ATGGCGCTCA GCTGAGTTAA CCAAGGACTA CAAAGAAGGA GACAAGAGCC   400
TACAGCTCAG ACTGGAGGAT GAAACGATTC TGGAATACCC AATTGATGTA   450
CAACGCAACC AGCTGCCCTT CTTACGGAAT CCAGATATCT TGGTGGGAGA   500
AAATGACCTG ACTGCCCTTA GCTATCTTCA TGAGCCTGCA GTTTTGCATA   550
ATTTGAAGGT CCGTTCCTG GAGTCCAACC ATATCTACAC TTACTGTGGT   600
ATCGTACTTG TTGCCATTAA TCCTTATGAA CAGTTGCCAA TCTATGGACA   650
AGATGTCATC TATACCTACA GTGGCCAAAA CATGGGAGAC ATGGACCCCC   700
ACATCTTTGC TGTGGCAGAA GAAGCCTACA AGCAGATGGC CAGAGATGAG   750
AAGAATCAGT CCATCATAGT CAGTGGGGAG TCTGGAGCCG GGAAGACGGT   800
ATCAGCCAAG TATGCCATGC GCTATTTCGC CACCGTTGGT GGCTCGGCCA   850
GTGAAACCAA CATCGAAGAG AAGGTGCTGG CATCCAGTCC CATCATGGAG   900
GCCATTGGAA ATGCCAAGAC CACCCGCAAT GACAACAGCA GCCGTTTTGG   950
CAAGTACATC CAGATTGGCT TTGACAAAAG GTACCACATC ATCGGGGCCA  1000
ACATGAGGAC TTACCTCTTG GAGAAGTCCA GAGTGGTCTT CCAGGCAGAT  1050
GATGAGAGGA ATTACCACAT CTTTTACCAG CTCTGTGCTG CTGCCGGTCT  1100
TCCAGAATTT AAAGAGCTTG CACTAACAAG TGCAGAGGAC TTTTTCTATA  1150
CATCACAGGG AGGAGACACT TCCATCGAGG GTGTGGACGA TGCTGAGGAC  1200
TTTGAGAAGA CTCGACAAGC CTTCACACTC CTCGGAGTGA AGAGTCCCA   1250
TCAGATGAGC ATTTTAAGA TAATTGCTTC TATCTTGCAC CTTGGAAGTG  1300
TGGCGATTCA GGCTGAGCGT GATGGTGATT CCTGTAGTAT ATCACCCCAG  1350
GATGTATACC TAAGCAACTT CTGCCGACTG CTAGGGGTGG AGCACAGTCA  1400
GATGGAGCAC TGGCTGTGTC ATCGCAAGCT GGTCACCACC TCGGAGACCT  1450
ACGTCAAGAC CATGTCCCTG CAGCAGGTGA TCAATGCGCG CAACGCCCTG  1500
GCGAAGCACA TCTATGCCCA GTTGTTCGGC TGGATTGTGG AGCACATCAA  1550
CAAGGCCCTG CACACCTCCC TCAAGCAGCA CTCCTTCATC GGGGTCCTGG  1600
ACATCTATGG GTTTGAGACA TTTGAGGTAA ACAGCTTTGA GCAGTTCTGT  1650
ATCAACTATG CAAATGAAAA GCTCCAGCAG CAGTTCAACT CGCATGTTTT  1700
CAAACTGGAG CAAGAAGAAT ACATGAAGGA ACAGATCCCT TGGACCCTGA  1750
TTGATTTTTA TGATAACCAA CCTTGTATCG ACCTCATTGA AGCCAAGCTG  1800
GGTATCTTGG ACCTGTTGGA TGAAGAATGT AAGGTCCCCA AAGGAACTGA  1850
CCAGAACTGG GCTCAGAAGC TCTATGACCG GCACTCCAGC AGCCAGCACT  1900
TCCAGAAGCC CCGCATGTCC AACACGGCCT TCATCATCGT CCACTTTGCA  1950
GACAAGGTGG AGTACCTCTC TGATGGTTTT CTGGAGAAAA ACAGAGACAC  2000
GGTGTATGAA GAGCAGATCA ATATCCTGAA GGCCAGCAAG TTCCCACTAG  2050
TGGCTGACTT GTTTCATGAT GACAAGGACC CTGTTCCTGC CACCACCCT   2100
GGGAAGGGGT CATCTTCGAA GATCAGCGTC CGTTCTGCCA GACCCCCAT   2150
GAAAGTCTCC AACAAGGAGC ACAAGAAAAC CGTTGGCCAC CAGTTCCGTA  2200
CCTCCCTGCA TCTGCTCATG GAGACCCTGA ATGCCACGAC ACCTCACTAT  2250
GTCCGCTGCA TCAAGCCCAA CGATGAGAAG CTCCCCTTTC ACTTTGACCC  2300
AAAGAGAGCA GTGCAGCAAC TCAGAGCCTG CGGGGTGTTG GAGACGATTC  2350
GAATCAGTGC AGCTGGCTAC CCATCCAGGT GGGCCTACCA TGACTTTTTC  2400
AACCGGTATC GGGTGCTGGT CAAGAAGAGA GAGCTCGCCA ACACAGACAA  2450
AAAGGCCATC TGCAGGTCTG TCCTGGAGAA CCTCATCAAG GACCCCGACA  2500
AGTTCCAGTT TGGCCGCACC AAGATCTTCT TCGAGCAGG CCAGGTGGCC  2550
```

FIG. 45B

```
TACCTGGAGA AGCTGCGGGC TGACAAGTTC CGGACAGCCA CCATCATGAT   2600
CCAGAAAACT GTCCGGGGAT GGCTGCAGAA GGTGAAATAT CACAGGCTGA   2650
AGGGGGCTAC CTTAACCCTG CAGAGGTACT GCCGGGGACA CCTGGCCCGC   2700
AGGCTGGCTG AGCACCTGCG GAGGATCAGA GCGGCTGTGG TGCTCCAGAA   2750
ACATTACCGC ATGCAGAGGG CCCGCCAGGC CTACCAGAGG GTCCGCAGAG   2800
CTGCCGTTGT TATCCAGGCC TTCACCCGGG CCATGTTTGT GCGGAGAACC   2850
TACCGCCAGG TCCTCATGGA GCACAAGGCC ACCACCATCC AGAAGCACGT   2900
GCGGGGCTGG ATGGCACGCA GGCACTTCCA GCGGCTGCGG GATGCAGCCA   2950
TTGTCATCCA GTGTGCCTTC CGGATGCTCA AGGCCAGGCG GGAGCTGAAG   3000
GCCCTCAGGA TTGAGGCCCG CTCAGCAGAG CATCTGAAAC GTCTCAACGT   3050
GGGCATGGAG AACAAGGTGG TCCAGCTGCA GCGGAAGATC GATGAGCAGA   3100
ACAAAGAGTT CAAGACACTT TCAGAGCAGT TGTCCGTGAC CACCTCAACA   3150
TACACCATGG AGGTAGAGCG GCTGAAGAAG GAGCTGGTGC ACTACCAGCA   3200
GAGCCCAGGT GAGGACACCA GCCTCAGGCT GCAGGAGGAG GTGGAGAGCC   3250
TGCGCACAGA GCTGCAGAGG GCCCACTCGG AGCGCAAGAT CTTGGAGGAC   3300
GCCCACAGCA GGGAGAAAGA TGAGCTGAGG AAGCGAGTTG CAGACCTGGA   3350
GCAAGAAAAT GCTCTCTTGA AAGATGAGAA AGAACAGCTC AACAACCAAA   3400
TCCTGTGCCA GTCTAAAGAT GAATTTGCCC AGAACTCTGT GAAGGAAAAT   3450
CTCATGAAGA AAGAACTGGA GGAGGAGCGA TCCCGGTACC AGAACCTTGT   3500
GAAGGAATAT TCACAGTTGG AGCAGAGATA CGACAACCTT CGGGATGAAA   3550
TGACCATCAT AAAGCAAACT CCAGGTCATA GGCGGAACCC ATCAAACCAA   3600
AGTAGCTTAG AATCTGACTC CAATTACCCC TCCATCTCCA CATCTGAGAT   3650
CGGAGACACT GAGGATGCCC TCCAGCAGGT GGAGGAAATT GGCCTGGAGA   3700
AGGCAGCCAT GGACATGACG GTCTTCCTGA AGCTGCAGAA GAGAGTACGG   3750
GAGCTGGAGC AGGAGAGGAA AAAGCTGCAA GTGCAGCTGG AGAAGAGAGA   3800
ACAGCAGGAC AGCAAGAAAG TCCAGGCGGA ACCACCACAG ACTGACATAG   3850
ATTTGGACCC GAATGCAGAT CTGGCCTACA ATAGTCTGAA GAGGCAAGAG   3900
CTGGAGTCAG AGAACAAAAA GCTGAAGAAT GACCTGAATG AGCTGAGGAA   3950
AGCCGTGGCC GACCAAGCCA CGCAGAATAA CTCCAGCCAC GGCTCCCCAG   4000
ATAGCTACAG CCTCCTGCTG AACCAGCTCA AGCTGGCCCA CGAGGAGCTC   4050
GAGGTGCGCA AGGAGGAGGT GCTCATCCTC AGGACCCAGA TCGTGAGCGC   4100
CGACCAGCGG CGACTCGCCG GCAGGAACGC GGAGCCGAAC ATTAATGCCA   4150
GATCAAGTTG GCCTAACAGT GAAAAGCATG TTGACCAGGA GGATGCCATT   4200
GAGGCCTATC ACGGGGTCTG CCAGACAAAC AGCAAGACTG AGGATTGGGG   4250
ATATTTAAAT GAAGATGGAG AACTCGGCTT GGCCTACCAA GGCCTAAAGC   4300
AAGTTGCCAG GCTGCTGGAG GCTCAGCTGC AGGCCCAGAG CCTGGAGCAT   4350
GAGGAGGAGG TGGAGCATCT CAAGGCTCAG CTCGAGGCCC TGAAGGAGGA   4400
GATGGACAAA CAGCAGCAGA CCTTCTGCCA GACGCTACTG CTCTCCCCAG   4450
AGGCCCAGGT GGAATTCGGC GTTCAGCAGG AAATATCCCG GCTGACCAAC   4500
GAGAATCTGG ACCTTAAAGA ACTGGTAGAA AAGCTGGAAA AGAATGAGAG   4550
GAAGCTCAAA AAGCAACTGA AGATTTACAT GAAGAAAGCC CAGGACCTAG   4600
AAGCTGCCCA GGCATTGGCC CAGAGTGAGA GGAAGCGCCA TGAGCTCAAC   4650
AGGCAGGTCA CGGTCCAGCG GAAAGAGAAG GATTTCCAGG GCATGCTGGA   4700
GTACCACAAA GAGGACGAGG CCCTCCTCAT CCGGAACCTG GTGACAGACT   4750
TGAAGCCCCA GATGCTGTCG GGCACAGTGC CCTGTCTCCC CGCCTACATC   4800
CTCTACATGT GCATCCGGCA CGCGGACTAC ACCAACGACG ATCTCAAGGT   4850
GCACTCCCTG CTGACCTCCA CCATCAACGG CATTAAGAAA GTCCTGAAAA   4900
AGCACAATGA TGACTTTGAG ATGACGTCAT TCTGGTTATC CAACACCTGC   4950
CGCCTTCTTC ACTGTCTGAA GCAGTACAGC GGGGATGAGG GCTTCATGAC   5000
TCAGAACACT GCAAAGCAGA ATGAACACTG TCTTAAGAAT TTTGACCTCA   5050
CCGAATACCG TCAGGTGCTG AGTGACCTTT CCATTCAGAT CTACCAGCAG   5100
```

FIG. 45C

```
CTCATTAAAA TTGCCGAGGG CGTGTTACAG CCGATGATAG TTTCTGCCAT   5150
GTTGGAAAAT GAGAGCATTC AGGGTCTATC TGGTGTGAAG CCCACCGGCT   5200
ACCGGAAGCG CTCCTCCAGC ATGGCAGATG GGGATAACTC ATACTGCCTG   5250
GAAGCTATCA TCCGCCAGAT GAATGCCTTT CATACAGTCA TGTGTGACCA   5300
GGGCTTGGAC CCTGAGATCA TCCTGCAGGT ATTCAAACAG CTCTTCTACA   5350
TGATCAACGC AGTGACTCTT AACAACCTGC TCTTGCGGAA GGACGTCTGC   5400
TCTTGGAGCA CAGGCATGCA ACTCAGGTAC AATATAAGTC AGCTTGAGGA   5450
GTGGCTTCGG GGAAGAAACC TTCACCAGAG TGGAGCAGTT CAGACCATGG   5500
AACCTCTGAT CCAAGCAGCC CAGCTCCTGC AATTAAAGAA GAAAACCCAG   5550
GAGGACGCAG AGGCTATCTG CTCCCTGTGT ACCTCCCTCA GCACCCAGCA   5600
GATTGTCAAA ATTTTAAACC TTTATACTCC CCTGAATGAA TTTGAAGAAC   5650
GGGTAACAGT GGCCTTTATA CGAACAATCC AGGCACAACT ACAAGAGCGG   5700
AATGACCCTC AGCAACTGCT ATTAGATGCC AAGCACATGT TCCTGTTTT    5750
GTTCCATTT AATCCATCTT CTCTAACCAT GGACTCAATC CACATCCCAG    5800
CGTGTCTCAA TCTGGAATTC CTCAATGAAG TCTGAAGATG CATGTTTCCA   5850
GCATTAGTTT GATTCCCAAT GTGAGCAAGA AGGAAGTATA TACAGTAAAG   5900
TAAATTCAAG GATCTGTTAA ATCTGGTAAA AGTAGATCAA ATCAGAGATT   5950
GACAGCCTGT GGAGGGTGCT GAACTATACA GAATTAGACA CAACTATGTC   6000
ATTATTTTTT GTACCTACTG CTCAGAATAA AAACACTTGA AATATGGAAG   6050
ATTTAAGTT TGATTTCAGT CCAACACATA TACATAATTT ATAGACACCA    6100
AGCAGTCCCC ATAGACATAT AAAAGGTGTC AATTCTATAA AACGAAGCTG   6150
CCTAGTTTTG ATCTTTGCAT AGAACTAGAG AATGTCCAAA TTAAAATACC   6200
AAATATATAT AAGTCACATA AATTGCCTTC AAAGGGCTTT AACAAATAAT   6250
GGTACTAATA ACCATGATAA TGGCATATAC TGACATTTCC CAAAGTTTGC   6300
AAACCATAGG TGTGGTTGAG TTTGTGGTGA GATGTTTAA GAACAAAAAT    6350
ATGGGGATGA GACTTCTGAG AAATATTCCC AAAATATTTT TTAATGGCTG   6400
ATTATACACA GACAGTGGTG TAACTGACCT CCAGACCAGA CATTTTGAGT   6450
ACTGGTTTCT GAAGCAAAAT TAGAAGTGCC AGTCCTCAGT GTGCTCAAAC   6500
GCTTTTGTGT TATCTTGATT TAATGGAAGA GATTATTAAA ATGCTGCTAT   6550
CCCAAACTCC AAGTGAGAAA GATGGAAAAA TATTTTGTTT CTGATGCTAG   6600
TCCATACACT TTCCAAGTCC CACAAAACTT TCACAAAAAT GTATATAAGC   6650
TAAATATTAG AAACGGATAA CAAACTTGTT TTATTTATAG ATGTAAAAAC   6700
CAAACAAGTC AATATGAAAG CTTTTAATCT CTTAATACCA TTAAGCTTCC   6750
AGTAAGAGCA TCACATAATG CTCTACTGTT CCAGAAACCA AATAGTAAAA   6800
CAAACTAAAG TTCGCACATC AGATCATCTG AAAAACCTTC AAAAATAATC   6850
AGTTCAGGGA TATTATACAA AAGTTTGGGT TTTTTTTTT TAAGAGAATA    6900
AAATGGCTTA GGTCAACTTT CCCTTTTCAG GTTATTTTCA ACGTTTTTCA   6950
AATTTAGCAC ACAAAAAATT GTAAATATCT CTCCCACAAA ATAAGGATTT   7000
TAAAAAAGTA ATTCAGTAAT ATAACAGGCT TAGATGTTTG CTGCTCTTAG   7050
AATTTTTTTT AACTTGTTTT TGGTTCTTC AAAAGCAAGC ATTCAATTGG    7100
AAACCCATAT TCTTTCCACA CTTTTTTTA CTGTCTTTTC TGTATTTCTT    7150
GATAGCAGTA TGCTGTTCCC ATAAGAAAAA AATGGTATTT GCAAATCATG   7200
GAAGAACAGC CTCTGTATTA CATTGAGAAA ATAAGATTTA TCCATGAATT   7250
GGAAGTAGAA CAGCCTGCCT TCACCCTCTT TTACTCAACC ACCCAACTTA   7300
AAAGGCTCTT GGAAACACAG CACACTCCAC GCTACCTTCT GCACTGTGCC   7350
CTTAGAGCAC AGCTTCCTCA GTTGTTCTCT GCATCTCCTG GGGCTTAGGC   7400
CAGTCTTAGC CTGGGTTAAG GCTGCTGACA TTGTGTTCCA ATCAGTTGTC   7450
ATGGGCATTA TCCCCTCTAC ATCCACATTA AACATGCCGG CTTCTCTTGG   7500
GCATCGGCAG AGCTGTGCCT TTTTCTTTCA GTTACAGTTA CATAATCACT   7550
GACGTCCATG ACACTTACCC ATGGATCCAT GTGCTGACTT CATTTAGAAG   7600
GCCAATCTAA AACAACTGGG TTTGTGGCTA CCTCTTTAAA GTTGTTTGTG   7650
```

FIG. 45D

```
AAGGATAATT TGTTTTTTAA TGCACTTTAG TTTGAAAGTG AGTCTCTTAT   7700
GTAAGGACCA TCCTTAAAAG ACCAAAAATG CCTTGTTAGA GTGTTAAGGA   7750
GTTTTGACAT GCAGTGGTTC CACAAACACA GTGGCTTACT ATCCTTATAC   7800
ACTGTCTTAT ACCATCATTC TCTCCATCTC TCTTGGTCAC TACTCTCTGC   7850
TGTCACTGGT TAATCACTAG GTGCCAAGAG CTTACTGAAT AAAAGCTTGG   7900
CAATTAGAAT AAATGGGGAG GGAAGGACCT TATGAATAGT CCATTTAGCC   7950
TAAGAAATGG CAGATTTAGT TCTTCTCTTC CAAAAGATAA AGGTATATCC   8000
TGGAATTGTA CTTAAAACTT ACAGATGACT AACAAATATA TACTTTATAT   8050
GTAGTTAATA TTTAGATCTG TCTTATTTAA TACTTGGAGG CTAGAAGAAG   8100
CATCTTTAGG GGAACTATAT AATCTTTTGT TAGCATTTTC TCTGCATTTT   8150
AAAAAATCAT TTCAATTCAA ACATTATCA GTGTCATGAA ATCAGTAATG    8200
ACTCTTTAAC AATTCAGGTT TGAACTCTGC ATTAGATGTC TCTTTAATTT   8250
TTTAATATTT AAAATTTAGT TGACATTTTT TTCACCAGGT GCCTTTAGCG   8300
GTTACTAAGA TAACTGACAT CAGTTGTTTC TCTGAAATAA GTGTTGCTGT   8350
GGGAATAATT TTAATGTTCA AGGTGATATC ATGGGGGAGT TTTGTCTTTT   8400
AAAACATTAG AAGCATTTTA AATATTAAGA ATCAAATATT TATAGATCAA   8450
AACTTGTGTT TTAAGTATTA TACGGGACCT GTTTACTTAT AGTAAATGTG   8500
AATGTACACA TGAGTTGTTG CTGAAGCTGA CAAGCATATT ACATACATGC   8550
ATTTTCCCTG TGCCCTCATA GTTGCAGTTA GAGTTCCAGT ACCTGTAGGC   8600
TCACCTGGGA GGCAGATTAG ACCCAAAGGT AGATGTTTTT CCCCTTTCCA   8650
TGAAGCATGT CAGTGGGAGT TGCTTCCTTT GATTCCCTA GTACTAAATT    8700
TTAAGGCTTT TGTAAAAACA AAACAAAACT AGGAGCTTGG AACAGTTAAA   8750
AATCAACACT GCTACCATCA ATTCATCAAA TATTTACTTA GAGCTTTCAT   8800
ACATTAAGAT TCCAGTAACC AATAAATTAG AATTCATTTC TTCTGCATAA   8850
AGTAAATTTT CATACACTTG ACCTACTAAG ACAGCAAGGG TGTCCTAAAT   8900
TGAGGCATTT GTATAATGCC TGCATAACTA AATGGTCACT AAAATGGGAC   8950
AGCATGGGGC AAGACCTTGT AGTTCTTCAC AGAATATTTG TGGTCAGTTT   9000
CTCCAATTAA TTTGCTGCAT GAGCCAAATA ACCATAATTC ACTTTTTATA   9050
CCCACTGGTG CCATAATTAG AGAATTAGAG GGTGTAGACA GAGGTTAATG   9100
CCAATGAGAA ACACAGGACA GGGTTTTTTT TATTATAAAG GTCATTAGAT   9150
ACAAAAGATT GTTTTCAAA AAATTTCTAA TTCTAACAAA GGGGATCAAT    9200
CAGAAATGAA ACTAAGCTAC TTTCTAAAGT GACACTGTAT CAGAATAATC   9250
CAGATTTGAA TATAACATTT TGCCACCAAC TGACATTTAG ATGAAGGACT   9300
GCCTCTCTGA AAGAGTTCAG ATCATATTCA GGGGTGAATC CAACACCATG   9350
GAAGAAAGAC TACTGATGAA AATATTTTCC CACTTTGCAC AAATCTGTAA   9400
ACTACACCTT TGTTTATAGA AAAATGCTTG TAATAGTCAC TGTAATATTT   9450
AGCTGTGGAT AAAAATTTGT GGAAATAAAT ACTTTTGAAT AAAGAGGTGT   9500
GCCAAATCTA AATGAAATTT (SEQ ID NO: 45)
```

FIG. 46

```
MSVGELYSQCTRVWIPDPDEVWRSAELTKDYKEGDKSLQLRLEDETILEYPIDVQRNQLP
FLRNPDILVGENDLTALSYLHEPAVLHNLKVRFLESNHIYTYCGIVLVAINPYEQLPIYG
QDVIYTYSGQNMGDMDPHIFAVAEEAYKQMARDEKNQSIIVSGESGAGKTVSAKYAMRYF
ATVGGSASETNIEEKVLASSPIMEAIGNAKTTRNDNSSRFGKYIQIGFDKRYHIIGANMR
TYLLEKSRVVFQADDERNYHIFYQLCAAAGLPEFKELALTSAEDFFYTSQGGDTSIEGVD
DAEDFEKTRQAFTLLGVKESHQMSIFKIIASILHLGSVAIQAERDGDSCSISPQDVYLSN
FCRLLGVEHSQMEHWLCHRKLVTTSETYVKTMSLQQVINARNALAKHIYAQLFGWIVEHI
NKALHTSLKQHSFIGVLDIYGFETFEVNSFEQFCINYANEKLQQQFNSHVFKLEQEEYMK
EQIPWTLIDFYDNQPCIDLIEAKLGILDLLDEECKVPKGTDQNWAQKLYDRHSSSQHFQK
PRMSNTAFIIVHFADKVEYLSDGFLEKNRDTVYEEQINILKASKFPLVADLFHDDKDPVP
ATTPGKGSSSKISVRSARPPMKVSNKEHKKTVGHQFRTSLHLLMETLNATTPHYVRCIKP
NDEKLPFHFDPKRAVQQLRACGVLETIRISAAGYPSRWAYHDFFNRYRVLVKKRELANTD
KKAICRSVLENLIKDPDKFQFGRTKIFFRAGQVAYLEKLRADKFRTATIMIQKTVRGWLQ
KVKYHRLKGATLTLQRYCRGHLARRLAEHLRRIRAAVVLQKHYRMQRARQAYQRVRRAAV
VIQAFTRAMFVRRTYRQVLMEHKATTIQKHVRGWMARRHFQRLRDAAIVIQCAFRMLKAR
RELKALRIEARSAEHLKRLNVGMENKVVQLQRKIDEQNKEFKTLSEQLSVTTSTYTMEVE
RLKKELVHYQQSPGEDTSLRLQEEVESLRTELQRAHSERKILEDAHSREKDELRKRVADL
EQENALLKDEKEQLNNQILCQSKDEFAQNSVKENLMKKELEEERSRYQNLVKEYSQLEQR
YDNLRDEMTIIKQTPGHRRNPSNQSSLESDSNYPSISTSEIGDTEDALQQVEEIGLEKAA
MDMTVFLKLQKRVRELEQERKKLQVQLEKREQQDSKKVQAEPPQTDIDLDPNADLAYNSL
KRQELESENKKLKNDLNELRKAVADQATQNNSSHGSPDSYSLLLNQLKLAHEELEVRKEE
VLILRTQIVSADQRRLAGRNAEPNINARSSWPNSEKHVDQEDAIEAYHGVCQTNSKTEDW
GYLNEDGELGLAYQGLKQVARLLEAQLQAQSLEHEEEVEHLKAQLEALKEEMDKQQQTFC
QTLLLSPEAQVEFGVQQEISRLTNENLDLKELVEKLEKNERKLKKQLKIYMKKAQDLEAA
QALAQSERKRHELNRQVTVQRKEKDFQGMLEYHKEDEALLIRNLVTDLKPQMLSGTVPCL
PAYILYMCIRHADYTNDDLKVHSLLTSTINGIKKVLKKHNDDFEMTSFWLSNTCRLLHCL
KQYSGDEGFMTQNTAKQNEHCLKNFDLTEYRQVLSDLSIQIYQQLIKIAEGVLQPMIVSA
MLENESIQGLSGVKPTGYRKRSSSMADGDNSYCLEAIIRQMNAFHTVMCDQGLDPEIILQ
VFKQLFYMINAVTLNNLLLRKDVCSWSTGMQLRYNISQLEEWLRGRNLHQSGAVQTMEPL
IQAAQLLQLKKKTQEDAEAICSLCTSLSTQQIVKILNLYTPLNEFEERVTVAFIRTIQAQ
LQERNDPQQLLLDAKHMFPVLFPFNPSSLTMDSIHIPACLNLEFLNEV-
(SEQ ID NO: 46)
```

FIG. 47A

```
TTTGAGCAGT TCGTGTGGGT CCGCTCCCAA GCTAGGGCTG GGCTGTTGCG    50
CTTGCGCCAG GGGTCGCATG CAGTCACGCG CTGCCGACCG CTTCCGGTGC   100
GCCGCGAGGG CCGCCGGGAC GGGTCTCCCT GGCGATCCGT GGTGTGCCGC   150
TACTGCCGGT GCAGCCGCCA AACCGGTGCC TCGGTGACGA CCGTGTCCCT   200
GCCGTCTTCC TCGAGCTCCC CGGGGCTTGA CCCCCGGGGC CCTCGGCAGG   250
CATCGGTGAG GAGCCTGCGG AGCGAACCTG TGCTCCTATT CTTGCCCTTC   300
AGGACCCCAT ATCGCGACTC CGAGGAGGGG AAGCGAGAGG GGCTGTCGCG   350
ACTCCGCGCC GTGTGTCGCC GGGCGGGGCC GCGGGGCCGG GGCTCCTTCA   400
GCCCCCGGGA TGCGCGCGCG AGCCCTCGCC TCCACTTCCT TGTTGCTGCT   450
GTCACGACTG GAGCCGCCTC TCGCCGACAG CGGGGAGCGC GAGTGCGCCA   500
GCCATCCCCC TCGTCCAGCC GCCGGGCCAA GCGCCTCCGG AATGTGAGC    550
GGCGCAGCTT GCACGCTCCT CCGGCCATGG ACGCATCATA TGATGGTACT   600
GAGGTAACTG TCGTGATGGA GGAAATTGAG GAAGCCTATT GTTACACCTC   650
TCCTGGGCCA CCCAAGAAGA AGAAAAAGTA TAAAATACAT GGAGAAAAGA   700
CAAAGAAACC CAGGTCTGCT TACCTTCTGT ACTATTACGA CATCTACCTG   750
AAAGTGCAGC AGGAGCTCCC CCACCTCCCT CAGTCTGAGA TCAATAAGAA   800
GATTAGTGAG AGTTGGAGGC TTCTCAGCGT GGCCGAGAGG AGTTACTACT   850
TGGAGAAAGC CAAACTAGAG AAGGAAGGTT TGGATCCTAA CTCTAAGCTC   900
TCTGCACTGA CTGCTGTGGT TCCGGACATC CCAGGTTTCC GCAAGATCCT   950
CCCACGCTCA GATTATATCA TCATCCCCAA GAGCAGCCTG CAGGAGGACC  1000
GGAGCTGCCC TCAGCTAGAG CTATGTGTGG CTCAGAACCA GATGTCCCCG  1050
AAAGGACCTC CTCTTGTGTC CAACACTGCC CCGGAGACAG TGCCCAGCCA  1100
TGCAGGCATG GCAGAGCAGT GCCTGGCTGT GGAGGCCCTG GCTGAGGAGG  1150
TGGGAGCCCT TACCCAGTCA GGTGCTGTAC AGGAGATTGC CACCTCAGAG  1200
ATCCTCAGCC AGGATGTGCT CCTAGAGGAC GCTTCCCTAG AAGTAGGGGA  1250
GAGCCACCAA CCTTACCAGA CAAGCCTGGT AATTGAAGAG ACCTTGGTGA  1300
ATGGCTCACC AGACCTCCCC ACTGGAAGCC TGGCTGTGCC CCACCCCCAG  1350
GTTGGGGAGA GTGTATCAGT GGTAACAGTC ATGAGGGATT CCAGTGAGAG  1400
TAGCTCCTCT GCACCAGCCA CACAGTTCAT CATGTTGCCT CTGCCTGCCT  1450
ACTCGGTTGT GGAGAACCCC ACCTCCATCA AACTGACCAC TACATATACC  1500
CGCCGGGGCC ATGGGACATG CACCAGCCCA GGGTGCTCCT TTACATATGT  1550
CACCAGGCAC AAGCCACCTA AGTGCCCTAC CTGTGGTAAC TTCCTAGGAG  1600
GGAAGTGGAT CCCAAAGGAA AAGCCAGCCA AAGTAAAAGT GGAATTGGCT  1650
TCTGGCGTCT CTTCCAAAGG CTCTGTGGTG AAAAGAAATC AGCAACCTGT  1700
CACCACTGAG CAAAATTCCT CTAAGGAAAA TGCCTCCAAA CTGACTCTGG  1750
AGAATTCGGA AGCTGTAAGC CAGCTCCTGA ACGTAGCTCC TCCCAGAGAA  1800
GTAGGTGAGG AGAGTGAGTG GGAGGAAGTG ATCATCTCCG ATGCCCATGT  1850
TTTGGTTAAG GAAGCTCCCG GGAATTGTGG TACAGCAGTC ACTAAGACGC  1900
CAGTCGTCAA AAGTGGTGTG CAGCCTGAGG TCACTCTGGG GACAACTGAC  1950
AATGACAGTC CTGGAGCAGA CGTACCAACA CCATCCGAGG GGACAAGTAC  2000
CTCCAGTCCA CTCCCTGCTC CTAAAAAACC TACAGGAGtT GACCTGCTTA  2050
CCCCTGGGTC CAGAGCTCCA GAGCTTAAAG GCAGAGCACG GGCAAGCCC   2100
TCATTACTGG CTGCAGCAAG ACCCATGAGA GCAATTTTGC CAGCCCCAGT  2150
TAACGTGGGG CGAGGCAGCA GCATGGGACT GCCCAGGGCC AGGCAGGCCT  2200
TTTCCCTGAG TGATAAGACT CCCTCTGTGA GGACTTGTGG TCTGAAGCCA  2250
AGCACACTGA AGCAGCTGGG CCAGCCCATT CAACAGCCAT CTGGCCCTGG  2300
TGAGGTGAAG CTACCAAGTG GCCCATCCAA CAGGACTTCT CAGGTGAAAG  2350
TTGTGGAGGT CAAGCCCGAT ATGTTTCCTC CATATAAGTA CAGCTGCACT  2400
GTCACATTGG ATTTGGGCCT GGCTACATCA AGAGGCCGGG AAAGTGCAA   2450
GAATCCCTCT TGTAGCTATG TCTACACCAA CAGGCACAAA CCTCGAATTT  2500
GTCCCAGCTG TGGTGTTAAC CTTGCCAAAG ACCGGACTGA GAAAACCACC  2550
```

FIG. 47B

```
AAGGCTATCG AGGTGAGCTC ACCACTCCCA GATGTACTGA ATGCCACAGA  2600
GCCCCTGAGC ACAGCCCAGA GGGAGATCCA GCGCCAGTCC ACACTGCAGC  2650
TGCTGCGCAA AGTCCTGCAG ATTCCTGAGA ATGAGTCAGA GCTGGCTGAG  2700
GTCTTCGCCT TGATTCATGA ACTAACAGC  TCTCGACTTA TCTTGTCCAA  2750
CGTGAGTGAG GAGACAGTCA CCATCGAGCA AACCTCTTGG TCGAATTATT  2800
ATGAGTCTCC GTCCACGCAG TGCCTTCTCT GTAGCAGCCC ATTATTCAAA  2850
GGGGGACAAA ACTCCCTGGC TGGGCCCAG  GAGTGCTGGC TGCTGACAGC  2900
CAGCCGTCTG CAGACAGTGA CTGCCCAGGT GAAGATGTGT CTGAACCCCC  2950
ATTGTCTGGC CCTGCACAGC TTCATAGACA TCTACACAGG TCTCTTTAAT  3000
GTGGGGAACA AGCTGCTGGT AAGCCTGGAC TTGCTTTTTG CAATCAGAAA  3050
TCAGATCAAG CTCGGAGAGG ACCCCAGAGT GTCCATCAAT GTTGTTCTGA  3100
AGTCGGTGCA GGAGCAGACA GAGAAGACTC TGACCTCGGA GGAGCTGAGC  3150
CAGCTGCAGG AGCTGCTGTG CAATGGCTAT TGGGCCTTTG AGTGCCTCAC  3200
TGTCCGAGAC TACAATGACA TGATCTGTGG CATCTGTGGT GTGGCCCCCA  3250
AAGTGGAAAT GGCTCAGAGG AGTGAAGAGA ATGTGCTAGC ACTGAAGAGC  3300
GTGGAGTTCA CCTGGCCTGA ATTCCTGGGC TCTAATGAGG TAAATGTGGA  3350
GGACTTTTGG GCCACGATGG AGACAGAGGT GATTGAGCAG GTGGCATTTC  3400
CTGCCAGCAT CCCTATCACC AAATTTGATG CGTCTGTTAT TGCCCCCTTC  3450
TTCCCACCAC TCATGAGAGG AGCTGTGGTC GTCAACACTG AGAAAGACAA  3500
AAACCTGGAT GTGCAGCCAG TACCTGGCAG TGGCAGTGCC TTGGTGAGGC  3550
TGCTCCAGGA GGGCACCTGC AAGCTTGATG AGATTGGCTC CTACAGTGAA  3600
GAGAAGCTGC AGCACCTGCT AAGGCAGTGT GGAATCCCCT TTGGGGCAGA  3650
AGACTCCAAG GACCAGCTCT GCTTCTCCTT GTTGGCCCTC TACGAATCTG  3700
TACAGAATGG AGCTAGAGCT ATACGGCCCC CACGTCACTT CACAGGTGGT  3750
AAAATCTACA AGGTGTGCCC CCATCAGGTG GTCTGCGGCT CCAAGTATCT  3800
TGTGCGAGGT GAGAGTGCCC GTGACCATGT GGACCTGCTT GCCTCTTCCC  3850
GCCACTGGCC GCCTGTCTAT GTGGTAGATA TGGCCACGTC AGTGGCCCTG  3900
TGTGCTGACC TCTGCTACCC AGAGCTGACT AACCAGATGT GGGGGAGGAA  3950
CCAGGGCTGT TTCTCTAGCC CCACAGAGCC ACCTGTGAGT GTGTCCTGCC  4000
CAGAGCTCTT GGACCAGCAT TATACTGTGG ACATGACAGA AACTGAGCAC  4050
TCTATCCAGC ACCCAGTCAC CAAGACTGCC ACGCGGCGCA TCGTCCATGC  4100
AGGCCTACAG CCCAATCCTG GTGACCCAG  TGCTGGGCAC CACTCCTTGG  4150
CCCTGTGCCC TGAATTGGCA CCTTACGCAA CCATCCTGGC CTCCATCGTG  4200
GACAGCAAAC CAAACGGTGT CCGCCAGCGG CCCATTGCCT TCGACAATGC  4250
CACTCACTAT TACCTCTACA ACCGCCTCAT GGACTTCCTC ACCAGCCGCG  4300
AAATTGTCAA TCGTCAGATC CATGACATTG TACAGAGCTG CCAGCCTGGT  4350
GAGGTGGTCA TTCGTGACAC CCTCTACCGC CTTGGGGTTG CTCAGATCAA  4400
GACAGAGACA GAGGAGGAGG GTGAGGAAGA GGAGGTGGCC GCAGTGGCAG  4450
AATAAGCCAG GCTGTTGTAC AGGGACTACA CCATCTCTCA AGCCATAGTA  4500
AGGCCCTTGC CTGAGGCAGA GCTATCCAGG GGACCTGCAG AAGTGGTCTC  4550
CTGTGGGGAG GGCCTCTGAC TGCTGGGACT GACCAAAGAG CTTCCATTCC  4600
CTGAGCATGG TGGGACCCAG GGTCCTCAGT TCTCAACCCT CCAGGGGTCA  4650
GGAGTGGTAC CAGGAAACCT CTTCTGGCCC CGAGAGAGCA CTTGGGGGAC  4700
ACGGTATGTT TAATGGAGGG GAGGCTGAGG GAAAGGCTCG TAGCTGGTGG  4750
GTTCCGTGGG GCCTGCGGTG TGGGTCAGGG TGGAGGTCCT GGGTGGGCTA  4800
AGGCGTGAGC CCCAGCACTA GGTGGGAAGG CTGCTGAGGT CTCTCCCACC  4850
CCTGAGGAGC CCTGGTTTCA GCCCCCTCAG TCTGATGAAT TGCTTAGCCT  4900
GTTGCCTTTG ACTAGGGGCC TGGGTGGCCT CATTAACTCT AGGGGTCCCT  4950
TTGGGCTCTT GATTCTCCCT GAAGGAGGGA TGCATTTCTC TCTTGCTCTT  5000
CCTGTACCCA CATTTGGGGG AAGCTGAGGA GGGAGGAACA GTCAGCCACA  5050
GCTCTCTTCC AGCACTGTCC TCTCCACCCC AAGCTTTGAG GAAGAGCATC  5100
```

FIG. 47C

```
CCCTTCCTCC TTTCCCTGGC CACTGCTGCT GCAGCCAATA TCCTCTCTGG    5150
GCCTGGGACC CTCTCCACAG AGGGGATGTG GTCCCTGGTC ATGACATAAC    5200
CTAGCAGCAG TAGGAAAAAC TCCCTTCTAT GAAGGGGAAG CAGACTGGGC    5250
CATAAGGAAA CAGCAGGACT GGCTCAAGTG CCCAAGGTTT GTTTAGGGCC    5300
TGGGAATTGG CCATGTGTTA ATTATTGAG  TGGAGTAGGT GGCTTTTTTT    5350
CCCTCCCTCT TCCCCCAACA AGAATAAAGT TTATTAAATT ATCTGGTTTT    5400
GGTGTAaaaa aaaaaaaaaa aa (SEQ ID NO: 47)
```

FIG. 48

```
MDASYDGTEVTVVMEEIEEAYCYTSPGPPKKKKKYKIHGEKTKKPRSAYLLYYYDIYLKV
QQELPHLPQSEINKKISESWRLLSVAERSYYLEKAKLEKEGLDPNSKLSALTAVVPDIPG
FRKILPRSDYIIIPKSSLQEDRSCPQLELCVAQNQMSPKGPPLVSNTAPETVPSHAGMAE
QCLAVEALAEEVGALTQSGAVQEIATSEILSQDVLLEDASLEVGESHQPYQTSLVIEETL
VNGSPDLPTGSLAVPHPQVGESVSVVTVMRDSSESSSAPATQFIMLPLPAYSVVENPTS
IKLTTTYTRRGHGTCTSPGCSFTYVTRHKPPKCPTCGNFLGGKWIPKEKPAKVKVELASG
VSSKGSVVKRNQQPVTTEQNSSKENASKLTLENSEAVSQLLNVAPPREVGEESEWEEVII
SDAHVLVKEAPGNCGTAVTKTPVVKSGVQPEVTLGTTDNDSPGADVPTPSEGTSTSSPLP
APKKPTGVDLLTPGSRAPELKGRARGKPSLLAAARPMRAILPAPVNVGRGSSMGLPRARQ
AFSLSDKTPSVRTCGLKPSTLKQLGQPIQQPSGPGEVKLPSGPSNRTSQVKVVEVKPDMF
PPYKYSCTVTLDLGLATSRGRGKCKNPSCSYVYTNRHKPRICPSCGVNLAKDRTEKTTKA
IEVSSPLPDVLNATEPLSTAQREIQRQSTLQLLRKVLQIPENESELAEVFALIHELNSSR
LILSNVSEETVTIEQTSWSNYYESPSTQCLLCSSPLFKGGQNSLAGPQECWLLTASRLQT
VTAQVKMCLNPHCLALHSFIDIYTGLFNVGNKLLVSLDLLFAIRNQIKLGEDPRVSINVV
LKSVQEQTEKTLTSEELSQLQELLCNGYWAFECLTVRDYNDMICGICGVAPKVEMAQRSE
ENVLALKSVEFTWPEFLGSNEVNVEDFWATMETEVIEQVAFPASIPITKFDASVIAPFFP
PLMRGAVVVNTEKDKNLDVQPVPGSGSALVRLLQEGTCKLDEIGSYSEEKLQHLLRQCGI
PFGAEDSKDQLCFSLLALYESVQNGARAIRPPRHFTGGKIYKVCPHQVVCGSKYLVRGES
ARDHVDLLASSRHWPPVYVVDMATSVALCADLCYPELTNQMWGRNQGCFSSPTEPPVSVS
CPELLDQHYTVDMTETEHSIQHPVTKTATRRIVHAGLQPNPGDPSAGHHSLALCPELAPY
ATILASIVDSKPNGVRQRPIAFDNATHYYLYNRLMDFLTSREIVNRQIHDIVQSCQPGEV
VIRDTLYRLGVAQIKTETEEEGEEEEVAAVAE- (SEQ ID NO: 48)
```

FIG. 49A

```
AGGCCAGCCG GCGCCCGCGC GGACACTTTC AGCCCCGAGC CGCGGCCGCT  50
CGGGTCGGAC CCACGCGCAG CGGCCGGAGA TGCAGCGGGG CGCCGCGCTG  100
TGCCTGCGAC TGTGGCTCTG CCTGGGACTC CTGGACGGCC TGGTGAGTGG  150
CTACTCCATG ACCCCCCCGA CCTTGAACAT CACGGAGGAG TCACACGTCA  200
TCGACACCGG TGACAGCCTG TCCATCTCCT GCAGGGACA GCACCCCCTC   250
GAGTGGGCTT GGCCAGGAGC TCAGGAGGCG CCAGCCACCG GAGACAAGGA  300
CAGCGAGGAC ACGGGGGTGG TGCGAGACTG CGAGGGCACA GACGCCAGGC  350
CCTACTGCAA GGTGTTGCTG CTGCACGAGG TACATGCCAA CGACACAGGC  400
AGCTACGTCT GCTACTACAA GTACATCAAG GCACGCATCG AGGGCACCAC  450
GGCCGCCAGC TCCTACGTGT TCGTGAGAGA CTTTGAGCAG CCATTCATCA  500
ACAAGCCTGA CACGCTCTTG GTCAACAGGA AGGACGCCAT GTGGGTGCCC  550
TGTCTGGTGT CCATCCCCGG CCTCAATGTC ACGCTGCGCT CGCAAAGCTC  600
GGTGCTGTGG CCAGACGGGC AGGAGGTGGT GTGGGATGAC CGGCGGGGCA  650
TGCTCGTGTC CACGCCACTG CTGCACGATG CCCTGTACCT GCAGTGCGAG  700
ACCACCTGGG GAGACCAGGA CTTCCTTTCC AACCCCTTCC TGGTGCACAT  750
CACAGGCAAC GAGCTCTATG ACATCCAGCT GTTGCCCAGG AAGTCGCTGG  800
AGCTGCTGGT AGGGGAGAAG CTGGTCCTGA ACTGCACCGT GTGGGCTGAG  850
TTTAACTCAG GTGTCACCTT TGACTGGGAC TACCCAGGGA AGCAGGCAGA  900
GCGGGGTAAG TGGGTGCCCG AGCGACGCTC CCAGCAGACC CACACAGAAC  950
TCTCCAGCAT CCTGACCATC CACAACGTCA GCCAGCACGA CCTGGGCTCG  1000
TATGTGTGCA AGGCCAACAA CGGCATCCAG CGATTTCGGG AGAGCACCGA  1050
GGTCATTGTG CATGAAAATC CCTTCATCAG CGTCGAGTGG CTCAAAGGAC  1100
CCATCCTGGA GGCCACGGCA GGAGACGAGC TGGTGAAGCT GCCCGTGAAG  1150
CTGGCAGCGT ACCCCCCGCC CGAGTTCCAG TGGTACAAGG ATGGAAAGGC  1200
ACTGTCCGGG CGCCACAGTC CACATGCCCT GGTGCTCAAG GAGGTGACAG  1250
AGGCCAGCAC AGGCACCTAC ACCCTCGCCC TGTGGAACTC CGCTGCTGGC  1300
CTGAGGCGCA ACATCAGCCT GGAGCTGGTG GTGAATGTGC CCCCCCAGAT  1350
ACATGAGAAG GAGGCCTCCT CCCCCAGCAT CTACTCGCGT CACAGCCGCC  1400
AGGCCCTCAC CTGCACGGCC TACGGGGTGC CCCTGCCTCT CAGCATCCAG  1450
TGGCACTGGC GGCCCTGGAC ACCCTGCAAG ATGTTTGCCC AGCGTAGTCT  1500
CCGGCGGCGG CAGCAGCAAG ACCTCATGCC ACAGTGCCGT GACTGGAGGG  1550
CGGTGACCAC GCAGGATGCC GTGAACCCCA TCGAGAGCCT GGACACCTGG  1600
ACCGAGTTTG TGGAGGGAAA GAATAAGACT GTGAGCAAGC TGGTGATCCA  1650
GAATGCCAAC GTGTCTGCCA TGTACAAGTG TGTGGTCTCC AACAAGGTGG  1700
GCCAGGATGA GCGGCTCATC TACTTCTATG TGACCACCAT CCCCGACGGC  1750
TTCACCATCG AATCCAAGCC ATCCGAGGAG CTACTAGAGG GCCAGCCGGT  1800
GCTCCTGAGC TGCCAAGCCG ACAGCTACAA GTACGAGCAT CTGCGCTGGT  1850
ACCGCCTCAA CCTGTCCACG CTGCACGATG CGCACGGGAA CCCGCTTCTG  1900
CTCGACTGCA AGAACGTGCA TCTGTTCGCC ACCCCTCTGG CCGCCAGCCT  1950
GGAGGAGGTG GCACCTGGGG CGCGCCACGC CACGCTCAGC CTGAGTATCC  2000
CCCGCGTCGC GCCCGAGCAC GAGGGCCACT ATGTGTGCGA AGTGCAAGAC  2050
CGGCGCAGCC ATGACAAGCA CTGCCACAAG AAGTACCTGT CGGTGCAGGC  2100
CCTGGAAGCC CCTCGGCTCA CGCAGAACTT GACCGACCTC TGGTGAACG  2150
TGAGCGACTC GCTGGAGATG CAGTGCTTGG TGGCCGGAGC GCACGCGCCC  2200
AGCATCGTGT GGTACAAAGA CGAGAGGCTG CTGGAGGAAA AGTCTGGAGT  2250
CGACTTGGCG GACTCCAACC AGAAGCTGAG CATCCAGCGC GTGCGCGAGG  2300
AGGATGCGGG ACGCTATCTG TGCAGCGTGT GCAACGCCAA GGGCTGCGTC  2350
AACTCCTCCG CCAGCGTGGC CGTGGAAGGC TCCGAGGATA AGGGCAGCAT  2400
GGAGATCGTG ATCCTTGTCG GTACCGGCGT CATCGCTGTC TTCTTCTGGG  2450
TCCTCCTCCT CCTCATCTTC TGTAACATGA GGAGGCCGGC CCACGCAGAC  2500
ATCAAGACGG GCTACCTGTC CATCATCATG GACCCCGGGG AGGTGCCTCT  2550
```

FIG. 49B

```
GGAGGAGCAA TGCGAATACC TGTCCTACGA TGCCAGCCAG TGGGAATTCC  2600
CCCGAGAGCG GCTGCACCTG GGGAGAGTGC TCGGCTACGG CGCCTTCGGG  2650
AAGGTGGTGG AAGCCTCCGC TTTCGGCATC CACAAGGGCA GCAGCTGTGA  2700
CACCGTGGCC GTGAAAATGC TGAAAGAGGG CGCCACGGCC AGCGAGCACC  2750
GCGCGCTGAT GTCGGAGCTC AAGATCCTCA TTCACATCGG CAACCACCTC  2800
AACGTGGTCA ACCTCCTCGG GGCGTGCACC AAGCCGCAGG GCCCCCTCAT  2850
GGTGATCGTG GAGTTCTGCA AGTACGGCAA CCTCTCCAAC TTCCTGCGCG  2900
CCAAGCGGGA CGCCTTCAGC CCCTGCGCGG AGAAGTCTCC CGAGCAGCGC  2950
GGACGCTTCC GCGCCATGGT GGAGCTCGCC AGGCTGGATC GGAGGCGGCC  3000
GGGGAGCAGC GACAGGGTCC TCTTCGCGCG GTTCTCGAAG ACCGAGGGCG  3050
GAGCGAGGCG GGCTTCTCCA GACCAAGAAG CTGAGGACCT GTGGCTGAGC  3100
CCGCTGACCA TGGAAGATCT TGTCTGCTAC AGCTTCCAGG TGGCCAGAGG  3150
GATGGAGTTC CTGGCTTCCC GAAAGTGCAT CCACAGAGAC CTGGCTGCTC  3200
GGAACATTCT GCTGTCGGAA AGCGACGTGG TGAAGATCTG TGACTTTGGC  3250
CTTGCCCGGG ACATCTACAA AGACCCCGAC TACGTCCGCA AGGGCAGTGC  3300
CCGGCTGCCC CTGAAGTGGA TGGCCCCTGA AAGCATCTTC GACAAGGTGT  3350
ACACCACGCA GAGTGACGTG TGGTCCTTTG GGGTGCTTCT CTGGGAGATC  3400
TTCTCTCTGG GGGCCTCCCC GTACCCTGGG GTGCAGATCA ATGAGGAGTT  3450
CTGCCAGCGG CTGAGAGACG GCACAAGGAT GAGGGCCCCG GAGCTGGCCA  3500
CTCCCGCCAT ACGCCGCATC ATGCTGAACT GCTGGTCCGG AGACCCCAAG  3550
GCGAGACCTG CATTCTCGGA GCTGGTGGAG ATCCTGGGGG ACCTGCTCCA  3600
GGGCAGGGGC CTGCAAGAGG AAGAGGAGGT CTGCATGGCC CCGCGCAGCT  3650
CTCAGAGCTC AGAAGAGGGC AGCTTCTCGC AGGTGTCCAC CATGGCCCTA  3700
CACATCGCCC AGGCTGACGC TGAGGACAGC CCGCCAAGCC TGCAGCGCCA  3750
CAGCCTGGCC GCCAGGTATT ACAACTGGGT GTCCTTTCCC GGGTGCCTGG  3800
CCAGAGGGGC TGAGACCCGT GGTTCCTCCA GGATGAAGAC ATTTGAGGAA  3850
TTCCCCATGA CCCCAACGAC CTACAAAGGC TCTGTGGACA ACCAGACAGA  3900
CAGTGGGATG GTGCTGGCCT CGGAGGAGTT TGAGCAGATA GAGAGCAGGC  3950
ATAGACAAGA AAGCGGCTTC AGGTAGCTGA AGCAGAGAGA GAGAAGGCAG  4000
CATACGTCAG CATTTTCTTC TCTGCACTTA TAAGAAAGAT CAAAGACTTT  4050
AAGACTTTCG CTATTTCTTC TACTGCTATC TACTACAAAC TTCAAAGAGG  4100
AACCAGGAGG ACAAGAGGAG CATGAAAGTG GACAAGGAGT GTGACCACTG  4150
AAGCACCACA GGGAGGGGTT AGGCCTCCGG ATGACTGCGG GCAGGCCTGG  4200
ATAATATCCA GCCTCCCACA AGAAGCTGGT GGAGCAGAGT GTTCCCTGAC  4250
TCCTCCAAGG AAAGGGAGAC GCCCTTTCAT GGTCTGCTGA GTAACAGGTG  4300
CCTTCCCAGA CACTGGCGTT ACTGCTTGAC CAAAGAGCCC TCAAGCGGCC  4350
CTTATGCCAG CGTGACAGAG GGCTCACCTC TTGCCTTCTA GGTCACTTCT  4400
CACAATGTCC CTTCAGCACC TGACCCTGTG CCCACCAGTT ATTCCTTGGT  4450
AATATGAGTA ATACATCAAA GAGTAGTATT AAAAGCTAAT TAATCATGTT  4500
TATAaaaaaa aaaaaaaaaa aaaaaaaaaa aaaa (SEQ ID NO: 49)
```

FIG. 50

```
MQRGAALCLRLWLCLGLLDGLVSGYSMTPPTLNITEESHVIDTGDSLSISCRGQHPLEWA
WPGAQEAPATGDKDSEDTGVVRDCEGTDARPYCKVLLLHEVHANDTGSYVCYYKYIKARI
EGTTAASSYVFVRDFEQPFINKPDTLLVNRKDAMWVPCLVSIPGLNVTLRSQSSVLWPDG
QEVVWDDRRGMLVSTPLLHDALYLQCETTWGDQDFLSNPFLVHITGNELYDIQLLPRKSL
ELLVGEKLVLNCTVWAEFNSGVTFDWDYPGKQAERGKWVPERRSQQTHTELSSILTIHNV
SQHDLGSYVCKANNGIQRFRESTEVIVHENPFISVEWLKGPILEATAGDELVKLPVKLAA
YPPPEFQWYKDGKALSGRHSPHALVLKEVTEASTGTYTLALWNSAAGLRRNISLELVVNV
PPQIHEKEASSPSIYSRHSRQALTCTAYGVPLPLSIQWHWRPWTPCKMFAQRSLRRRQQQ
DLMPQCRDWRAVTTQDAVNPIESLDTWTEFVEGKNKTVSKLVIQNANVSAMYKCVVSNKV
GQDERLIYFYVTTIPDGFTIESKPSEELLEGQPVLLSCQADSYKYEHLRWYRLNLSTLHD
AHGNPLLLDCKNVHLFATPLAASLEEVAPGARHATLSLSIPRVAPEHEGHYVCEVQDRRS
HDKHCHKKYLSVQALEAPRLTQNLTDLLVNVSDSLEMQCLVAGAHAPSIVWYKDERLLEE
KSGVDLADSNQKLSIQRVREEDAGRYLCSVCNAKGCVNSSASVAVEGSEDKGSMEIVILV
GTGVIAVFFWVLLLLIFCNMRRPAHADIKTGYLSIIMDPGEVPLEEQCEYLSYDASQWEF
PRERLHLGRVLGYGAFGKVVEASAFGIHKGSSCDTVAVKMLKEGATASEHRALMSELKIL
IHIGNHLNVVNLLGACTKPQGPLMVIVEFCKYGNLSNFLRAKRDAFSPCAEKSPEQRGRF
RAMVELARLDRRRPGSSDRVLFARFSKTEGGARRASPDQEAEDLWLSPLTMEDLVCYSFQ
VARGMEFLASRKCIHRDLAARNILLSESDVVKICDFGLARDIYKDPDYVRKGSARLPLKW
MAPESIFDKVYTTQSDVWSFGVLLWEIFSLGASPYPGVQINEEFCQRLRDGTRMRAPELA
TPAIRRIMLNCWSGDPKARPAFSELVEILGDLLQGRGLQEEEEVCMAPRSSQSSEEGSFS
QVSTMALHIAQADAEDSPPSLQRHSLAARYYNWVSFPGCLARGAETRGSSRMKTFEEFPM
TPTTYKGSVDNQTDSGMVLASEEFEQIESRHRQESGFR-      (SEQ ID NO: 50)
```

FIG. 51A

```
CTGCTTCACT TCACGGGGCG AACATGGCGC ACAGCTGTCG GTGGCGCTTC  50
CCCGCCCGAC CCGGGACCAC CGGGGCGGC GGCGGCGGGG GGCGCCGGGG  100
CCTAGGGGGC GCCCCGCGGC AACGCGTCCC GGCCCTGCTG CTTCCCCCCG  150
GGCCCCCGGT CGGCGGTGGC GGCCCCGGGG CGCCCCCCTC CCCCCCGGCT  200
GTGGCGGCCG CGGCGGCGGC GGCGGGAAGC AGCGGGCTG GGGTTCCAGG  250
GGGAGCGGCC GCCGCCTCAG CAGCCTCCTC GTCGTCCGCC TCGTCTTCGT  300
CTTCGTCATC GTCCTCAGCC TCTTCAGGGC CGGCCCTGCT CCGGGTGGGC  350
CCGGGCTTCG ACGCGGCGCT GCAGGTCTCG GCCGCCATCG GCACCAACCT  400
GCGCCGGTTC CGGGCCGTGT TTGGGGAGAG CGGCGGGGGA GGCGGCAGCG  450
GAGAGGATGA GCAATTCTTA GGTTTTGGCT CAGATGAAGA AGTCAGAGTG  500
CGAAGTCCCA CAAGGTCTCC TTCAGTTAAA ACTAGTCCTC GAAAACCTCG  550
TGGGAGACCT AGAAGTGGCT CTGACCGAAA TTCAGCTATC CTCTCAGATC  600
CATCTGTGTT TTCCCCTCTA AATAAATCAG AGACCAAATC TGGAGATAAG  650
ATCAAGAAGA AAGATTCTAA AAGTATAGAA AAGAAGAGAG GAAGACCTCC  700
CACCTTCCCT GGAGTAAAAA TCAAAATAAC ACATGGAAAG GACATTTCAG  750
AGTTACCAAA GGGAAACAAA GAAGATAGCC TGAAAAAAAT TAAAAGGACA  800
CCTTCTGCTA CGTTTCAGCA AGCCACAAAG ATTAAAAAAT TAAGAGCAGG  850
TAAACTCTCT CCTCTCAAGT CTAAGTTTAA GACAGGGAAG CTTCAAATAG  900
GAAGGAAGGG GGTACAAATT GTACGACGGA GAGGAAGGCC TCCATCAACA  950
GAAAGGATAA AGACCCCTTC GGGTCTCCTC ATTAATTCTG AACTGGAAAA  1000
GCCCCAGAAA GTCCGGAAAG ACAAGGAAGG AACACCTCCA CTTACAAAAG  1050
AAGATAAGAC AGTTGTCAGA CAAAGCCCTC GAAGGATTAA GCCAGTTAGG  1100
ATTATTCCTT CTTCAAAAAG GACAGATGCA ACCATTGCTA AGCAACTCTT  1150
ACAGAGGGCA AAAAAGGGGG CTCAAAAGAA AATTGAAAAA GAAGCAGCTC  1200
AGCTGCAGGG AAGAAAGGTG AAGACACAGG TCAAAAATAT TCGACAGTTC  1250
ATCATGCCTG TTGTCAGTGC TATCTCCTCG GGATCATTA AGACCCCTCG  1300
GCGGTTTATA GAGGATGAGG ATTATGACCC TCCAATTAAA ATTGCCCGAT  1350
TAGAGTCTAC ACCGAATAGT AGATTCAGTG CCCCGTCCTG TGGATCTTCT  1400
GAAAAATCAA GTGCAGCTTC TCAGCACTCC TCTCAAATGT CTTCAGACTC  1450
CTCTCGATCT AGTAGCCCCA GTGTTGATAC CTCCACAGAC TCTCAGGCTT  1500
CTGAGGAGAT TCAGGTACTT CCTGAGGAGC GGAGCGATAC CCCTGAAGTT  1550
CATCCTCCAC TGCCCATTTC CCAGTCCCCA GAAAATGAGA GTAATGATAG  1600
GAGAAGCAGA AGGTATTCAG TGTCGGAGAG AAGTTTTGGA TCTAGAACGA  1650
CGAAAAAATT ATCAACTCTA CAAAGTGCCC CCCAGCAGCA GACCTCCTCG  1700
TCTCCACCTC CACCTCTGCT GACTCCACCG CCACCACTGC AGCCAGCCTC  1750
CAGTATCTCT GACCACACAC CTTGGCTTAT GCCTCCAACA ATCCCCTTAG  1800
CATCACCATT TTTGCCTGCT TCCACTGCTC CTATGCAAGG GAAGCGAAAA  1850
TCTATTTTGC GAGAACCGAC ATTTAGGTGG ACTTCTTTAA AGCATTCTAG  1900
GTCAGAGCCA CAATACTTTT CCTCAGCAAA GTATGCCAAA GAAGGTCTTA  1950
TTCGCAAACC AATATTTGAT AATTTCCGAC CCCTCCACT AACTCCCGAG  2000
GACGTTGGCT TTGCATCTGG TTTTTCTGCA TCTGGTACCG CTGCTTCAGC  2050
CCGATTGTTT TCGCCACTCC ATTCTGGAAC AAGGTTTGAT ATGCACAAAA  2100
GGAGCCCTCT TCTGAGAGCT CCAAGATTTA CTCCAAGTGA GGCTCACTCT  2150
AGAATATTTG AGTCTGTAAC CTTGCCTAGT AATCGAACTT CTGCTGGAAC  2200
ATCTTCTTCA GGAGTATCCA ATAGAAAAAG GAAAAGAAAA GTGTTTAGTC  2250
CTATTCGATC TGAACCAAGA TCTCCTTCTC ACTCCATGAG GACAAGAAGT  2300
GGAAGGCTTA GTAGTTCTGA GCTCTCACCT CTCACCCCCC CGTCTTCTGT  2350
CTCTTCCTCG TTAAGCATTT CTGTTAGTCC TCTTGCCACT AGTGCCTTAA  2400
ACCCAACTTT TACTTTTCCT TCTCATTCCC TGACTCAGTC TGGGGAATCT  2450
GCAGAGAAAA ATCAGAGACC AAGGAAGCAG ACTAGTGCTC CGGCAGAGCC  2500
```

FIG. 51B

```
ATTTTCATCA AGTAGTCCTA CTCCTCTCTT CCCTTGGTTT ACCCCAGGCT  2550
CTCAGACTGA AAGAGGGAGA AATAAAGACA AGGCCCCCGA GGAGCTGTCC  2600
AAAGATCGAG ATGCTGACAA GAGCGTGGAG AAGGACAAGA GTAGAGAGAG  2650
AGACCGGGAG AGAGAAAAGG AGAATAAGCG GGAGTCAAGG AAAGAGAAAA  2700
GGAAAAAGGG ATCAGAAATT CAGAGTAGTT CTGCTTTGTA TCCTGTGGGT  2750
AGGGTTTCCA AAGAGAAGGT TGTTGGTGAA GATGTTGCCA CTTCATCTTC  2800
TGCCAAAAAA GCAACAGGGC GGAAGAAGTC TTCATCACAT GATTCTGGGA  2850
CTGATATTAC TTCTGTGACT CTTGGGGATA CAACAGCTGT CAAAACCAAA  2900
ATACTTATAA AGAAGGGAG AGGAAATCTG GAAAAAACCA ACTTGGACCT   2950
CGGCCCAACT GCCCCATCCC TGGAGAAGGA GAAACCCTC TGCCTTTCCA   3000
CTCCTTCATC TAGCACTGTT AAACATTCCA CTTCCTCCAT AGGCTCCATG  3050
TTGGCTCAGG CAGACAAGCT TCCAATGACT GACAAGAGGG TTGCCAGCCT  3100
CCTAAAAAAG GCCAAAGCTC AGCTCTGCAA GATTGAGAAG AGTAAGAGTC  3150
TTAAACAAAC CGACCAGCCC AAAGCACAGG GTCAAGAAAG TGACTCATCA  3200
GAGACCTCTG TGCGAGGACC CCGGATTAAA CATGTCTGCA GAAGAGCAGC  3250
TGTTGCCCTT GGCCGAAAAC GAGCTGTGTT TCCTGATGAC ATGCCCACCC  3300
TGAGTGCCTT ACCATGGGAA GAACGAGAAA AGATTTTGTC TTCCATGGGG  3350
AATGATGACA AGTCATCAAT TGCTGGCTCA GAAGATGCTG AACCTCTTGC  3400
TCCACCCATC AAACCAATTA AACCTGTCAC TAGAAACAAG GCACCCCAGG  3450
AACCTCCAGT AAAGAAGGA CGTCGATCGA GGCGGTGTGG GCAGTGTCCC   3500
GGCTGCCAGG TGCCTGAGGA CTGTGGTGTT TGTACTAATT GCTTAGATAA  3550
GCCCAAGTTT GGTGGTCGCA ATATAAAGAA GCAGTGCTGC AAGATGAGAA  3600
AATGTCAGAA TCTACAATGG ATGCCTTCCA AAGCCTACCT GCAGAAGCAA  3650
GCTAAAGCTG TGAAAAGAA AGAGAAAAG TCTAAGACCA GTGAAAAGAA    3700
AGACAGCAAA GAGAGCAGTG TTGTGAAGAA CGTGGTGGAC TCTAGTCAGA  3750
AACCTACCCC ATCAGCAAGA GAGGATCCTG CCCCAAAGAA AAGCAGTAGT  3800
GAGCCTCCTC CACGAAAGCC CGTCGAGGAA AAGAGTGAAG AAGGGAATGT  3850
CTCGGCCCCT GGGCCTGAAT CCAAACAGGC CACCACTCCA GCTTCCAGGA  3900
AGTCAAGCAA GCAGGTCTCC CAGCCAGCAC TGGTCATCCC GCCTCAGCCA  3950
CCTACTACAG GACCGCCAAG AAAAGAAGTT CCCAAAACCA CTCCTAGTGA  4000
GCCCAAGAAA AAGCAGCCTC CACCACCAGA ATCAGGTCCA GAGCAGAGCA  4050
AACAGAAAAA AGTGGCTCCC CGCCCAAGTA TCCCTGTAAA ACAAAAACCA  4100
AAAGAAAAGG AAAAACCACC TCCGGTCAAT AAGCAGGAGA ATGCAGGCAC  4150
TTTGAACATC CTCAGCACTC TCTCCAATGG CAATAGTTCT AAGCAAAAAA  4200
TTCCAGCAGA TGGAGTCCAC AGGATCAGAG TGGACTTTAA GGAGGATTGT  4250
GAAGCAGAAA ATGTGTGGGA GATGGGAGGC TTAGGAATCT TGACTTCTGT  4300
TCCTATAACA CCCAGGGTGG TTTGCTTTCT CTGTGCCAGT AGTGGGCATG  4350
TAGAGTTTGT GTATTGCCAA GTCGTTGTG AGCCCTTCCA CAAGTTTTGT   4400
TTAGAGGAGA ACGAGCGCCC TCTGGAGGAC CAGCTGGAAA ATTGGTGTTG  4450
TCGTCGTTGC AAATTCTGTC ACGTTTGTGG AAGGCAACAT CAGGCTACAA  4500
AGCAGCTGCT GGAGTGTAAT AAGTGCCGAA ACAGCTATCA CCCTGAGTGC  4550
CTGGGACCAA ACTACCCCAC CAAACCCACA AAGAAGAAGA AAGTCTGGAT  4600
CTGTACCAAG TGTGTTCGCT GTAAGAGCTG TGGATCCACA ACTCCAGGCA  4650
AAGGGTGGGA TGCACAGTGG TCTCATGATT TCTCACTGTG TCATGATTGC  4700
GCCAAGCTCT TTGCTAAAGG AAACTTCTGC CCTCTCTGTG ACAAATGTTA  4750
TGATGATGAT GACTATGAGA GTAAGATGAT GCAATGTGGA AAGTGTGATC  4800
GCTGGGTCCA TTCCAAATGT GAGAATCTTT CAGATGAGAT GTATGAGATT  4850
CTATCTAATC TGCCAGAAAG TGTGGCCTAC ACTTGTGTGA ACTGTACTGA  4900
GCGGCACCCT GCAGAGTGGC GACTGGCCCT TGAAAAGAG CTGCAGATTT   4950
CTCTGAAGCA AGTTCTGACA GCTTTGTTGA ATTCTCGGAC TACCAGCCAT  5000
TTGCTACGCT ACCGGCAGGC TGCCAAGCCT CCAGACTTAA ATCCCGAGAC  5050
```

FIG. 51C

```
AGAGGAGAGT ATACCTTCCC GCAGCTCCCC CGAAGGACCT GATCCACCAG   5100
TTCTTACTGA GGTCAGCAAA CAGGATGATC AGCAGCCTTT AGATCTAGAA   5150
GGAGTCAAGA GGAAGATGGA CCAAGGGAAT TACACATCTG TGTTGGAGTT   5200
CAGTGATGAT ATTGTGAAGA TCATTCAAGC AGCCATTAAT TCAGATGGAG   5250
GACAGCCAGA AATTAAAAAA GCCAACAGCA TGGTCAAGTC CTTCTTCATT   5300
CGGCAAATGG AACGTGTTTT TCCATGGTTC AGTGTCAAAA AGTCCAGGTT   5350
TTGGGAGCCA AATAAAGTAT CAAGCAACAG TGGGATGTTA CCAAACGCAG   5400
TGCTTCCACC TTCACTTGAC CATAATTATG CTCAGTGGCA GGAGCGAGAG   5450
GAAAACAGCC ACACTGAGCA GCCTCCTTTA ATGAAGAAAA TCATTCCAGC   5500
TCCCAAACCC AAAGGTCCTG GAGAACCAGA CTCACCAACT CCTCTGCATC   5550
CTCCTACACC ACCAATTTTG AGTACTGATA GGAGTCGAGA AGACAGTCCA   5600
GAGCTGAACC CACCCCCAGG CATAGAAGAC AATAGACAGT GTGCGTTATG   5650
TTTGACTTAT GGTGATGACA GTGCTAATGA TGCTGGTCGT TTACTATATA   5700
TTGGCCAAAA TGAGTGGACA CATGTAAATT GTGCTTTGTG GTCAGCGGAA   5750
GTGTTTGAAG ATGATGACGG ATCACTAAAG AATGTGCATA TGGCTGTGAT   5800
CAGGGGCAAG CAGCTGAGAT GTGAATTCTG CCAAAAGCCA GGAGCCACCG   5850
TGGGTTGCTG TCTCACATCC TGCACCAGCA ACTATCACTT CATGTGTTCC   5900
CGAGCCAAGA ACTGTGTCTT TCTGGATGAT AAAAAAGTAT ATTGCCAACG   5950
ACATCGGGAT TTGATCAAAG GCGAAGTGGT TCCTGAGAAT GGATTTGAAG   6000
TTTTCAGAAG AGTGTTTGTG GACTTTGAAG GAATCAGCTT GAGAAGGAAG   6050
TTTCTCAATG GCTTGGAACC AGAAAATATC CACATGATGA TTGGGTCTAT   6100
GACAATCGAC TGCTTAGGAA TTCTAAATGA TCTCTCCGAC TGTGAAGATA   6150
AGCTCTTTCC TATTGGATAT CAGTGTTCCA GGGTATACTG GAGCACCACA   6200
GATGCTCGCA AGCGCTGTGT ATATACATGC AAGATAGTGG AGTGCCGTCC   6250
TCCAGTCGTA GAGCCGGATA TCAACAGCAC TGTTGAACAT GATGAAAACA   6300
GGACCATTGC CCATAGTCCA ACATCTTTTA CAGAAAGTTC ATCAAAAGAG   6350
AGTCAAAACA CAGCTGAAAT TATAAGTCCT CCATCACCAG ACCGACCTCC   6400
TCATTCACAA ACCTCTGGCT CCTGTTATTA TCATGTCATC TCAAAGGTCC   6450
CCAGGATTCG AACACCCAGT TATTCTCCAA CACAGAGATC CCCTGGCTGT   6500
CGACCGTTGC CTTCTGCAGG AAGTCCTACC CCAACCACTC ATGAAATAGT   6550
CACAGTAGGT GATCCTTTAC TCTCCTCTGG ACTTCGAAGC ATTGGCTCCA   6600
GGCGTCACAG TACCTCTTCC TTATCACCCC AGCGGTCCAA ACTCCGGATA   6650
ATGTCTCCAA TGAGAACTGG GAATACTTAC TCTAGGAATA ATGTTTCCTC   6700
AGTCTCCACC ACCGGGACCG CTACTGATCT TGAATCAAGT GCCAAAGTAG   6750
TTGATCATGT CTTAGGGCCA CTGAATTCAA GTACTAGTTT AGGGCAAAAC   6800
ACTTCCACCT CTTCAAATTT GCAAAGGACA GTGGTTACTG TAGGCAATAA   6850
AAACAGTCAC TTGGATGGAT CTTCATCTTC AGAAATGAAG CAGTCCAGTG   6900
CTTCAGACTT GGTGTCCAAG AGCCTCTCTT TAAAGGGAGA GAAGACCAAA   6950
GTGCTGAGTT CCAAGAGCTC AGAGGGATCT GCACATAATG TGGCTTACCC   7000
TGGAATTCCT AAACTGGCCC CACAGGTTCA TAACACAACA TCTAGAGAAC   7050
TGAATGTTAG TAAAATCGGC TCCTTTGCTG AACCCTCTTC AGTGTCGTTT   7100
TCTTCTAAAG AGGCCCTCTC CTTCCCACAC CTCCATTTGA GAGGGCAAAG   7150
GAATGATCGA GACCAACACA CAGATTCTAC CCAATCAGCA AACTCCTCTC   7200
CAGATGAAGA TACTGAAGTC AAAACCTTGA AGCTATCTGG AATGAGCAAC   7250
AGATCATCCA TTATCAACGA ACATATGGGA TCTAGTTCCA GAGATAGGAG   7300
ACAGAAAGGG AAAAAATCCT GTAAAGAAAC TTTCAAAGAA AAGCATTCCA   7350
GTAAATCTTT TTTGGAACCT GGTCAGGTGA CAACTGGTGA GGAAGGAAAC   7400
TTGAAGCCAG AGTTTATGGA TGAGGTTTTG ACTCCTGAGT ATATGGGCCA   7450
ACGACCATGT AACAATGTTT CTTCTGATAA GATTGGTGAT AAAGGCCTTT   7500
CTATGCCAGG AGTCCCCAAA GCTCCACCCA TGCAAGTAGA AGGATCTGCC   7550
AAGGAATTAC AGGCACCACG GAAACGCACA GTCAAAGTGA CACTGACACC   7600
```

FIG. 51D

```
TCTAAAAATG GAAAATGAGA GTCAATCCAA AAATGCCCTG AAAGAAAGTA  7650
GTCCTGCTTC CCCTTTGCAA ATAGAGTCAA CATCTCCCAC AGAACCAATT  7700
TCAGCCTCTG AAAATCCAGG AGATGGTCCA GTGGCCCAAC CAAGCCCCAA  7750
TAATACCTCA TGCCAGGATT CTCAAAGTAA CAACTATCAG AATCTTCCAG  7800
TACAGGACAG AAACCTAATG CTTCCAGATG GCCCAAACC  TCAGGAGGAT  7850
GGCTCTTTTA AAAGGAGGTA TCCCCGTCGC AGTGCCCGTG CACGTTCTAA  7900
CATGTTTTTT GGGCTTACCC CACTCTATGG AGTAAGATCC TATGGTGAAG  7950
AAGACATTCC ATTCTACAGC AGCTCAACTG GGAAGAAGCG AGGCAAGAGA  8000
TCAGCTGAAG GACAGGTGGA TGGGGCCGAT GACTTAAGCA CTTCAGATGA  8050
AGACGACTTA TACTATTACA ACTTCACTAG AACAGTGATT TCTTCAGGTG  8100
GAGAGGAACG ACTGGCATCC CATAATTTAT TTCGGGAGGA GGAACAGTGT  8150
GATCTTCCAA AAATCTCACA GTTGGATGGT GTTGATGATG GACAGAGAG  8200
TGATACTAGT GTCACAGCCA CAACAAGGAA AAGCAGCCAG ATTCCAAAAA  8250
GAAATGGTAA AGAAAATGGA ACAGAGAACT TAAAGATTGA TAGACCTGAA  8300
GATGCTGGGG AGAAAGAACA TGTCACTAAG AGTTCTGTTG GCCACAAAAA  8350
TGAGCCAAAG ATGGATAACT GCCATTCTGT AAGCAGAGTT AAAACACAGG  8400
GACAAGATTC CTTGGAAGCT CAGCTCAGCT CATTGGAGTC AAGCCGCAGA  8450
GTCCACACAA GTACCCCCTC CGACAAAAAT TTACTGGACA CCTATAATAC  8500
TGAGCTCCTG AAATCAGATT CAGACAATAA CAACAGTGAT GACTGTGGGA  8550
ATATCCTGCC TTCAGACATT ATGGACTTTG TACTAAAGAA TACTCCATCC  8600
ATGCAGGCTT TGGGTGAGAG CCCAGAGTCA TCTTCATCAG AACTCCTGAA  8650
TCTTGGTGAA GGATTGGGTC TTGACAGTAA TCGTGAAAAA GACATGGGTC  8700
TTTTTGAAGT ATTTCTCAG  CAGCTGCCTA CAACAGAACC TGTGGATAGT  8750
AGTGTCTCTT CCTCTATCTC AGCAGAGGAA CAGTTTGAGT TGCCTCTAGA  8800
GCTACCATCT GATCTGTCTG TCTTGACCAC CCGGAGTCCC ACTGTCCCCA  8850
GCCAGAATCC CAGTAGACTA GCTGTTATCT CAGACTCAGG GGAGAAGAGA  8900
GTAACCATCA CAGAAAAATC TGTAGCCTCC TCTGAAAGTG ACCCAGCACT  8950
GCTGAGCCCA GGAGTAGATC CAACTCCTGA AGGCCACATG ACTCCTGATC  9000
ATTTTATCCA AGGACACATG GATGCAGACC ACATCTCTAG CCCTCCTTGT  9050
GGTTCAGTAG AGCAAGGTCA TGGCAACAAT CAGGATTTAA CTAGGAACAG  9100
TAGCACCCCT GGCCTTCAGG TACCTGTTTC CCCAACTGTT CCCATCCAGA  9150
ACCAGAAGTA TGTGCCCAAT TCTACTGATA GTCCTGGCCC GTCTCAGATT  9200
TCCAATGCAG CTGTCCAGAC CACTCCACCC CACCTGAAGC CAGCCACTGA  9250
GAAACTCATA GTTGTTAACC AGAACATGCA GCCACTTTAT GTTCTCCAAA  9300
CTCTTCCAAA TGGAGTGACC CAAAAAATCC AATTGACCTC TTCTGTTAGT  9350
TCTACACCCA GTGTGATGGA GACAAATACT TCAGTATTGG GACCCATGGG  9400
AGGTGGTCTC ACCCTTACCA CAGGACTAAA TCCAAGCTTG CCAACTTCTC  9450
AATCTTTGTT CCCTTCTGCT AGCAAAGGAT TGCTACCCAT GTCTCATCAC  9500
CAGCACTTAC ATTCCTTCCC TGCAGCTACT CAAAGTAGTT TCCCACCAAA  9550
CATCAGCAAT CCTCCTTCAG GCCTGCTTAT TGGGGTTCAG CCTCCTCCGG  9600
ATCCCCAACT TTTGGTTTCA GAATCCAGCC AGAGGACAGA CCTCAGTACC  9650
ACAGTAGCCA CTCCATCCTC TGGACTCAAG AAAAGACCCA TATCTCGTCT  9700
ACAGACCCGA AAGAATAAAA AACTTGCTCC CTCTAGTACC CCTTCAAACA  9750
TTGCCCCTTC TGATGTGGTT TCTAATATGA CATTGATTAA CTTCACACCC  9800
TCCCAGCTTC CTAATCATCC AAGTCTGTTA GATTTGGGGT CACTTAATAC  9850
TTCATCTCAC CGAACTGTCC CCAACATCAT AAAAAGATCT AAATCTAGCA  9900
TCATGTATTT TGAACCGGCA CCCCTGTTAC CACAGAGTGT GGGAGGAACT  9950
GCTGCCACAG CGGCAGGCAC ATCAACAATA AGCCAGGATA CTAGCCACCT  10000
CACATCAGGG TCTGTGTCTG GCTTGGCATC CAGTTCCTCT GTCTTGAATG  10050
TTGTATCCAT GCAAACTACC ACAACCCCTA CAAGTAGTGC GTCAGTTCCA  10100
GGACACGTCA CCTTAACCAA CCCAAGGTTG CTTGGTACCC CAGATATTGG  10150
```

FIG. 51E

```
CTCAATAAGC AATCTTTTAA TCAAAGCTAG CCAGCAGAGC CTGGGGATTC  10200
AGGACCAGCC TGTGGCTTTA CCGCCAAGTT CAGGAATGTT TCCACAACTG  10250
GGGACATCAC AGACCCCCTC TACTGCTGCA ATAACAGCGG CATCTAGCAT  10300
CTGTGTGCTC CCCTCCACTC AGACTACGGG CATAACAGCC GCTTCACCTT  10350
CTGGGGAAGC AGACGAACAC TATCAGCTTC AGCATGTGAA CCAGCTCCTT  10400
GCCAGCAAAA CTGGGATTCA TTCTTCCCAG CGTGATCTTG ATTCTGCTTC  10450
AGGGCCCCAG GTATCCAACT TTACCCAGAC GGTAGACGCT CCTAATAGCA  10500
TGGGACTGGA GCAGAACAAG GCTTTATCCT CAGCTGTGCA AGCCAGCCCC  10550
ACCTCTCCTG GGGGTTCTCC ATCCTCTCCA TCTTCTGGAC AGCGGTCAGC  10600
AAGCCCTTCA GTGCCGGGTC CCACTAAACC CAAACCAAAA ACCAAACGGT  10650
TTCAGCTGCC TCTAGACAAA GGGAATGGCA AGAAGCACAA AGTTTCCCAT  10700
TTGCGGACCA GTTCTTCTGA AGCACACATT CCAGACCAAG AAACGACATC  10750
CCTGACCTCA GGCACAGGGA CTCCAGGAGC AGAGGCTGAG CAGCAGGATA  10800
CAGCTAGCGT GGAGCAGTCC TCCCAGAAGG AGTGTGGGCA ACCTGCAGGG  10850
CAAGTCGCTG TTCTTCCGGA AGTTCAGGTG ACCCAAAATC CAGCAAATGA  10900
ACAAGAAAGT GCAGAACCTA AAACAGTGGA AGAAGAGGAA AGTAATTTCA  10950
GCTCCCCACT GATGCTTTGG CTTCAGCAAG AACAAAAGCG GAAGGAAAGC  11000
ATTACTGAGA AAAAACCCAA GAAAGGACTT GTTTTTGAAA TTTCCAGTGA  11050
TGATGGCTTT CAGATCTGTG CAGAAAGTAT TGAAGATGCC TGGAAGTCAT  11100
TGACAGATAA AGTCCAGGAA GCTCGATCAA ATGCCCGCCT AAAGCAGCTC  11150
TCATTTGCAG GTGTTAACGG TTTGAGGATG CTGGGGATTC TCCATGATGC  11200
AGTTGTGTTC CTCATTGAGC AGCTGTCTGG TGCCAAGCAC TGTCGAAATT  11250
ACAAATTCCG TTTCCACAAG CCAGAGGAGG CCAATGAACC CCCCTTGAAC  11300
CCTCACGGCT CAGCCAGGGC TGAAGTCCAC CTCAGGAAGT CAGCATTTGA  11350
CATGTTTAAC TTCCTGGCTT CTAAACATCG TCAGCCTCCT GAATACAACC  11400
CCAATGATGA AGAAGAGGAG GAGGTACAGC TGAAGTCAGC TCGGAGGGCA  11450
ACTAGCATGG ATCTGCCAAT GCCCATGCGC TTCCGGCACT TAAAAAAGAC  11500
TTCTAAGGAG GCAGTTGGTG TCTACAGGTC TCCCATCCAT GGCCGGGGTC  11550
TTTTCTGTAA GAGAAACATT GATGCAGGTG AGATGGTGAT TGAGTATGCC  11600
GGCAACGTCA TCCGCTCCAT CCAGACTGAC AAGCGGGAAA AGTATTACGA  11650
CAGCAAGGGC ATTGGTTGCT ATATGTTCCG AATTGATGAC TCAGAGGTAG  11700
TGGATGCCAC CATGCATGGA AATGCTGCAC GCTTCATCAA TCACTCGTGT  11750
GAGCCTAACT GCTATTCTCG GGTCATCAAT ATTGATGGGC AGAAGCACAT  11800
TGTCATCTTT GCCATGCGTA AGATCTACCG AGGAGAGGAA CTCACTTACG  11850
ACTATAAGTT CCCCATTGAG GATGCCAGCA ACAAGCTGCC CTGCAACTGT  11900
GGCGCCAAGA AATGCCGGAA GTTCCTAAAC *TAA*AGCTGCT CTTCTCCCCC  11950
AGTGTTGGAG TGCAAGGAGG CGGGGCCATC CAAAGCAACG CTGAAGGCCT  12000
TTTCCAGCAG CTGGGAGCTC CCGGATTGCG TGGCACAGCT GAGGGGCCTC  12050
TGTGATGGCT GAGCTCTCTT ATGTCCTATA CTCACATCAG ACATGTGATC  12100
ATAGTCCCAG AGACAGAGTT GAGGTCTCGA AGAAAAGATC CATGATCGGC  12150
TTTCTCCTGG GGCCCCTCCA ATTGTTTACT GTTAGAAAGT GGGAATGGGG  12200
TCCCTAGCAG ACTTGCCTGG AAGGAGCCTA TTATAGAGGG TTGGTTATGT  12250
TGGGAGATTG GGCCTGAATT CTCCACAGA AATAAGTTGC CATCCTCAGG  12300
TTGGCCCTTT CCCAAGCACT GTAAGTGAGT GGGTCAGGCA AAGCCCCAAA  12350
TGGAGGGTTG GTTAGATTCC TGACAGTTTG CCAGCCAGGC CCCACCTACA  12400
GCGTCTGTCG AACAAACAGA GGTCTGGTGG TTTTCCCTAC TATCCTCCCA  12450
CTCGAGAGTT CACTTCTGGT TGGGAGACAG GATTCCTAGC ACCTCCGGTG  12500
TCAAAGGCT GTCATGGGGT TGTGCCAATT AATTACCAAA CATTGAGCCT  12550
GCAGGCTTTG AGTGGGAGTG TTGCCCCCAG GAGCCTTATC TCAGCCAATT  12600
ACCTTTCTTG ACAGTAGGAG CGGCTTCCCT CTCCCATTCC CTCTTCACTC  12650
CCTTTTCTTC CTTTCCCCTG TCTTCATGCC ACTGCTTTCC CATGCTTCTT  12700
```

FIG. 51F

```
TCGGGTTGTA GGGGAGACTG ACTGCCTGCT CAAGGACACT CCCTGCTGGG  12750
CATAGGATGT GCCTGCAAAA AGTTCCCTGA GCCTGTAAGC ACTCCAGGTG  12800
GGGAAGTGGA CAGGAGCCAT TGGTCATAAC CAGACAGAAT TTGGAAACAT  12850
TTTCATAAAG CTCCATGGAG AGTTTTAAAG AAACATATGT AGCATGATTT  12900
TGTAGGAGAG GAAAAAGATT ATTTAAATAG GATTTAAATC ATGCAACAAC  12950
GAGAGTATCA CAGCCAGGAT GACCCTTGGG TCCCATTCCT AAGACATGGT  13000
TACTTTATTT TCCCCTTGTT AAGACATAGG AAGACTTAAT TTTTAAACGG  13050
TCAGTGTCCA GTTGAAGGCA GAACACTAAT CAGATTTCAA GGCCCACAAC  13100
TTGGGGACTA GACCACCTTA TGTTGAGGGA ACTCTGCCAC CTGCGTGCAA  13150
CCCACAGCTA AAGTAAATTC AATGACACTA CTGCCCTGAT TACTCCTTAG  13200
GATGTGGTCA AAACAGCATC AAATGTTTCT TCTCTTCCTT TCCCCAAGAC  13250
AGAGTCCTGA ACCTGTTAAA TTAAGTCATT GGATTTTACT CTGTTCTGTT  13300
TACAGTTTAC TATTTAAGGT TTTATAAATG TAAATATATT TTGTATATTT  13350
TTCTATGAGA AGCACTTCAT AGGGAGAAGC ACTTATGACA AGGCTATTTT  13400
TTAAACCGCG GTATTATCCT AATTTAAAAG AAGATCGGTT TTTAATAATT  13450
TTTTATTTTC ATAGGATGAA GTTAGAGAAA ATATTCAGCT GTACACACAA  13500
AGTCTGGTTT TTCCTGCCCA ACTTCCCCCT GGAAGGTGTA CTTTTTGTTG  13550
TTTAATGTGT AGCTTGTTTG TGCCCTGTTG ACATAAATGT TTCCTGGGTT  13600
TGCTCTTTGA CAATAAATGG AGAAGGAAGG TCACCCAACT CCATTGGGCC  13650
ACTCCCCTCC TTCCCCTATT GAAGCTCCTC AAAAGGCTAC AGTAATATCT  13700
TGATACAACA GATTCTCTTC TTTCCCGCCT CTCTCCTTTC CGGCGCAACT  13750
TCCAGAGTGG TGGGAGACGG CAATCTTTAC ATTTCCCTCA TCTTTCTTAC  13800
TTCAGAGTTA GCAAACAACA AGTTGAATGG CAACTTGACA TTTTTGCATC  13850
ACCATCTGCC TCATAGGCCA CTCTTTCCTT TCCCTCTGCC CACCAAGTCC  13900
TCATATCTGC AGAGAACCCA TTGATCACCT TGTGCCCTCT TTTGGGGCAG  13950
CCTGTTGAAA CTGAAGCACA GTCTGACCAC TCACGATAAA GCAGATTTTT  14000
CTCTGCCTCT GCCACAAGGT TTCAGAGTAG TGTAGTCCAA GTAGAGGGTG  14050
GGGCACCCTT TTCTCGCCGC AAGAAGCCCA TTCCTATGGA AGTCTAGCAA  14100
AGCAATACGA CTCAGCCCAG CACTCTCTGC CCCAGGACTC ATGGCTCTGC  14150
TGTGCCTTCC ATCCTGGGCT CCCTTCTCTC CTGTGACCTT AAGAACTTTG  14200
TCTGGTGGCT TTGCTGGAAC ATTGTCACTG TTTTCACTGT CATGCAGGGA  14250
GCCCAGCACT GTGGCCAGGA TGGCAGAGAC TTCCTTGTCA TCATGGAGAA  14300
GTGCCAGCAG GGGACTGGGA AAAGCACTCT ACCCAGACCT CACCTCCCTT  14350
CCTCCTTTTG CCCATGAACA AGATGCAGTG GCCCTAGGGG TTCCACTAGT  14400
GTCTGCTTTC CTTTATTATT GCACTGTGTG AGGTTTTTTT GTAAATCCTT  14450
GTATTCCTAT TTTTTTTAAA GAAAAAAAAA AAACCTTAAG CTGCATTTGT  14500
TACTGAAATG ATTAATGCAC TGATGGGTCC TGAATTCACC TTGAGAAAGA  14550
CCCAAAGGCC AGTCAGGGGG TGGGGGGAAC TCAGCTAAAT AGACCTAGTT  14600
ACTGCCCTGC TAGGCCATGC TGTACTGTGA GCCCCTCCTC ACTCTCTACC  14650
AACCCTAAAC CCTGAGGACA GGGGAGGAAC CCACAGCTTC CTTCTCCTGC  14700
CAGCTGCAGA TGGTTTGCCT TGCCTTTCCA CCCCCTAATT GTCAACCACA  14750
AAAATGAGAA ATTCCTCTTC TAGCTCAGCC TTGAGTCCAT TGCCAAATTT  14800
TCAGCACACC TGCCAGCAAC TTGGGGGAAT AAGCGAAGGT TTCCCTACAA  14850
GAGGGAAAGA AGGCAAAAAC GGCACAGCTA TCTCCAAACA CATCTGAGTT  14900
CATTTCAAAA GTGACCAAGG GAATCTCCGC ACAAAGTGC AGATTGAGGA  14950
ATTGTGATGG GTCATTCCCA AGAATCCCCC AAGGGGCATC CCAAATCCCT  15000
GAGGAGTAAC AGCTGCAAAC CTGGTCAGTT CTCAGTGAGA GCCAGCTCAC  15050
TTATAGCTTT GCTGCTAGAA CCTGTTGTGG CTGCATTTCC TGGTGGCCAG  15100
TGACAACTGT GTAACCAGAA TAGCTGCATG GCGCTGACCC TTTGGCCGGA  15150
ACTTGGTCTC TTGGCTCCCT CCTTGGCCAC CCACCACCTC TCGCACAGCC  15200
CCTCTGTTTT TACACCAATA ACAAGAATTA AGGGGGAAGC CCTGGCAGCT  15250
```

FIG. 51G

```
ATACGTTTTC AACCAGACTC CTTTGCCGGG ACCCAGCCCG CCACCCTGCT  15300
CGCCTCCGTC AAACCCCCGG CCAATGCAGT GAGCACCATG TAGCTCCCTT  15350
GATTTAAAAA AAATAAAAAA TAAAAAAAAA AGGAAAAAAA AATACAACAC  15400
ACACACAAAA ATAAAAAAAA TATTCTAATG AATGTATCTT TCTAAAGGAC  15450
TGACGTTCAA TCAAATATCT GAAAATACTA AAGGTCAAAA CCTTGTCAGA  15500
TGTTAACTTC TAAGTTCGGT TTGGGATTTT TTTTTTTAA TAGAAATCAA   15550
GTTGTTTTG TTTTAAGGA AAAGCGGGTC ATTGCAAAGG GCTGGGTGTA    15600
ATTTTATGTT TCATTTCCTT CATTTAAAG CAATACAAGG TTATGGAGCA   15650
GATGGTTTTG TGCCGAATCA TGAATACTAG TCAAGTCACA CACTCTGGAA  15700
ACTTGCAACT TTTTGTTTGT TTTGGTTTTC AAATAAATAT AAATATGATA  15750
TATATAGGAA CTAATATAGT AATGCACCAT GTAACAAAGC CTAGTTCAGT  15800
CCATGGCTTT TAATTCTCTT AACACTATAG ATAAGGATTG TGTTACAGTT  15850
GCTAGTAGCG GCAGGAAGAT GTCAGGCTCA CTTTCCTCTG ATTCCCGAAA  15900
TGGGGGGAAC CTCTAACCAT AAAGGAATGG TAGAACAGTC CATTCCTCGG  15950
ATCAGAGAAA AATGCAGACA TGGTGTCACC TGGATTTTTT TCTGCCCATG  16000
AATGTTGCCA GTCAGTACCT GTCCTCCTTG TTTCTCTATT TTTGGTTATG  16050
AATGTTGGGG TTACCACCTG CATTAGGGG AAAATTGTGT TCTGTGCTTT   16100
CCTGGTATCT TGTTCCGAGG TACTCTAGTT CTGTCTTTCA ACCAAGAAAA  16150
TAGAATTGTG GTGTTTCTTT TATTGAACTT TTAACAGTCT CTTTAGTAAA  16200
TACAGGTAGT TGAATAATTG TTTCAAGAGC TCAACAGATG ACAAGCTTCT  16250
TTTCTAGAAA TAAGACATTT TTTGACAACT TTATCATGTA TAACAGATCT  16300
GTTTTTTTTC CTTGTGTTCT TCCAAGCTTC TGGTTAGAGA AAAAGAGAAA  16350
AAAAAAAAAG GAAAATGTGT CTAAAGTCCA TCAGTGTTAA CTCCCTGTGA  16400
CAGGGATGAA GGAAAATACT TTAATAGTTC AAAAAATAAT AATGCTGAAA  16450
GCTCTCTACG AAAGACTGAA TGTAAAAGTA AAAAGTGTAC ATAGTTGTAA  16500
AAAAAAGGAG TTTTTAAACA TGTTTATTTT CTATGCACTT TTTTTTATTT  16550
AAGTGATAGT TTAATTAATA AACATGTCAA GTTTAaaaaa aaaaaaaaa
(SEQ ID NO: 51)
```

FIG. 52A

MAHSCRWRFPARPGTTGGGGGGGRRGLGGAPRQRVPALLLPPGPPVGGGGPGAPPSPPAV
AAAAAAAGSSGAGVPGGAAAASAASSSSASSSSSSSSSASSGPALLRVGPGFDAALQVSA
AIGTNLRRFRAVFGESGGGGGSGEDEQFLGFGSDEEVRVRSPTRSPSVKTSPRKPRGRPR
SGSDRNSAILSDPSVFSPLNKSETKSGDKIKKKDSKSIEKKRGRPPTFPGVKIKITHGKD
ISELPKGNKEDSLKKIKRTPSATFQQATKIKKLRAGKLSPLKSKFKTGKLQIGRKGVQIV
RRRGRPPSTERIKTPSGLLINSELEKPQKVRKDKEGTPPLTKEDKTVVRQSPRRIKPVRI
IPSSKRTDATIAKQLLQRAKKGAQKKIEKEAAQLQGRKVKTQVKNIRQFIMPVVSAISSR
IIKTPRRFIEDEDYDPPIKIARLESTPNSRFSAPSCGSSEKSSAASQHSSQMSSDSSRSS
SPSVDTSTDSQASEEIQVLPEERSDTPEVHPPLPISQSPENESNDRRSRRYSVSERSFGS
RTTKKLSTLQSAPQQQTSSSPPPPLLTPPPPLQPASSISDHTPWLMPPTIPLASPFLPAS
TAPMQGKRKSILREPTFRWTSLKHSRSEPQYFSSAKYAKEGLIRKPIFDNFRPPPLTPED
VGFASGFSASGTAASARLFSPLHSGTRFDMHKRSPLLRAPRFTPSEAHSRIFESVTLPSN
RTSAGTSSSGVSNRKRKRKVFSPIRSEPRSPSHSMRTRSGRLSSSELSPLTPPSSVSSSL
SISVSPLATSALNPTFTFPSHSLTQSGESAEKNQRPRKQTSAPAEPFSSSSPTPLFPWFT
PGSQTERGRNKDKAPEELSKDRDADKSVEKDKSRERDREREKENKRESRKEKRKKGSEIQ
SSSALYPVGRVSKEKVVGEDVATSSSAKKATGRKKSSSHDSGTDITSVTLGDTTAVKTKI
LIKKGRGNLEKTNLDLGPTAPSLEKEKTLCLSTPSSSTVKHSTSSIGSMLAQADKLPMTD
KRVASLLKKAKAQLCKIEKSKSLKQTDQPKAQGQESDSSETSVRGPRIKHVCRRAAVALG
RKRAVFPDDMPTLSALPWEEREKILSSMGNDDKSSIAGSEDAEPLAPPIKPIKPVTRNKA
PQEPPVKKGRRSRRCGQCPGCQVPEDCGVCTNCLDKPKFGGRNIKKQCCKMRKCQNLQWM
PSKAYLQKQAKAVKKKEKKSKTSEKKDSKESSVVKNVVDSSQKPTPSAREDPAPKKSSSE
PPPRKPVEEKSEEGNVSAPGPESKQATTPASRKSSKQVSQPALVIPPQPPTTGPPRKEVP
KTTPSEPKKKQPPPPESGPEQSKQKKVAPRPSIPVKQKPKEKEKPPPVNKQENAGTLNIL
STLSNGNSSKQKIPADGVHRIRVDFKEDCEAENVWEMGGLGILTSVPITPRVVCFLCASS
GHVEFVYCQVCCEPFHKFCLEENERPLEDQLENWCCRRCKFCHVCGRQHQATKQLLECNK
CRNSYHPECLGPNYPTKPTKKKKVWICTKCVRCKSCGSTTPGKGWDAQWSHDFSLCHDCA
KLFAKGNFCPLCDKCYDDDDYESKMMQCGKCDRWVHSKCENLSDEMYEILSNLPESVAYT
CVNCTERHPAEWRLALEKELQISLKQVLTALLNSRTTSHLLRYRQAAKPPDLNPETEESI
PSRSSPEGPDPPVLTEVSKQDDQQPLDLEGVKRKMDQGNYTSVLEFSDDIVKIIQAAINS
DGGQPEIKKANSMVKSFFIRQMERVFPWFSVKKSRFWEPNKVSSNSGMLPNAVLPPSLDH
NYAQWQEREENSHTEQPPLMKKIIPAPKPKGPGEPDSPTPLHPPTPPILSTDRSREDSPE
LNPPPGIEDNRQCALCLTYGDDSANDAGRLLYIGQNEWTHVNCALWSAEVFEDDDGSLKN
VHMAVIRGKQLRCEFCQKPGATVGCCLTSCTSNYHFMCSRAKNCVFLDDKKVYCQRHRDL
IKGEVVPENGFEVFRRVFVDFEGISLRRKFLNGLEPENIHMMIGSMTIDCLGILNDLSDC
EDKLFPIGYQCSRVYWSTTDARKRCVYTCKIVECRPPVVEPDINSTVEHDENRTIAHSPT
SFTESSSKESQNTAEIISPPSPDRPPHSQTSGSCYYHVISKVPRIRTPSYSPTQRSPGCR
PLPSAGSPTPTTHEIVTVGDPLLSSGLRSIGSRRHSTSSLSPQRSKLRIMSPMRTGNTYS
RNNVSSVSTTGTATDLESSAKVVDHVLGPLNSSTSLGQNTSTSSNLQRTVVTVGNKNSHL
DGSSSSEMKQSSASDLVSKSSSLKGEKTKVLSSKSSEGSAHNVAYPGIPKLAPQVHNTTS
RELNVSKIGSFAEPSSVSFSSKEALSFPHLHLRGQRNDRDQHTDSTQSANSSPDEDTEVK
TLKLSGMSNRSSIINEHMGSSSRDRRQKGKKSCKETFKEKHSSKSFLEPGQVTTGEEGNL
KPEFMDEVLTPEYMGQRPCNNVSSDKIGDKGLSMPGVPKAPPMQVEGSAKELQAPRKRTV
KVTLTPLKMENESQSKNALKESSPASPLQIESTSPTEPISASENPGDGPVAQPSPNNTSC
QDSQSNNYQNLPVQDRNLMLPDGPKPQEDGSFKRRYPRRSARARSNMFFGLTPLYGVRSY
GEEDIPFYSSSTGKKRGKRSAEGQVDGADDLSTSDEDDLYYYNFTRTVISSGGEERLASH
NLFREEEQCDLPKISQLDGVDDGTESDTSVTATTRKSSQIPKRNGKENGTENLKIDRPED
AGEKEHVTKSSVGHKNEPKMDNCHSVSRVKTQGQDSLEAQLSSLESSRRVHTSTPSDKNL
LDTYNTELLKSDSDNNNSDDCGNILPSDIMDFVLKNTPSMQALGESPESSSSELLNLGEG
LGLDSNREKDMGLFEVFSQQLPTTEPVDSSVSSSISAEEQFELPLELPSDLSVLTTRSPT
VPSQNPSRLAVISDSGEKRVTITEKSVASSESDPALLSPGVDPTPEGHMTPDHFIQGHMD
ADHISSPPCGSVEQGHGNNQDLTRNSSTPGLQVPVSPTVPIQNQKYVPNSTDSPGPSQIS

FIG. 52B

```
NAAVQTTPPHLKPATEKLIVVNQNMQPLYVLQTLPNGVTQKIQLTSSVSSTPSVMETNTS
VLGPMGGGLTLTTGLNPSLPTSQSLFPSASKGLLPMSHHQHLHSFPAATQSSFPPNISNP
PSGLLIGVQPPPDPQLLVSESSQRTDLSTTVATPSSGLKKRPISRLQTRKNKKLAPSSTP
SNIAPSDVVSNMTLINFTPSQLPNHPSLLDLGSLNTSSHRTVPNIIKRSKSSIMYFEPAP
LLPQSVGGTAATAAGTSTISQDTSHLTSGSVSGLASSSSVLNVVSMQTTTTPTSSASVPG
HVTLTNPRLLGTPDIGSISNLLIKASQQSLGIQDQPVALPPSSGMFPQLGTSQTPSTAAI
TAASSICVLPSTQTTGITAASPSGEADEHYQLQHVNQLLASKTGIHSSQRDLDSASGPQV
SNFTQTVDAPNSMGLEQNKALSSAVQASPTSPGGSPSSPSSGQRSASPSVPGPTKPKPKT
KRFQLPLDKGNGKKHKVSHLRTSSSEAHIPDQETTSLTSGTGTPGAEAEQQDTASVEQSS
QKECGQPAGQVAVLPEVQVTQNPANEQESAEPKTVEEEESNFSSPLMLWLQQEQKRKESI
TEKKPKKGLVFEISSDDGFQICAESIEDAWKSLTDKVQEARSNARLKQLSFAGVNGLRML
GILHDAVVFLIEQLSGAKHCRNYKFRFHKPEEANEPPLNPHGSARAEVHLRKSAFDMFNF
LASKHRQPPEYNPNDEEEEEVQLKSARRATSMDLPMPMRFRHLKKTSKEAVGVYRSPIHG
RGLFCKRNIDAGEMVIEYAGNVIRSIQTDKREKYYDSKGIGCYMFRIDDSEVVDATMHGN
AARFINHSCEPNCYSRVINIDGQKHIVIFAMRKIYRGEELTYDKFPIEDASNKLPCNCG
AKKCRKFLN-(SEQ ID NO:52)
```

FIG. 53A

```
GCCGCCGCCA GGGAAAAGAA AGGGAGGAAG GAAGGAACAA GAAAAGGAAA  50
TAAAGAGAAA GGGGAGGCGG GGAAAGGCAA CGAGCTGTCC GGCCTCCGTC  100
AAGGGAGTTG GAGGGAAAAA GTTCTCAGGC GCCGCAGGTC CGAGTGCCTC  150
GCAGCCCCTC CCGAGGCGCA GCCGCCAGAC CAGTGGAGCC GGGGCGCAGG  200
GCGGGGCGG  AGGCGCCGGG GCGGGGGATG CGGGGCCGCG GCGCAGCCCC  250
CCGGCCCTGA GAGCGAGGAC AGCGCCGCCC GGCCCGCAGC CGTCGCCGCT  300
TCTCCACCTC GGCCCGTGGA GCCGGGGCGT CCGGGCGTAG CCCTCGCTCG  350
CCTGGGTCAG GGGGTGCGCG TCGGGGGAGG CAGAAGCC*AT G*GATCCCGGG  400
CAGCAGCCGC CGCCTCAACC GGCCCCCCAG GGCCAAGGGC AGCCGCCTTC  450
GCAGCCCCCG CAGGGGCAGG GCCCGCCGTC CGGACCCGGG CAACCGGCAC  500
CCGCGGCGAC CCAGGCGGCG CCGCAGGCAC CCCCCGCCGG GCATCAGATC  550
GTGCACGTCC GCGGGGACTC GGAGACCGAC CTGGAGGCGC TCTTCAACGC  600
CGTCATGAAC CCCAAGACGG CCAACGTGCC CCAGACCGTG CCCATGAGGC  650
TCCGGAAGCT GCCCGACTCC TTCTTCAAGC CGCCGGAGCC CAAATCCCAC  700
TCCCGACAGG CCAGTACTGA TGCAGGCACT GCAGGAGCCC TGACTCCACA  750
GCATGTTCGA GCTCATTCCT CTCCAGCTTC TCTGCAGTTG GGAGCTGTTT  800
CTCCTGGGAC ACTGACCCCC ACTGGAGTAG TCTCTGGCCC AGCAGCTACA  850
CCCACAGCTC AGCATCTTCG ACAGTCTTCT TTTGAGATAC CTGATGATGT  900
ACCTCTGCCA GCAGGTTGGG AGATGGCAAA GACATCTTCT GGTCAGAGAT  950
ACTTCTTAAA TCACATCGAT CAGACAACAA CATGGCAGGA CCCCAGGAAG  1000
GCCATGCTGT CCCAGATGAA CGTCACAGCC CCCACCAGTC CACCAGTGCA  1050
GCAGAATATG ATGAACTCGG CTTCAGCCAT GAACCAGAGA ATCAGTCAGA  1100
GTGCTCCAGT GAAACAGCCA CCACCCCTGG CTCCCCAGAG CCCACAGGGA  1150
GGCGTCATGG GTGGCAGCAA CTCCAACCAG CAGCAACAGA TGCGACTGCA  1200
GCAACTGCAG ATGGAGAAGG AGAGGCTGCG GCTGAAACAG CAAGAACTGC  1250
TTCGGCAGGA GTTAGCCCTG CGTAGCCAGT TACCAACACT GGAGCAGGAT  1300
GGTGGGACTC AAAATCCAGT GTCTTCTCCC GGGATGTCTC AGGAATTGAG  1350
AACAATGACG ACCAATAGCT CAGATCCTTT CCTTAACAGT GGCACCTATC  1400
ACTCTCGAGA TGAGAGTACA GACAGTGGAC TAAGCATGAG CAGCTACAGT  1450
GTCCCTCGAA CCCCAGATGA CTTCCTGAAC AGTGTGGATG AGATGGATAC  1500
AGGTGATACT ATCAACCAAA GCACCCTGCC CTCACAGCAG AACCGTTTCC  1550
CAGACTACCT TGAAGCCATT CCTGGGACAA ATGTGGACCT TGGAACACTG  1600
GAAGGAGATG GAATGAACAT AGAAGGAGAG GAGCTGATGC CAAGTCTGCA  1650
GGAAGCTTTG AGTTCTGACA TCCTTAATGA CATGGAGTCT GTTTTGGCTG  1700
CCACCAAGCT AGATAAAGAA AGCTTTCTTA CATGGTTA*TA G*AGCCCTCAG  1750
GCAGACTGAA TTCTAAATCT GTGAAGGATC TAAGGAGACA CATGCACCGG  1800
AAATTTCCAT AAGCCAGTTG CAGTTTTCAG GCTAATACAG AAAAAGATGA  1850
ACAAACGTCC AGCAAGATAC TTTAATCCTC TATTTTGCTC TTCCTTGTCC  1900
ATTGCTGCTG TTAATGTATT GCTGACCTCT TTCACAGTTG GCTCTAAAGA  1950
ATCAAAAGAA AAAAACTTTT TATTTCTTTT GCTATTAAAA CTACTGTTCA  2000
TTTTGGGGGC TGGGGGAAGT GAGCCTGTTT GGATGATGGA TGCCATTCCT  2050
TTTGCCCAGT TAAATGTTCA CCAATCATTT TAACTAAATA CTCAGACTTA  2100
GAAGTCAGAT GCTTCATGTC ACAGCATTTA GTTTGTTCAA CAGTTGTTTC  2150
TTCAGCTTCC TTTGTCCAGT GGAAAAACAT GATTTACTGG TCTGACAAGC  2200
CAAAAATGTT ATATCTGATA TTAAATACTT AATGCTGATT TGAAGAGATA  2250
GCTGAAACCA AGGCTGAAGA CTGTTTTACT TTCAGTATTT TCTTTTCCTC  2300
CTAGTGCTAT CATTAGTCAC ATAATGACCT TGATTTTATT TTAGGAGCTT  2350
ATAAGGCATG AGACAATTTC CATATAAATA TATTAATTAT TGCCACATAC  2400
TCTAATATAG ATTTTGGTGG ATAATTTTGT GGGTGTGCAT TTGTTCTGT   2450
TTTGTTGGGT TTTTTGTTTT TTTGTTTTT  GGCAGGGTCG GTGGGGGGGT  2500
```

FIG. 53B

```
TGGTTGGTTG GTTGGTTTTG TCGGAACCTA GGCAAATGAC CATATTAGTG  2550
AATCTGTTAA TAGTTGTAGC TTGGGATGGT TATTGTAGTT GTTTTGGTAA  2600
AATCTTCATT TCCTGGTTTT TTTTACCACC TTATTTAAAT CTCGATTATC  2650
TGCTCTCTCT TTTATATACA TACACACACC CAAACATAAC ATTTATAATA  2700
GTGTGGTAGT GGAATGTATC CTTTTTTAGG TTTCCCTGCT TTCCAGTTAA  2750
TTTTTAAAAT GGTAGCGCTT TGTATGCATT TAGAATACAT GACTAGTAGT  2800
TTATATTTCA CTGGTAGTTT AAATCTGGTT GGGGCAGTCT GCAGATGTTT  2850
GAAGTAGTTT AGTGTTCTAG AAAGAGCTAT TACTGTGGAT AGTGCCTAGG  2900
GGAGTGCTCC ACGCCCTCTG GGCATACGGT AGATATTATC TGATGAATTG  2950
GAAAGGAGCA AACCAGAAAT GGCTTTATTT TCTCCCTTGG ACTAATTTTT  3000
AAGTCTCGAT TGGAATTCAG TGAGTAGGTT CATAATGTGC ATGACAGAAA  3050
TAAGCTTTAT AGTGGTTTAC CTTCATTTAG CTTTGGAAGT TTTCTTTGCC  3100
TTAGTTTTGG AAGTAAATTC TAGTTTGTAG TTCTCATTTG TAATGAACAC  3150
ATTAACGACT AGATTAAAAT ATTGCCTTCA AGATTGTTCT TACTTACAAG  3200
ACTTGCTCCT ACTTCTATGC TGAAAATTGA CCCTGGATAG AATACTATAA  3250
GGTTTTGAGT TAGCTGGAAA AGTGATCAGA TTAATAAATG TATATTGGTA  3300
GTTGAATTTA GCAAAGAAAT AGAGATAATC ATGATTATAC CTTTATTTTT  3350
ACAGGAAGAG ATGATGTAAC TAGAGTATGT GTCTACAGGA GTAATAATGG  3400
TTTCCAAAGA GTATTTTTA AAGGAACAAA ACGAGCATGA ATTAACTCTT  3450
CAATATAAGC TATGAAGTAA TAGTTGGTTG TGAATTAAAG TGGCACCAGC  3500
TAGCACCTCT GTGTTTAAG GGTCTTTCAA TGTTCTAGA ATAAGCCCTT  3550
ATTTCAAGG GTTCATAACA GGCATAAAAT CTCTTCTCCT GGCAAAAGCT  3600
GCTATGAAAA GCCTCAGCTT GGGAAGATAG ATTTTTTCC CCCCAATTAC  3650
AAAATCTAAG TATTTTGGCC CTTCAATTTG GAGGAGGGCA AAAGTTGGAA  3700
GTAAGAAGTT TTATTTTAAG TACTTTCAGT GCTCAAAAAA ATGCAATCAC  3750
TGTGTTGTAT ATAATAGTTC ATAGGTTGAT CACTCATAAT AATTGACTCT  3800
AAGGCTTTTA TTAAGAAAAC AGCAGAAAGA TTAAATCTTG AATTAAGTCT  3850
GGGGGGAAAT GGCCACTGCA GATGGAGTTT TAGAGTAGTA ATGAAATTCT  3900
ACCTAGAATG CAAAATTGGG TATATGAATT ACATAGCATG TTGTTGGGAT  3950
TTTTTTTAAT GTGCAGAAGA TCAAAGCTAC TTGGAAGGAG TGCCTATAAT  4000
TTGCCAGTAG CCACAGATTA AGATTATATC TTATATATCA GCAGATTAGC  4050
TTTAGCTTAG GGGGAGGGTG GGAAAGTTTG GGGGGGGGGT TGTGAAGATT  4100
TAGGGGGACC TTGATAGAGA ACTTTATAAA CTTCTTTCTC TTTAATAAAG  4150
ACTTGTCTTA CACCGTGCTG CCATTAAAGG CAGCTGTTCT AGAGTTTCAG  4200
TCACCTAAGT ACACCCACAA AACAATATGA ATATGGAGAT CTTCCTTTAC  4250
CCCTCAACTT TAATTTGCCC AGTTATACCT CAGTGTTGTA GCAGTACTGT  4300
GATACCTGGC ACAGTGCTTT GATCTTACGA TGCCCTCTGT ACTGACCTGA  4350
AGGAGACCTA AGAGTCCTTT CCCTTTTTGA GTTGAATCA TAGCCTTGAT   4400
GTGGTCTCTT GTTTTATGTC CTTGTTCCTA ATGTAAAAGT GCTTAACTGC  4450
TTCTTGGTTG TATTGGGTAG CATTGGGATA AGATTTAAC TGGGTATTCT   4500
TGAATTGCTT TTACAATAAA CCAATTTTAT AATCTTTAAA TTTATCAACT  4550
TTTTACATTT GTGTTATTTT CAGTCAGGGC TTCTTAGATC TACTTATGGT  4600
TGATGGAGCA CATTGATTTG GAGTTTCAGA TCTTCCAAAG CACTATTTGT  4650
TGTAATAACT TTTCTAAATG TAGTGCCTTT AAAGGAAAAA TGAACACAGG  4700
GAAGTGACTT TGCTACAAAT AATGTTGCTG TGTTAAGTAT TCATATTAAA  4750
TACATGCCTT CTATATGGAA CATGGCAGAA AGACTGAAAA ATAACAGTAA  4800
TTAATTGTGT AATTCAGAAT TCATACCAAT CAGTGTTGAA ACTCAAACAT  4850
TGCAAAAGTG GGTGGCAATA TTCAGTGCTT AACACTTTC TAGCGTTGGT   4900
ACATCTGAGA AATGAGTGCT CAGGTGGATT TTATCCTCGC AAGCATGTTG  4950
TTATAAGAAT TGTGGGTGTG CCTATCATAA CAATTGTTTT CTGTATCTTG  5000
AAAAAGTATT CTCCACATTT TAAATGTTTT ATATTAGAGA ATTCTTTAAT  5050
```

FIG. 53C

```
GCACACTTGT CAAATATATA TATATAGTAC CAATGTTACC TTTTTATTTT  5100
TTGTTTTAGA TGTAAGAGCA TGCTCATATG TTAGGTACTT ACATAAATTG  5150
TTACATTATT TTTCTTATG TAATACCTTT TTGTTTGTTT ATGTGGTTCA  5200
AATATATTCT TTCCTTAAAC TCTTaaaaaa aaaa (SEQ ID NO: 53)
```

FIG. 54

```
MDPGQQPPPQPAPQGQGQPPSQPPQGQGPPSGPGQPAPAATQAAPQAPPAGHQIVHVRGD
SETDLEALFNAVMNPKTANVPQTVPMRLRKLPDSFFKPPEPKSHSRQASTDAGTAGALTP
QHVRAHSSPASLQLGAVSPGTLTPTGVVSGPAATPTAQHLRQSSFEIPDDVPLPAGWEMA
KTSSGQRYFLNHIDQTTTWQDPRKAMLSQMNVTAPTSPPVQQNMMNSASAMNQRISQSAP
VKQPPPLAPQSPQGGVMGGSNSNQQQQMRLQQLQMEKERLRLKQQELLRQELALRSQLPT
LEQDGGTQNPVSSPGMSQELRTMTTNSSDPFLNSGTYHSRDESTDSGLSMSSYSVPRTPD
DFLNSVDEMDTGDTINQSTLPSQQNRFPDYLEAIPGTNVDLGTLEGDGMNIEGEELMPSL
QEALSSDILNDMESVLAATKLDKESFLTWL- (SEQ ID NO: 54)
```

FIG. 55A

| | | | | | |
|---|---|---|---|---|---|
| <u>A</u>CCAGGGTCC | CGGCTCGGGG | TCCGGGCTGG | GGAGGGGAAC | CTGGGCGCCT | 50 |
| GGGACCCGCC | G*ATG*CCCCCT | GCCCCGCCCG | GAGGTGAAAG | CGGGTGTGAG | 100 |
| GAGCGCGGCG | CGGCAGGTCA | TATTGAACAT | TCCAGATACC | TATCATTACT | 150 |
| CGATGCTGTT | GATAACAGCA | AGATGGCTTT | GAACTCAGGG | TCACCACCAG | 200 |
| CTATTGGACC | TTACTATGAA | AACCATGGAT | ACCAACCGGA | AAACCCCTAT | 250 |
| CCCGCACAGC | CCACTGTGGT | CCCCACTGTC | TACGAGGTGC | ATCCGGCTCA | 300 |
| GTACTACCCG | TCCCCCGTGC | CCCAGTACGC | CCCGAGGGTC | CTGACGCAGG | 350 |
| CTTCCAACCC | CGTCGTCTGC | ACGCAGCCCA | AATCCCATC | CGGGACAGTG | 400 |
| TGCACCTCAA | AGACTAAGAA | AGCACTGTGC | ATCACCTTGA | CCCTGGGGAC | 450 |
| CTTCCTCGTG | GGAGCTGCGC | TGGCCGCTGG | CCTACTCTGG | AAGTTCATGG | 500 |
| GCAGCAAGTG | CTCCAACTCT | GGGATAGAGT | GCGACTCCTC | AGGTACCTGC | 550 |
| ATCAACCCCT | CTAACTGGTG | TGATGGCGTG | TCACACTGCC | CCGGCGGGGA | 600 |
| GGACGAGAAT | CGGTGTGTTC | GCCTCTACGG | ACCAAACTTC | ATCCTTCAGG | 650 |
| TGTACTCATC | TCAGAGGAAG | TCCTGGCACC | CTGTGTGCCA | AGACGACTGG | 700 |
| AACGAGAACT | ACGGGCGGGC | GGCCTGCAGG | GACATGGGCT | ATAAGAATAA | 750 |
| TTTTTACTCT | AGCCAAGGAA | TAGTGGATGA | CAGCGGATCC | ACCAGCTTTA | 800 |
| TGAAACTGAA | CACAAGTGCC | GGCAATGTCG | ATATCTATAA | AAAACTGTAC | 850 |
| CACAGTGATG | CCTGTTCTTC | AAAAGCAGTG | GTTTCTTTAC | GCTGTATAGC | 900 |
| CTGCGGGGTC | AACTTGAACT | CAAGCCGCCA | GAGCAGGATT | GTGGGCGGCG | 950 |
| AGAGCGCGCT | CCCGGGGGCC | TGGCCCTGGC | AGGTCAGCCT | GCACGTCCAG | 1000 |
| AACGTCCACG | TGTGCGGAGG | CTCCATCATC | ACCCCGAGT | GGATCGTGAC | 1050 |
| AGCCGCCCAC | TGCGTGGAAA | AACCTCTTAA | CAATCCATGG | CATTGGACGG | 1100 |
| CATTTGCGGG | GATTTGAGA | CAATCTTTCA | TGTTCTATGG | AGCCGGATAC | 1150 |
| CAAGTAGAAA | AAGTGATTTC | TCATCCAAAT | TATGACTCCA | AGACCAAGAA | 1200 |
| CAATGACATT | GCGCTGATGA | AGCTGCAGAA | GCCTCTGACT | TCAACGACC | 1250 |
| TAGTGAAACC | AGTGTGTCTG | CCCAACCCAG | GCATGATGCT | GCAGCCAGAA | 1300 |
| CAGCTCTGCT | GGATTTCCGG | GTGGGGGGCC | ACCGAGGAGA | AAGGGAAGAC | 1350 |
| CTCAGAAGTG | CTGAACGCTG | CCAAGGTGCT | TCTCATTGAG | ACACAGAGAT | 1400 |
| GCAACAGCAG | ATATGTCTAT | GACAACCTGA | TCACACCAGC | CATGATCTGT | 1450 |
| GCCGGCTTCC | TGCAGGGGAA | CGTCGATTCT | TGCCAGGGTG | ACAGTGGAGG | 1500 |
| GCCTCTGGTC | ACTTCGAAGA | ACAATATCTG | GTGGCTGATA | GGGGATACAA | 1550 |
| GCTGGGGTTC | TGGCTGTGCC | AAAGCTTACA | GACCAGGAGT | GTACGGGAAT | 1600 |
| GTGATGGTAT | TCACGGACTG | GATTTATCGA | CAAATGAGGG | CAGACGGC*TA* | 1650 |
| *A*TCCACATGG | TCTTCGTCCT | TGACGTCGTT | TTACAAGAAA | ACAATGGGGC | 1700 |
| <u>T</u>GGTTTTGCT | TCCCCGTGCA | TGATTTACTC | TTAGAGATGA | TTCAGAGGTC | 1750 |
| ACTTCATTTT | TATTAAACAG | TGAACTTGTC | TGGCTTTGGC | ACTCTCTGCC | 1800 |
| ATTCTGTGCA | GGCTGCAGTG | GCTCCCCTGC | CCAGCCTGCT | CTCCCTAACC | 1850 |
| CCTTGTCCGC | AAGGGGTGAT | GGCCGGCTGG | TTGTGGGCAC | TGGCGGTCAA | 1900 |
| GTGTGGAGGA | GAGGGGTGGA | GGCTGCCCCA | TTGAGATCTT | CCTGCTGAGT | 1950 |
| CCTTTCCAGG | GGCCAATTTT | GGATGAGCAT | GGAGCTGTCA | CCTCTCAGCT | 2000 |
| GCTGGATGAC | TTGAGATGAA | AAAGGAGAGA | CATGAAAGG | GAGACAGCCA | 2050 |
| GGTGGCACCT | GCAGCGGCTG | CCCTCTGGGG | CCACTTGGTA | GTGTCCCCAG | 2100 |
| CCTACCTCTC | CACAAGGGGA | TTTTGCTGAT | GGGTTCTTAG | AGCCTTAGCA | 2150 |
| GCCCTGGATG | GTGGCCAGAA | ATAAAGGGAC | CAGCCCTTCA | TGGGTGGTGA | 2200 |
| CGTGGTAGTC | ACTTGTAAGG | GGAACAGAAA | CATTTTGTT | CTTATGGGGT | 2250 |
| GAGAATATAG | ACAGTGCCCT | TGGTGCGAGG | GAAGCAATTG | AAAAGGAACT | 2300 |
| TGCCCTGAGC | ACTCCTGGTG | CAGGTCTCCA | CCTGCACATT | GGGTGGGGCT | 2350 |
| CCTGGGAGGG | AGACTCAGCC | TTCCTCCTCA | TCCTCCCTGA | CCCTGCTCCT | 2400 |
| AGCACCCTGG | AGAGTGCACA | TGCCCCTTGG | TCCTGGCAGG | GCGCCAAGTC | 2450 |
| TGGCACCATG | TTGGCCTCTT | CAGGCCTGCT | AGTCACTGGA | AATTGAGGTC | 2500 |
| CATGGGGGAA | ATCAAGGATG | CTCAGTTTAA | GGTACACTGT | TTCCATGTTA | 2550 |

FIG. 55B

```
TGTTTCTACA CATTGCTACC TCAGTGCTCC TGGAAACTTA GCTTTTGATG  2600
TCTCCAAGTA GTCCACCTTC ATTAACTCT  TTGAAACTGT ATCATCTTTG  2650
CCAAGTAAGA GTGGTGGCCT ATTTCAGCTG CTTTGACAAA ATGACTGGCT  2700
CCTGACTTAA CGTTCTATAA ATGAATGTGC TGAAGCAAAG TGCCCATGGT  2750
GGCGGCGAAG AAGAGAAAGA TGTGTTTTGT TTTGGACTCT CTGTGGTCCC  2800
TTCCAATGCT GTGGGTTTCC AACCAGGGGA AGGGTCCCTT TTGCATTGCC  2850
AAGTGCCATA ACCATGAGCA CTACTCTACC ATGGTTCTGC CTCCTGGCCA  2900
AGCAGGCTGG TTTGCAAGAA TGAAATGAAT GATTCTACAG CTAGGACTTA  2950
ACCTTGAAAT GGAAAGTCAT GCAATCCCAT TTGCAGGATC TGTCTGTGCA  3000
CATGCCTCTG TAGAGAGCAG CATTCCCAGG GACCTTGGAA ACAGTTGGCA  3050
CTGTAAGGTG CTTGCTCCCC AAGACACATC CTAAAAGGTG TTGTAATGGT  3100
GAAAACGTCT TCCTTCTTTA TTGCCCCTTC TTATTTATGT GAACAACTGT  3150
TTGTCTTTTT TTGTATCTTT TTAAACTGT  AAAGTTCAAT TGTGAAAATG  3200
AATATCATGC AAATAAATTA TGCAATTTTT TTTCAAAGT  AAaaaaaaaa  3250
(SEQ ID NO: 55)
```

FIG. 56

```
MPPAPPGGESGCEERGAAGHIEHSRYLSLLDAVDNSKMALNSGSPPAIGPYYENHGYQPE
NPYPAQPTVVPTVYEVHPAQYYPSPVPQYAPRVLTQASNPVVCTQPKSPSGTVCTSKTKK
ALCITLTLGTFLVGAALAAGLLWKFMGSKCSNSGIECDSSGTCINPSNWCDGVSHCPGGE
DENRCVRLYGPNFILQVYSSQRKSWHPVCQDDWNENYGRAACRDMGYKNNFYSSQGIVDD
SGSTSFMKLNTSAGNVDIYKKLYHSDACSSKAVVSLRCIACGVNLNSSRQSRIVGGESAL
PGAWPWQVSLHVQNVHVCGGSIITPEWIVTAAHCVEKPLNNPWHWTAFAGILRQSFMFYG
AGYQVEKVISHPNYDSKTKNNDIALMKLQKPLTFNDLVKPVCLPNPGMMLQPEQLCWISG
WGATEEKGKTSEVLNAAKVLLIETQRCNSRYVYDNLITPAMICAGFLQGNVDSCQGDSGG
PLVTSKNNIWWLIGDTSWGSGCAKAYRPGVYGNVMVFTDWIYRQMRADG-
(SEQ ID NO: 56)
```

FIG. 57A

```
AAATTCGCGG TGGGGGCGGA GAGCGCAGGG AGAAGTAAGC CCAGTGCAGG   50
ATCCTGAGGC CCGTGTTTGC AGGACCAGGG CCGGCCTTCC GATTCCCCAT  100
TCATTCCAGA AGCACCGAAC CACGCTGTGC CCGGATCCCA AGTGCAGCGG  150
CACCCAGCGT GGGCCTGGGG TTGCCGGTTG ACCCGGTCCT CAGCCTGGTA  200
GCAGAGGCCA GGCCAGTGCC ACAAGGCACC TAAGTCCACC TGGGCCTGGA  250
GCAGGACAGG TTGCAAAAGA AAATATCTCG GGACCCCCAA ACTCCTTATG  300
CTAAGGGAAA CATCGAGCCT GGGAACTGAG CCATCAACGC TGCCATTCTT  350
TTTCCCAAAC AGAACCCTGT TGTCAGAGGT ACACCCAGAG CAACTCCACA  400
CCGGGTGCAT GCCACAGCAA CTCCATCTTA AATAGGAGCT GGTAAAACGA  450
GGCTGATACC TACTGGGCTG CATTCCCAGA CGGCATAGCG AGGAGGTGCT  500
GAAGAGCGCA GGTTTGGAGA ATGATCACCT GGATTGGAAC CATAGCTCTA  550
CCAATATGGA ACCCAGCTCC TTAGGCCTCG GTCTTCTCAT GGAGAACATG  600
GTGTGATAAT CCTACTCCTC TGGGAGGGTG GCTGTTAAGC CTTGGACCGC  650
AGTTGCCGGC CAGGAATCCC AGTGTCACGG TGGACACGCC TCCCTCGCGC  700
CCTTGCCGCC CACCTGCTCA CCCAGCTCAG GGGCTTTGGA ATTCTGTGGC  750
CACACTGCGA GGAGATCGGT TCTGGGTCGG AGGCTACAGG AAGACTCCCA  800
CTCCCTGAAA TCTGGAGTGA AGAACGCCGC CATCCAGCCA CCATTCCAAG  850
GAGGTGCAGG AGAACAGCTC TGTGATACCA TTTAACTTGT TGACATTACT  900
TTTATTTGAA GGAACGTATA TTAGAGCTTA CTTTGCAAAG AAGGAAGATG  950
GTTGTTTCCG AAGTGGACAT CGCAAAAGCT GATCCAGCTG CTGCATCCCA 1000
CCCTCTATTA CTGAATGGAG ATGCTACTGT GGCCCAGAAA ATCCAGGCT 1050
CGGTGGCTGA GAACAACCTG TGCAGCCAGT ATGAGGAGAA GGTGCGCCCC 1100
TGCATCGACC TCATTGACTC CCTGCGGGCT CTAGGTGTGG AGCAGGACCT 1150
GGCCCTGCCA GCCATCGCCG TCATCGGGGA CCAGAGCTCG GGCAAGAGCT 1200
CCGTGTTGGA GGCACTGTCA GGAGTTGCCC TTCCCAGAGG CAGCGGGATC 1250
GTGACCAGAT GCCCGCTGGT GCTGAAACTG AAGAAACTTG TGAACGAAGA 1300
TAAGTGGAGA GGCAAGGTCA GTTACCAGGA CTACGAGATT GAGATTTCGG 1350
ATGCTTCAGA GGTAGAAAAG GAAATTAATA AGCCCAGAA TGCCATCGCC 1400
GGGGAAGGAA TGGGAATCAG TCATGAGCTA ATCACCCTGG AGATCAGCTC 1450
CCGAGATGTC CCGGATCTGA CTCTAATAGA CCTTCCTGGC ATAACCAGAG 1500
TGGCTGTGGG CAATCAGCCT GCTGACATTG GGTATAAGAT CAAGACACTC 1550
ATCAAGAAGT ACATCCAGAG GCAGGAGACA ATCAGCCTGG TGGTGGTCCC 1600
CAGTAATGTG GACATCGCCA CCACAGAGGC TCTCAGCATG GCCCAGGAGG 1650
TGGACCCCGA GGGAGACAGG ACCATCGGAA TCTTGACGAA GCCTGATCTG 1700
GTGGACAAAG GAACTGAAGA CAAGGTTGTG GACGTGGTGC GGAACCTCGT 1750
GTTCCACCTG AAGAAGGGTT ACATGATTGT CAAGTGCCGG GGCCAGCAGG 1800
AGATCCAGGA CCAGCTGAGC CTGTCCGAAG CCCTGCAGAG AGAGAAGATC 1850
TTCTTTGAGA ACCACCCATA TTTCAGGGAT CTGCTGGAGG AAGGAAAGGC 1900
CACGGTTCCC TGCCTGGCAG AAAAACTTAC CAGCGAGCTC ATCACACATA 1950
TCTGTAAATC TCTGCCCCTG TTAGAAAATC AAATCAAGGA GACTCACCAG 2000
AGAATAACAG AGGAGCTACA AAAGTATGGT GTCGACATAC CGGAAGACGA 2050
AAATGAAAAA ATGTTCTTCC TGATAGATAA AGTTAATGCC TTTAATCAGG 2100
ACATCACTGC TCTCATGCAA GGAGAGGAAA CTGTAGGGGA GGAAGACATT 2150
CGGCTGTTTA CCAGACTCCG ACACGAGTTC CACAAATGGA GTACAATAAT 2200
TGAAACAAT TTTCAAGAG GCCATAAAAT TTTGAGTAGA AAAATCCAGA 2250
AATTTGAAAA TCAGTATCGT GGTAGAGAGC TGCCAGGCTT TGTGAATTAC 2300
AGGACATTTG AGACAATCGT GAAACAGCAA ATCAAGGCAC TGGAAGAGCC 2350
GGCTGTGGAT ATGCTACACA CCGTGACGGA TATGGTCCGG CTTGCTTTCA 2400
CAGATGTTTC GATAAAAAAT TTTGAAGAGT TTTTAACCCT CCACAGAACC 2450
GCCAAGTCCA AAATTGAAGA CATTAGAGCA GAACAAGAGA GAGAAGGTGA 2500
GAAGCTGATC CGCCTCCACT TCCAGATGGA ACAGATTGTC TACTGCCAGG 2550
```

FIG. 57B

```
ACCAGGTATA CAGGGGTGCA TTGCAGAAGG TCAGAGAGAA GGAGCTGGAA  2600
GAAGAAAAGA AGAAGAAATC CTGGGATTTT GGGGCTTTCC AGTCCAGCTC  2650
GGCAACAGAC TCTTCCATGG AGGAGATCTT TCAGCACCTG ATGGCCTATC  2700
ACCAGGAGGC CAGCAAGCGC ATCTCCAGCC ACATCCCTTT GATCATCCAG  2750
TTCTTCATGC TCCAGACGTA CGGCCAGCAG CTTCAGAAGG CCATGCTGCA  2800
GCTCCTGCAG GACAAGGACA CCTACAGCTG GCTCCTGAAG GAGCGGAGCG  2850
ACACCAGCGA CAAGCGGAAG TTCCTGAAGG AGCGGCTTGC ACGGCTGACG  2900
CAGGCTCGGC GCCGGCTTGC CCAGTTCCCC GGTTAACCAC ACTCTGTCCA  2950
GCCCCGTAGA CGTGCACGCA CACTGTCTGC CCCCGTTCCC GGGTAGCCAC  3000
TGGACTGACG ACTTGAGTGC TCAGTAGTCA GACTGGATAG TCCGTCTCTG  3050
CTTATCCGTT AGCCGTGGTG ATTTAGCAGG AAGCTGTGAG AGCAGTTTGG  3100
TTTCTAGCAT GAAGACAGAG CCCCACCCTC AGATGCACAT GAGCTGGCGG  3150
GATTGAAGGA TGCTGTCTTC GTACTGGGAA AGGGATTTTC AGCCCTCAGA  3200
ATCGCTCCAC CTTGCAGCTC TCCCCTTCTC TGTATTCCTA GAAACTGACA  3250
CATGCTGAAC ATCACAGCTT ATTTCCTCAT TTTTATAATG TCCCTTCACA  3300
AACCCAGTGT TTTAGGAGCA TGAGTGCCGT GTGTGTGCGT CCTGTCGGAG  3350
CCCTGTCTCC TCTCTCTGTA ATAAACTCAT TTCTAGCAGA CAaaaaaaaa  3400
aaaaaaaa (SEQ ID NO: 57)
```

FIG. 58

```
MVVSEVDIAKADPAAASHPLLLNGDATVAQKNPGSVAENNLCSQYEEKVRPCIDLIDSLR
ALGVEQDLALPAIAVIGDQSSGKSSVLEALSGVALPRGSGIVTRCPLVLKLKKLVNEDKW
RGKVSYQDYEIEISDASEVEKEINKAQNAIAGEGMGISHELITLEISSRDVPDLTLIDLP
GITRVAVGNQPADIGYKIKTLIKKYIQRQETISLVVVPSNVDIATTEALSMAQEVDPEGD
RTIGILTKPDLVDKGTEDKVVDVVRNLVFHLKKGYMIVKCRGQQEIQDQLSLSEALQREK
IFFENHPYFRDLLEEGKATVPCLAEKLTSELITHICKSLPLLENQIKETHQRITEELQKY
GVDIPEDENEKMFFLIDKVNAFNQDITALMQGEETVGEEDIRLFTRLRHEFHKWSTIIEN
NFQEGHKILSRKIQKFENQYRGRELPGFVNYRTFETIVKQQIKALEEPAVDMLHTVTDMV
RLAFTDVSIKNFEEFFNLHRTAKSKIEDIRAEQEREGEKLIRLHFQMEQIVYCQDQVYRG
ALQKVREKELEEEKKKKSWDFGAFQSSSATDSSMEEIFQHLMAYHQEASKRISSHIPLII
QFFMLQTYGQQLQKAMLQLLQDKDTYSWLLKERSDTSDKRKFLKERLARLTQARRRLAQF
PG- (SEQ ID NO: 58)
```

FIG. 59A

```
GCTCTTAAGA CTAGCACGGT GGGCTGGCAG GCGCCCGCTG TCGGCCGAGG    50
ACTGTCTGGG CGCGCTTCCT GGAGGAGGCG GTGCGTTTCG CGCGCTCGCT   100
GCCGGCGAGC CAGCCTCTTC CCTTACTCAC CGGTGTCCGG AAAGGTGAAC   150
GCTGCGCTCG GGCTGCCTCG CCTGTTACCT CCGCCGCCGG GCATGCTCAG   200
CGTCTGCAGC TGCCGGACCA GCTCCGGCAT GCGGTCCCAG TGGCCCTCGG   250
CGCGGCAGCG CTCCAGCTCG CTCTCCACCT TCAGATATTG ATGACCATGA   300
GATCCCTGCT CAGAACCCCC TTCCTGTGTG GCCTGCTCTG GCCTTTTGT    350
GCCCCAGGCG CCAGGGCTGA GGAGCCTGCA GCCAGCTTCT CCCAACCCGG   400
CAGCATGGGC CTGGATAAGA ACACAGTGCA CGACCAAGAG CATATCATGG   450
AGCATCTAGA AGGTGTCATC AACAAACCAG AGGCGGAGAT GTCGCCACAA   500
GAATTGCAGC TCCATTACTT CAAAATGCAT GATTATGATG CAATAATTT    550
GCTTGATGGC TTAGAACTCT CCACAGCCAT CACTCATGTC CATAAGGAGG   600
AAGGGAGTGA ACAGGCACCA CTAATGAGTG AAGATGAACT GATTAACATA   650
ATAGATGGTG TTTTGAGAGA TGATGACAAG AACAATGATG GATACATTGA   700
CTATGCTGAA TTTGCAAAAT CACTGCAGTA GATGTTATTT GGCCATCTCC   750
TGGTTATATA CAAATGTGAC CCGTGATAAT GTGATTGAAC ACTTTAGTAA   800
TGCAAAATAA CTCATTTCCA ACTACTGCTG CAGCATTTTG GTAAAAACCT   850
GTAGCGATTC GTTACACTGG GGTGAGAAGA GATAAGAGAA ATGAAAGAGA   900
AGAGAAATGG GACATCTAAT AGTCCCTAAG TGCTATTAAA TACCTTATTG   950
GACAAGGGCT TGCTTCAAGC ATCTGTATTA GTCTGTATTA ATGCTGCTGA  1000
TAAAGACGTA CCCGAGACTG GGAAGAAAAA GAGGTTTACT TGGACTTACA  1050
GTTCCACATG GCTGGGGAGG CCTCAGAATC ATGGCGGGAG GTGAAAGGCA  1100
CTTCTTACAT GGCAGCAAGA GAAAATGAGG AAGAAGCAAA AGTGGAAACC  1150
CCTGATAAGC CATCAGATCT TGTGAAACTT ATTCACTATC ACAAGAATAG  1200
CATGGGAAAG ACTGGCCCCC ATGATTCAAT TACCTCCCCT TGGGTCTCTC  1250
CCACAACACG TGGGAATTCT GGTAGATACA ATTTCAAGTT GAGATTTGGG  1300
TGGGGACATA GCCAAACCAT ATCATTCTAC CCCTGGCCCC TCCAAATCTC  1350
ATGTCCTCAC TATTCAAAAC CAATCATGCC TTCCTAACAG TCCCCCAAAG  1400
TCTTAACTCT TTTCAGCATT AACGCAAAAA TCCACAGTCC AAAGTCTCAT  1450
CTGAGACAAG GCAAGTCCCT TCCACCTATG AGCCTGTAAA ATCAAAAGCA  1500
AGCTAGTTAC TTCCTAGATA CCAACAGGGG TACAGGTATT GATTAAAGAC  1550
GGCTGTTCCA AATGGGAGAA ATTGGCCAAA ATAAAGGGGT TACAGGGCCC  1600
ATGCAAGTCC GAAATCCAGC AGGGCTGTCA AATTTTAAAG TTCCAGAATA  1650
ATCTCCTTTG ACTCCAGGTC TCACATCCAG GTCATACTGA TGCAAGAAGT  1700
GGGTTCCCAT GGTCTTGGGC AGCTCTGCCC CTGTGGCTTT GTAGGGTACA  1750
GCCTCCCTCC TGGCTGCTTT CACGGCTGTT GTTCAGTGCC TGCGGCTTTT  1800
CCAGGTGCAC GGTGCAAGCT GTTGGTGGAT CTACCATTCT GGGGTCTGGA  1850
GGACGGTGGC CCTCTTCTCA CAGCTCCACT AGGCAGTGCC CCAGTAGGGA  1900
CTCTGTGTGG GGGCTCCCAC ACCACATTTC CCTTCTGCAC TGCCCTAGCA  1950
GAGGTTCTCT CCCCTGCCGC TGAGAGGGCC TCTCCCCTGC AGCAAACGTT  2000
TGCCTGGGCA TTGAGGCATT CCATACATC TTCTGAAAAC TAGGCGGAGG   2050
TTTCCAAATC TCAATTCTTG ACTTCTGTGC ACCTGCAGGC TTAACAGCAC  2100
ATAGAAGCTG CCAAGGCTTG GGCTTCCAC TCTGAAGCCA CAGCCCGAGC   2150
TGTATGTTGG CCCCTTTCAG CCATGGCTGG AGTGGCTGGG ACACAAGACA  2200
CCAAGTCCCT AGGCTGCACA CACATGTCAG GGGCTGCCCT GACATGGCCT  2250
GGAGACATTT TCCCCATGGT GTTGGGGATT AACATTAGGC TCCTTGCTAC  2300
TTATGCAAAT TTCTGCAGCT GGCTTGAATT TCTCCCAGA AAATGGGTTT   2350
TTCTTTTCTA TTGCATAGTC AGGCTGCAAA TTTCCAAACT TTTATGCTTT  2400
GCTTCCCTTA TTTATAAGGG AATGCCTTTA AAAGCACCCA AGTCACCTGT  2450
TGAACACTTT GCTGCTTAGA AATTTCTTCC GCTAGTTAAC CTAAATCATC  2500
TCTCTCAAGT TCAAAGTTCC ACAAATCCCT ATGGAAGGGG CAAAATGCTG  2550
```

FIG. 59B

```
CCAGTCTCTT TGCTAAAACA TAACAAGAGT CACCTTTACT CCAGTTCCCA 2600
ACAAGTTCCT CATCTTCATC TGAGGCCACC TCAGCCTGGA CTTTGTTGTC 2650
CATATTGCTA TCAGCATTTG GGGCAAAGCC ATTCAACAAG TCTGTAGGAA 2700
GTTCCAAACT TTCCCACATT TTCCTGTTTT CTTCTGAGCC CTCCAAACTG 2750
TTCCAGCCTC TGCCTGTTAC CCAGTTCCAA AGTCACTTCC ACATTTTGGG 2800
TATTTCTTCA GCAGGTCCCA ATCTACTGGT ACCAATTTAC TGTATTAGTC 2850
CGTTTTCACG CTGCTGATAA AGACATACCC GAGACTGGGA AGAAAAAGTG 2900
GTTTAATTGG ACTTAAAGTT CCACATGGCT GGGGAGGCCT CAGAATCATG 2950
GTGGGAGGCA AAAGACACTT CTTACATTGT GGCAAGAAAA AATGAGGAAG 3000
AAGCAAAAGC AGAAACCCCT GATAAACTGA TCAGATCTCA TGAGACTTAT 3050
TCACTGTCAC GAGAATAGCA CGGGAAAGAC TGGCCCCCAT GATTCAATTA 3100
CCTCCCCCTG GGTCTGTCCC ACAACACGTG GGAATTCTGG GAGATACAAT 3150
TCAAGTTGAG ATTTGTGGGG GGACACAACC AAACCATATC AGCATCCTTT 3200
CAAGAATATT AGATAATTGG AGCTGAGTAC TCAGGAACTT GACTGTAGTA 3250
GAATACTGCT AGTTTCTTAA TTTTAATTCA CATCACCTGA AAAGTAAAAC 3300
AACAGGCTTT GCCAAGTGGA TGCTTTTCAG TAACAGTGAA GTGGAGTGAA 3350
TACCAAATGT TTGCCCTGGT GGTTCCTATC TCTTCAGGCA AACATGGTCA 3400
GTATTCTGTA AAGTTCCCCT GGCCTAAATG ATTACTTGCT CTGGGCAAGT 3450
GGATATTTAT TAGGCTATTT CAAAGCCACA GCATAAGAAT GTCAGCCTAG 3500
CCACAGAGTC TGAGATTCTG AGTTCAGCCT AGCCACAGAG TCTAAGATTC 3550
TGTATCCTCT GACATTTTGG AAATGATACA CTACTGGCTT AAGTGATGAC 3600
TCTTTCAGAT TTTCAGTATT TTATACAACT ACTGCCACAT CCTTATACTT 3650
TATTGCTTTT CTGTCTTCTT CAACCTGGGA GAGACCCTGA ATTTGAGTGT 3700
GTTCTCTAAT CAATAGTGGT TTAGCTTTCT TTTCTATTTC ACTCGTTTCT 3750
AGGGTTTTTT ATTTGCAGTT TAGGAACTAT TAGGAATGTC AGGACTTTAT 3800
CAGCAGGGGT AAAACTACCA CCTGGCCTAG CCTAAGTAGG AAGTGAAAAG 3850
ATAATTCACC AAACAATGAT TAATCAGATA GAAGTTCTAG TCAAGAGGGA 3900
TATTGTTGAA GTTACCTCTT TTAGCCTAGA TACATGGATT CTTTTCAAAT 3950
CAGGAAAGAT TAGAAAGGA ACCCAAAAAA CCCTTTAACA GTGTGAATCT 4000
TTATAGTATT TGAAAATGAG AAGAAGCAGC AGATTGTAAT TTGGTTTATT 4050
GGATGTGATG GACGTTCTGT AATAGAAAAC CTGAAACGAT GATTGAATGG 4100
GAAAAGAGA CTACAAAATT TGTCGTAGGA TGTATACAGA CTTATTTTCT 4150
TTATTACAGT ATTATAAGAA AACATATGTA TTTGTAAAAA TGGTTTCCTG 4200
TGTCAAGTAT TTGTGCAGTC AGAGCTGACT TGTAAACTAT TCTTGTAATA 4250
GCTCATTATT TTGAAAGATT TATATATGAT GAATTCTGGA TATATGACCA 4300
ATAAAACTGA TGAAGCAAAA CCTCaaaaaa aaaa (SEQ ID NO: 59)
```

FIG. 60

MTMRSLLRTPFLCGLLWAFCAPGARAEEPAASFSQPGSMGLDKNTVHDQEHIMEHLEGVI
NKPEAEMSPQELQLHYFKMHDYDGNNLLDGLELSTAITHVHKEEGSEQAPLMSEDELINI
IDGVLRDDDKNNDGYIDYAEFAKSLQ- (SEQ ID NO: 60)

FIG. 61A

```
AGCTGCAAGT GGCGGGCGCC CAGGCAGATG CGATCCAGCG GCTCTGGGGG    50
CGGCAGCGGT GGTAGCAGCT GGTACCTCCC GCCGCCTCTG TTCGGAGGGT   100
CGCGGGGCAC CGAGGTGCTT TCCGGCCGCC CTCTGGTCGG CCACCCAAAG   150
CCGCGGGCGC TGATGATGGG TGAGGAGGGG GCGGCAAGAT TCGGGCGCC    200
CCTGCCCTGA ACGCCCTCAG CTGCTGCCGC CGGGGCCGCT CCAGTGCCTG   250
CGAACTCTGA GGAGCCGAGG CGCCGGTGAG AGCAAGGACG CTGCAAACTT   300
GCGCAGCGCG GGGGCTGGGA TTCACGCCCA GAAGTTCAGC AGGCAGACAG   350
TCCGAAGCCT TCCCGCAGCG GAGAGATAGC TTGAGGGTGC GCAAGACGGC   400
AGCCTCCGCC CTCGGTTCCC GCCCAGACCG GGCAGAAGAG CTTGGAGGAG   450
CCAAAAGGAA CGCAAAAGGC GGCCAGGACA GCGTGCAGCA GCTGGGAGCC   500
GCCGTTCTCA GCCTTAAAAG TTGCAGAGAT GGAGGCTGC CCCGAGAGGG    550
GACAGACCCC AGCTCCGACT GCGGGGGGCA GGAGAGGACG GTACCCAACT   600
GCCACCTCCC TTCAACCATA GTAGTTCCTC TGTACCGAGC GCAGCGAGCT   650
ACAGACGGGG GCGCGGCACT CGGCGCGGAG AGCGGGAGGC TCAAGGTCCC   700
AGCCAGTGAG CCCAGTGTGC TTGAGTGTCT CTGGACTCGC CCCTGAGCTT   750
CCAGGTCTGT TTCATTTAGA CTCCTGCTCG CCTCCGTGCA GTTGGGGGAA   800
AGCAAGAGAC TTGCGCGCAC GCACAGTCCT CTGGAGATCA GGTGGAAGGA   850
GCCGCTGGGT ACCAAGGACT GTTCAGAGCC TCTTCCCATC TCGGGGAGAG   900
CGAAGGGTGA GGCTGGGCCC GGAGAGCAGT GTAAACGGCC TCCTCCGGCG   950
GGATGGGAGC CATCGGGCTC CTGTGGCTCC TGCCGCTGCT GCTTTCCACG  1000
GCAGCTGTGG GCTCCGGGAT GGGGACCGGC CAGCGCGCGG GCTCCCCAGC  1050
TGCGGGGCCG CCGCTGCAGC CCCGGGAGCC ACTCAGCTAC TCGCGCCTGC  1100
AGAGGAAGAG TCTGGCAGTT GACTTCGTGG TGCCCTCGCT CTTCCGTGTC  1150
TACGCCCGGG ACCTACTGCT GCCACCATCC TCCTCGGAGC TGAAGGCTGG  1200
CAGGCCCGAG GCCCGCGGCT CGCTAGCTCT GGACTGCGCC CCGCTGCTCA  1250
GGTTGCTGGG GCCGGCGCCG GGGGTCTCCT GGACCGCCGG TTCACCAGCC  1300
CCGGCAGAGG CCCGGACGCT GTCCAGGGTG CTGAAGGGCG GCTCCGTGCG  1350
CAAGCTCCGG CGTGCCAAGC AGTTGGTGCT GGAGCTGGGC GAGGAGGCGA  1400
TCTTGGAGGG TTGCGTCGGG CCCCCCGGGG AGGCGGCTGT GGGGCTGCTC  1450
CAGTTCAATC TCAGCGAGCT GTTCAGTTGG TGGATTCGCC AAGGCGAAGG  1500
GCGACTGAGG ATCCGCCTGA TGCCCGAGAA GAAGGCGTCG GAAGTGGGCA  1550
GAGAGGGAAG GCTGTCCGCG GCAATTCGCG CCTCCCAGCC CCGCCTTCTC  1600
TTCCAGATCT TCGGGACTGG TCATAGCTCC TTGGAATCAC CAACAAACAT  1650
GCCTTCTCCT TCTCCTGATT ATTTACATG GAATCTCACC TGGATAATGA   1700
AAGACTCCTT CCCTTTCCTG TCTCATCGCA GCCGATATGG TCTGGAGTGC  1750
AGCTTTGACT TCCCCTGTGA GCTGGAGTAT TCCCCTCCAC TGCATGACCT  1800
CAGGAACCAG AGCTGGTCCT GGCGCCGCAT CCCCTCCGAG GAGGCCTCCC  1850
AGATGGACTT GCTGGATGGG CCTGGGCAG AGCGTTCTAA GGAGATGCCC   1900
AGAGGCTCCT TTCTCCTTCT CAACACCTCA GCTGACTCCA AGCACACCAT  1950
CCTGAGTCCG TGGATGAGGA GCAGCAGTGA GCACTGCACA CTGGCCGTCT  2000
CGGTGCACAG GCACCTGCAG CCCTCTGGAA GGTACATTGC CCAGCTGCTG  2050
CCCCACAACG AGGCTGCAAG AGAGATCCTC CTGATGCCCA CTCCAGGGAA  2100
GCATGGTTGG ACAGTGCTCC AGGGAAGAAT CGGGCGTCCA GACAACCCAT  2150
TTCGAGTGGC CCTGGAATAC ATCTCCAGTG GAAACCGCAG CTTGTCTGCA  2200
GTGGACTTCT TTGCCCTGAA GAACTGCAGT GAAGGAACAT CCCCAGGCTC  2250
CAAGATGGCC CTGCAGAGCT CCTTCACTTG TTGGAATGGG ACAGTCCTCC  2300
AGCTTGGGCA GGCCTGTGAC TTCCACCAGG ACTGTGCCCA GGGAAGAAGAT 2350
GAGAGCCAGA TGTGCCGGAA ACTGCCTGTG GGTTTTACT GCAACTTTGA   2400
AGATGGCTTC TGTGGCTGGA CCCAAGGCAC ACTGTCACCC CACACTCCTC  2450
AATGGCAGGT CAGGACCCTA AAGGATGCCC GGTTCCAGGA CCACCAAGAC  2500
CATGCTCTAT TGCTCAGTAC CACTGATGTC CCCGCTTCTG AAAGTGCTAC  2550
```

FIG. 61B

```
AGTGACCAGT GCTACGTTTC CTGCACCGAT CAAGAGCTCT CCATGTGAGC  2600
TCCGAATGTC CTGGCTCATT CGTGGAGTCT TGAGGGGAAA CGTGTCCTTG  2650
GTGCTAGTGG AGAACAAAAC CGGGAAGGAG CAAGGCAGGA TGGTCTGGCA  2700
TGTCGCCGCC TATGAAGGCT TGAGCCTGTG GCAGTGGATG GTGTTGCCTC  2750
TCCTCGATGT GTCTGACAGG TTCTGGCTGC AGATGGTCGC ATGGTGGGGA  2800
CAAGGATCCA GAGCCATCGT GGCTTTTGAC AATATCTCCA TCAGCCTGGA  2850
CTGCTACCTC ACCATTAGCG GAGAGGACAA GATCCTGCAG AATACAGCAC  2900
CCAAATCAAG AAACCTGTTT GAGAGAAACC CAAACAAGGA GCTGAAACCC  2950
GGGGAAAATT CACCAAGACA GACCCCCATC TTTGACCCTA CAGTTCATTG  3000
GCTGTTCACC ACATGTGGGG CCAGCGGGCC CCATGGCCCC ACCCAGGCAC  3050
AGTGCAACAA CGCCTACCAG AACTCCAACC TGAGCGTGGA GGTGGGGAGC  3100
GAGGGCCCCC TGAAAGGCAT CCAGATCTGG AAGGTGCCAG CCACCGACAC  3150
CTACAGCATC TCGGGCTACG GAGCTGCTGG CGGGAAAGGC GGGAAGAACA  3200
CCATGATGCG GTCCCACGGC GTGTCTGTGC TGGGCATCTT CAACCTGGAG  3250
AAGGATGACA TGCTGTACAT CCTGGTTGGG CAGCAGGGAG AGGACGCCTG  3300
CCCCAGTACA AACCAGTTAA TCCAGAAAGT CTGCATTGGA GAGAACAATG  3350
TGATAGAAGA AGAAATCCGT GTGAACAGAA GCGTGCATGA GTGGGCAGGA  3400
GGCGGAGGAG GAGGGGGTGG AGCCACCTAC GTATTTAAGA TGAAGGATGG  3450
AGTGCCGGTG CCCCTGATCA TTGCAGCCGG AGGTGGTGGC AGGGCCTACG  3500
GGGCCAAGAC AGACACGTTC CACCCAGAGA GACTGGAGAA TAACTCCTCG  3550
GTTCTAGGGC TAAACGGCAA TTCCGGAGCC GCAGGTGGTG GAGGTGGCTG  3600
GAATGATAAC ACTTCCTTGC TCTGGGCCGG AAAATCTTTG CAGGAGGGTG  3650
CCACCGGAGG ACATTCCTGC CCCCAGGCCA TGAAGAAGTG GGGGTGGGAG  3700
ACAAGAGGGG GTTTCGGAGG GGGTGGAGGG GGGTGCTCCT CAGGTGGAGG  3750
AGGCGGAGGA TATATAGGCG GCAATGCAGC CTCAAACAAT GACCCCGAAA  3800
TGGATGGGGA AGATGGGGTT TCCTTCATCA GTCCACTGGG CATCCTGTAC  3850
ACCCCAGCTT TAAAAGTGAT GGAAGGCCAC GGGGAAGTGA ATATTAAGCA  3900
TTATCTAAAC TGCAGTCACT GTGAGGTAGA CGAATGTCAC ATGGACCCTG  3950
AAAGCCACAA GGTCATCTGC TTCTGTGACC ACGGGACGGT GCTGGCTGAG  4000
GATGGCGTCT CCTGCATTGT GTCACCCACC CCGGAGCCAC ACCTGCCACT  4050
CTCGCTGATC CTCTCTGTGG TGACCTCTGC CCTCGTGGCC GCCCTGGTCC  4100
TGGCTTTCTC CGGCATCATG ATTGTGTACC GCCGGAAGCA CCAGGAGCTG  4150
CAAGCCATGC AGATGGAGCT GCAGAGCCCT GAGTACAAGC TGAGCAAGCT  4200
CCGCACCTCG ACCATCATGA CCGACTACAA CCCCAACTAC TGCTTTGCTG  4250
GCAAGACCTC CTCCATCAGT GACCTGAAGG AGGTGCCGCG GAAAAACATC  4300
ACCCTCATTC GGGGTCTGGG CCATGGCGCC TTTGGGGAGG TGTATGAAGG  4350
CCAGGTGTCC GGAATGCCCA ACGACCCAAG CCCCCTGCAA GTGGCTGTGA  4400
AGACGCTGCC TGAAGTGTGC TCTGAACAGG ACGAACTGGA TTTCCTCATG  4450
GAAGCCCTGA TCATCAGCAA ATTCAACCAC CAGAACATTG TTCGCTGCAT  4500
TGGGGTGAGC CTGCAATCCC TGCCCCGGTT CATCCTGCTG GAGCTCATGG  4550
CGGGGGGAGA CCTCAAGTCC TTCCTCCGAG AGACCCGCCC TCGCCCGAGC  4600
CAGCCCTCCT CCCTGGCCAT GCTGGACCTT CTGCACGTGG CTCGGGACAT  4650
TGCCTGTGGC TGTCAGTATT TGGAGGAAAA CCACTTCATC CACCGAGACA  4700
TTGCTGCCAG AAACTGCCTC TTGACCTGTC CAGGCCCTGG AAGAGTGGCC  4750
AAGATTGGAG ACTTCGGGAT GGCCCGAGAC ATCTACAGGG CGAGCTACTA  4800
TAGAAAGGGA GGCTGTGCCA TGCTGCCAGT TAAGTGGATG CCCCCAGAGG  4850
CCTTCATGGA AGGAATATTC ACTTCTAAAA CAGACACATG GTCCTTTGGA  4900
GTGCTGCTAT GGGAAATCTT TTCTCTTGGA TATATGCCAT ACCCCAGCAA  4950
AAGCAACCAG GAAGTTCTGG AGTTTGTCAC CAGTGGAGGC CGGATGGACC  5000
CACCCAAGAA CTGCCCTGGG CCTGTATACC GGATAATGAC TCAGTGCTGG  5050
CAACATCAGC CTGAAGACAG GCCCAACTTT GCCATCATTT TGGAGAGGAT  5100
```

FIG. 61C

```
TGAATACTGC ACCCAGGACC CGGATGTAAT CAACACCGCT TTGCCGATAG  5150
AATATGGTCC ACTTGTGGAA GAGGAAGAGA AAGTGCCTGT GAGGCCCAAG  5200
GACCCTGAGG GGGTTCCTCC TCTCCTGGTC TCTCAACAGG CAAAACGGGA  5250
GGAGGAGCGC AGCCCAGCTG CCCCACCACC TCTGCCTACC ACCTCCTCTG  5300
GCAAGGCTGC AAAGAAACCC ACAGCTGCAG AGATCTCTGT TCGAGTCCCT  5350
AGAGGGCCGG CCGTGGAAGG GGGACACGTG AATATGGCAT TCTCTCAGTC  5400
CAACCCTCCT TCGGAGTTGC ACAAGGTCCA CGGATCCAGA AACAAGCCCA  5450
CCAGCTTGTG GAACCCAACG TACGGCTCCT GGTTTACAGA GAAACCCACC  5500
AAAAAGAATA ATCCTATAGC AAAGAAGGAG CCACACGACA GGGGTAACCT  5550
GGGGCTGGAG GGAAGCTGTA CTGTCCCACC TAACGTTGCA ACTGGGAGAC  5600
TTCCGGGGGC CTCACTGCTC CTAGAGCCCT CTTCGCTGAC TGCCAATATG  5650
AAGGAGGTAC CTCTGTTCAG GCTACGTCAC TTCCCTTGTG GGAATGTCAA  5700
TTACGGCTAC CAGCAACAGG GCTTGCCCTT AGAAGCCGCT ACTGCCCTG   5750
GAGCTGGTCA TTACGAGGAT ACCATTCTGA AAAGCAAGAA TAGCATGAAC  5800
CAGCCTGGGC CCTGAGCTCG GTCGCACACT CACTTCTCTT CCTTGGGATC  5850
CCTAAGACCG TGGAGGAGAG AGAGGCAATG GCTCCTTCAC AAACCAGAGA  5900
CCAAATGTCA CGTTTTGTTT TGTGCCAACC TATTTTGAAG TACCACCAAA  5950
AAAGCTGTAT TTTGAAAATG CTTTAGAAAG GTTTTGAGCA TGGGTTCATC  6000
CTATTCTTTC GAAAGAAGAA AATATCATAA AAATGAGTGA TAAATACAAG  6050
GCCCAGATGT GGTTGCATAA GGTTTTTATG CATGTTTGTT GTATACTTCC  6100
TTATGCTTCT TTCAAATTGT GTGTGCTCTG CTTCAATGTA GTCAGAATTA  6150
GCTGCTTCTA TGTTTCATAG TTGGGGTCAT AGATGTTTCC TTGCCTTGTT  6200
GATGTGGACA TGAGCCATTT GAGGGGAGAG GGAACGGAAA TAAAGGAGTT  6250
ATTTGTAATG ACTAAaa (SEQ ID NO: 61)
```

FIG. 62

```
MGAIGLLWLLPLLLSTAAVGSGMGTGQRAGSPAAGPPLQPREPLSYSRLQRKSLAVDFVV
PSLFRVYARDLLLPPSSSELKAGRPEARGSLALDCAPLLRLLGPAPGVSWTAGSPAPAEA
RTLSRVLKGGSVRKLRRAKQLVLELGEEAILEGCVGPPGEAAVGLLQFNLSELFSWWIRQ
GEGRLRIRLMPEKKASEVGREGRLSAAIRASQPRLLFQIFGTGHSSLESPTNMPSPSPDY
FTWNLTWIMKDSFPFLSHRSRYGLECSFDFPCELEYSPPLHDLRNQSWSWRRIPSEEASQ
MDLLDGPGAERSKEMPRGSFLLLNTSADSKHTILSPWMRSSSEHCTLAVSVHRHLQPSGR
YIAQLLPHNEAAREILLMPTPGKHGWTVLQGRIGRPDNPFRVALEYISSGNRSLSAVDFF
ALKNCSEGTSPGSKMALQSSFTCWNGTVLQLGQACDFHQDCAQGEDESQMCRKLPVGFYC
NFEDGFCGWTQGTLSPHTPQWQVRTLKDARFQDHQDHALLLSTTDVPASESATVTSATFP
APIKSSPCELRMSWLIRGVLRGNVSLVLVENKTGKEQGRMVWHVAAYEGLSLWQWMVLPL
LDVSDRFWLQMVAWWGQGSRAIVAFDNISISLDCYLTISGEDKILQNTAPKSRNLFERNP
NKELKPGENSPRQTPIFDPTVHWLFTTCGASGPHGPTQAQCNNAYQNSNLSVEVGSEGPL
KGIQIWKVPATDTYSISGYGAAGGKGGKNTMMRSHGVSVLGIFNLEKDDMLYILVGQQGE
DACPSTNQLIQKVCIGENNVIEEEIRVNRSVHEWAGGGGGGGGATYVFKMKDGVPVPLII
AAGGGGRAYGAKTDTFHPERLENNSSVLGLNGNSGAAGGGGGWNDTSLLWAGKSLQEGA
TGGHSCPQAMKKWGWETRGGFGGGGGGCSSGGGGGGYIGGNAASNNDPEMDGEDGVSFIS
PLGILYTPALKVMEGHGEVNIKHYLNCSHCEVDECHMDPESHKVICFCDHGTVLAEDGVS
CIVSPTPEPHLPLSLILSVVTSALVAALVLAFSGIMIVYRRKHQELQAMQMELQSPEYKL
SKLRTSTIMTDYNPNYCFAGKTSSISDLKEVPRKNITLIRGLGHGAFGEVYEGQVSGMPN
DPSPLQVAVKTLPEVCSEQDELDFLMEALIISKFNHQNIVRCIGVSLQSLPRFILLELMA
GGDLKSFLRETRPRPSQPSSLAMLDLLHVARDIACGCQYLEENHFIHRDIAARNCLLTCP
GPGRVAKIGDFGMARDIYRASYYRKGGCAMLPVKWMPPEAFMEGIFTSKTDTWSFGVLLW
EIFSLGYMPYPSKSNQEVLEFVTSGGRMDPPKNCPGPVYRIMTQCWQHQPEDRPNFAIIL
ERIEYCTQDPDVINTALPIEYGPLVEEEKVPVRPKDPEGVPPLLVSQQAKREEERSPAA
PPPLPTTSSGKAAKKPTAAEISVRVPRGPAVEGGHVNMAFSQSNPPSELHKVHGSRNKPT
SLWNPTYGSWFTEKPTKKNNPIAKKEPHDRGNLGLEGSCTVPPNVATGRLPGASLLLEPS
SLTANMKEVPLFRLRHFPCGNVNYGYQQQGLPLEAATAPGAHYEDTILKSKNSMNQPGP
- (SEQ ID NO: 62)
```

FIG. 63A

```
GCGAAGCCTG GCTGAGGCTG CGAAGGgCGA GCGGCGCAGG GACCCCGCGG    50
GCGTCTGGGG CTTCCGCGGC GCCCGCCTCT GCTCCCTCCC CTCGGGCGCT   100
GGGTGCCGAC CGGCCGGCTG GCCGGCGCCG CCTCCTGGGA AGATGGCGCT   150
GCACTTCCAG AGTTTGGCTG AATTGGAAGT GTTATGTACT CATCTCTACA   200
TAGGGACTGA TCTTACACAA AGAATAGAGG CTGAGAAAGC ACTCTTGGAA   250
CTTATTGACA GTCCAGAATG TCTCAGCAAG TGTCAACTTT TATTAGAACA   300
AGGAACAACA TCCTATGCTC AGCTCCTTGC AGCAACATGT CTTTCAAAAC   350
TTGTCAGCCG AGTCAGTCCT TTACCTGTTG AGCAGAGGAT GGACATCAGA   400
AACTACATTC TGAATTACGT GGCATCACAG CCCAAGCTGG CTCCCTTTGT   450
CATCCAAGCT CTTATTCAAG TCATTGCTAA AATCACTAAG TTGGGGTGGT   500
TTGAGGTTCA GAAAGACCAA TTTGTCTTCA GAGAAATTAT TGCTGATGTG   550
AAGAAGTTTC TCCAGGTAC TGTGGAACAC TGCATAATAG GAGTAATAAT    600
CCTTTCTGAA TTGACTCAGG AAATGAACCT GGTTGATTAT TCTAGACCTT   650
CAGCAAAACA CAGGAAAATA GCTACCTCAT TCGTGATAC TTCTCTCAAA    700
GACGTTTTAG TGCTAGCATG CTCTCTTTTA AAAGAGGTGT TTGCCAAACC   750
TTTAAATCTT CAGGATCAAT GTCAGCAAAA TCTGGTAATG CAGGTCTTGA   800
AACTGGTCCT TAACTGCCTT AACTTTGACT TCATTGGCAG TTCAGCAGAT   850
GAATCTGCAG ATGATCTTTG CACGGTGCAG ATTCCAACAA CTTGGAGAAC   900
AATTTCCTG GAACCAGAAA CATTGGATCT TTTCTTCAAT TTGTATCATT    950
CACTTCCACC ACTACTATCT CAGTTAGCAC TTTCATGTTT AGTTCAGTTT  1000
GCTTCGACAA GAAGGTCCTT ATTTAACAGT CCTGAACGTG CCAAGTACCT  1050
TGGTAATTTA ATTAAGGGAG TAAAAGGAT ACTTGAAAAC CCTCAGGTT    1100
TGTCTGATCC AGGTAATTAT CATGAATTTT GTCGATTTTT GGCTCGTTTA  1150
AAGACAAATT ATCAGCTGGG AGAATTAGTT ATGGTGAAGG AATATCCTGA  1200
AGTTATTAGA TTGATTGCTA ATTTTACCAT TACTAGCCTA CAGCACTGGG  1250
AATTTGCTCC TAACAGTGTT CATTATTTAT TAACTCTGTG GCAAAGGATG  1300
GTAGCATCTG TTCCTTTTGT GAAATCAACT GAACCCCACC TATTAGACAC  1350
TTATGCACCA GAAATACGA AGGCCTTTAT CACTTCTCGG TTGGACTCTG    1400
TTGCCATAGT TGTGAGAGAT CACTTAGATG ATCCACTGGA TGATACTGCC  1450
ACTGTGTTTC AGCAGTTGGA GCAGTTGTGC ACGGTCAGCA GATGTGAATA  1500
TGAAAAGACA TGTGCTCTTC TTGTGCAGTT ATTCGACCAA AATGCACAGA  1550
ATTACCAAAA ACTTCTGCAT CCATATTCTG GTGTAACTGT GGACATCACC  1600
ATTCAGGAAG GACGTCTTGC ATGGCTGGTA TACTTAGTTG GACAGTTGT   1650
AGGAGGAAGA TTAACATATA CCAGTACAGA TGAGCATGAT GCTATGGATG  1700
GAGAATTATC CTGTCGAGTT TTTCAGCTTA TATCTTTAAT GGATACCGGA  1750
TTGCCTCGAT GTTGTAATGA GAAAATAGAG CTTGCAATTC TGTGGTTCTT  1800
GGATCAGTTT CGTAAAACAT ATGTTGGTGA TCAACTTCAA AGAACCTCAA  1850
AGGTATATGC TCGTATGTCA GAAGTCTTAG GAATAACAGA TGACAACCAC  1900
GTTCTAGAGA CGTTCATGAC AAAAATTGTT ACAAACCTTA AATACTGGGG  1950
AAGATATGAG CCTGTAATTT CAAGGACTCT TCAGTTCCTA AATGACCTTT  2000
CTGTTGGTTA TATCCTTTTA AAAAAACTTG TGAAGATAGA TGCTGTGAAA  2050
TTCATGCTAA AAAACCACAC GAGTGAACAC TTCCCTTTTC TTGGCATCAG  2100
TGACAATCAT AGTCTCAGCG ACTTCAGGTG TCGAACAACC TTCTACACAG  2150
CGCTCACTCG CCTTCTGATG GTAGATCTGG GTGAAGATGA GGATGAATTT  2200
GAGAATTTCA TGCTGCCTCT TACAGTTGCT TTTGAAACAG TATTACAAAT  2250
ATTCAACAAC AACTTTAAAC AAGAAGATGT AAAGCGTATG TTGATCGGGC  2300
TGGCAAGAGA TCTTCGAGGG ATTGCCTTTG CACTGAACAC AAAGACCAGC  2350
TACACCATGC TGTTTGACTG GATGTACCCA ACGTACCTTC CCCTTCTTCA  2400
GAATGCTGTT GAACGGTGGT ATGGAGAGCC AACATGTACA ACTCCCATCT  2450
TGAAACTTAT GGCAGAACTT ATGCAAAACA GATCCCAGCG TTTGAATTTT  2500
GATGTATCAT CTCCTAATGG AATTCTTCTC TTCAGAGAAG CTAGTAAAAT  2550
```

FIG. 63B

```
GGTTTGCACT TATGGTAATC AGATCCTGTC CCTTGGGAGC CTCTCAAAAG 2600
ATCAGATTTA TCCAATGAAA CTCAAGGGCA TCTCCATCTG CTATTCAGCT 2650
CTCAAGTCTG CCTTGTGTGG AAATTATGTC AGCTTTGGCG TCTTCAAGTT 2700
GTATGGGGAC AACCATTTTG ACAATGTACT CCAGGCTTTT GTCAAAATGC 2750
TGCTGTCAGT GTCCCACAGT GACTTGCTAC AATACCGGAA ACTGAGCCAG 2800
TCTTATTATC CACTCCTGGA ATGTCTCACT CAGGACCATA TGAGCTTCAT 2850
CATCAACTTA GAGCCTCCTG TACTCATGTA TGTTCTCACA TCTATCTCAG 2900
AGGGACTCAC TACTCTTGAT ACAGTTGTCT CCTCCAGCTG CTGTACCAGT 2950
TTAGACTACA TCGTCACCTA CCTCTTCAAG CACATAGCAA AAGAGGGCAA 3000
GAAGCCACTT CGATGCAGAG AGGCTACCCA GGCTGGTCAG AGACTATTAC 3050
ATTTTATGCA GCAAAACCCA GATGTCCTGC AGCAGATGAT GTCTGTCCTC 3100
ATGAACACCA TTGTCTTTGA AGACTGTCGG AACCAGTGGT CAGTATCCAG 3150
GCCTCTCCTG GGGCTCATCC TGCTCAATGA GAAGTATTTC AGTGAACTGA 3200
GAGCAAGTTT GATAAACAGC CAGCCCCTCC CCAAGCAGGA GGTCCTTGCC 3250
CAGTGCTTCA GAAACCTAAT GGAAGGAGTG GAGCAGAACC TGTCCGTCAA 3300
GAACAGAGAC AGGTTCACCC AAAATCTGTC TGTATTCAGA AGAGATGTGG 3350
CAGAGGCGTT GCGCAGTGAT GGCAACACTG AACCATGCAG TCTCGACATG 3400
ATGAGCTGAC CCGACTTTTC TGACCATGTG CGGAGCAGCC TTTATCAAGA 3450
GACTCCTGAA GGTCTGGGTC TCAGGACAGT GATGTTGGCT AGCCCAGGGG 3500
AATGTATTTT TCAAAACATA CAAGCAACAG CAAAAGCCCT AACTTCTTAT 3550
ACGTCTAGCC TAATTATAAG AATTTCTAAC AGTACCAGTG TAAATTCAGT 3600
CTTTCTCTG AAAAGCAAAG GATGTGTTTT CAGTCTTTCT ATCAAATATT 3650
ATCTTTGTTC TCCTAATGCT CTGAAAGGAT GTAGAAACAA TATTTAACCA 3700
AAGAACGTAA TAAACCAGGT TTGCACCTAA GTGTGTACTA GTTTATGGTT 3750
CTGCAGTCAA GGTTGTCAAT TTGTTGGAGA TGCAGCCTTC ACCATGGATC 3800
CTGGATTGAG ACGAATGCCA TTGGAACCTG TTAAATGAGT AGTTTGTTAT 3850
GTGTCTGGAA GAAGCAGCGT TAGGGACTTT GGGCTGTGAG CATTTAGAAC 3900
GAGCCTGGAA GCACTACAGA GCATCCCACA GGACCACACG CAGGCCTCCC 3950
TGCCTCAGCT GCATCTGATA AAGTTGAGAG ACAGTAACAC AATTAAATGA 4000
CTTAGAAACA ATGTTTGCTT TTCACTGGCA TAAATCTGAA GTGGTTCAGT 4050
CTAGAAGAAT TAAGCTGTGC AATTACTGCC TGCAGAGATA TTTCTTCAGG 4100
AGGAGTCATG TAGCCCCAGT CAGAAGTTCT GGGTGGTGCC AGCACCCAGT 4150
CCTCTGCCTC CATTTAATTT TTAAGAGAAG GTGAAGGTAA CTATTAGAAT 4200
ATAATATTTG AAGCAGCTCT GCCTTCTTAG GGCTACCCAA AACAGTTCTA 4250
GGTGCTAAAA TTCAGATTTT CAGAGGATGA GAAATAGCTG GTTTCCAACT 4300
CTCCACAAAA ACTCTTATTA CTGTTGGGAC TTGGGATTCT GACTCACCCC 4350
AAACCCAGAA CATGAAGAAG ACCTTTACAG TTTGTGCTCT ACTGTTACTA 4400
GGCTATTAAT TTGAGATCGT CCACTGTCAA GTGTTTTACT ATCTCACTGC 4450
TGTTTTTATG ATTCAGGCTT ATAACAAATA TTGTATCCTT TATTTCTGAT 4500
AAGACATGAA AGGTTGGCCT TACTGTTGAA CAATAAGTAA ATCCACAGGC 4550
TCCTGTTGTA ATCTCAaaaa aaaaaa (SEQ ID NO: 63)
```

FIG. 64

MALHFQSLAELEVLCTHLYIGTDLTQRIEAEKALLELIDSPECLSKCQLLLEQGTTSYAQ
LLAATCLSKLVSRVSPLPVEQRMDIRNYILNYVASQPKLAPFVIQALIQVIAKITKLGWF
EVQKDQFVFREIIADVKKFLQGTVEHCIIGVIILSELTQEMNLVDYSRPSAKHRKIATSF
RDTSLKDVLVLACSLLKEVFAKPLNLQDQCQQNLVMQVLKLVLNCLNFDFIGSSADESAD
DLCTVQIPTTWRTIFLEPETLDLFFNLYHSLPPLLSQLALSCLVQFASTRRSLFNSPERA
KYLGNLIKGVKRILENPQGLSDPGNYHEFCRFLARLKTNYQLGELVMVKEYPEVIRLIAN
FTITSLQHWEFAPNSVHYLLTLWQRMVASVPFVKSTEPHLLDTYAPEITKAFITSRLDSV
AIVVRDHLDDPLDDTATVFQQLEQLCTVSRCEYEKTCALLVQLFDQNAQNYQKLLHPYSG
VTVDITIQEGRLAWLVYLVGTVVGGRLTYTSTDEHDAMDGELSCRVFQLISLMDTGLPRC
CNEKIELAILWFLDQFRKTYVGDQLQRTSKVYARMSEVLGITDDNHVLETFMTKIVTNLK
YWGRYEPVISRTLQFLNDLSVGYILLKKLVKIDAVKFMLKNHTSEHFPFLGISDNHSLSD
FRCRTTFYTALTRLLMVDLGEDEDEFENFMLPLTVAFETVLQIFNNNFKQEDVKRMLIGL
ARDLRGIAFALNTKTSYTMLFDWMYPTYLPLLQNAVERWYGEPTCTTPILKLMAELMQNR
SQRLNFDVSSPNGILLFREASKMVCTYGNQILSLGSLSKDQIYPMKLKGISICYSALKSA
LCGNYVSFGVFKLYGDNHFDNVLQAFVKMLLSVSHSDLLQYRKLSQSYYPLLECLTQDHM
SFIINLEPPVLMYVLTSISEGLTTLDTVVSSSCCTSLDYIVTYLFKHIAKEGKKPLRCRE
ATQAGQRLLHFMQQNPDVLQQMMSVLMNTIVFEDCRNQWSVSRPLLGLILLNEKYFSELR
ASLINSQPLPKQEVLAQCFRNLMEGVEQNLSVKNRDRFTQNLSVFRRDVAEALRSDGNTE
PCSLDMMS- (SEQ ID NO: 64)

FIG. 65A

```
GCGCTGGCGC GAGCCCACGA AGAGGTACGA TTCCGGAGAA TCGCGAGGCA    50
GAGCGGGAGC GCGCAGCCAG GTGGAAACTA ATTCTAAGCC AGACTGCTGG   100
AGATCACCCT GTTCTAGTGT GTGGAGGCTT CCACCAGGAG GCGCATTGGA   150
GTGACTGTCT GGCATCACCA AGATGACACT CCACGCCACC CGGGGGGCTG   200
CACTCCTCTC TTGGGTGAAC AGTCTACACG TGGCTGACCC TGTGGAGGCT   250
GTGCTGCAGC TCCAGGACTG CAGCATCTTC ATCAAGATCA TTGACAGAAT   300
CCATGGCACT GAAGAGGGAC AGCAAATCTT GAAGCAGCCG TGTCAGAGA    350
GACTGGACTT TGTGTGCAGT TTTCTGCAGA AAAATCGAAA ACATCCCTCT   400
TCCCCAGAAT GCCTGGTATC TGCACAGAAG GTGCTAGAGG GATCAGAGCT   450
GGAACTGGCG AAGATGACCA TGCTGCTCTT ATACCACTCT ACCATGAGCT   500
CCAAAAGTCC CAGGGACTGG GAACAGTTTG AATATAAAAT TCAGGCTGAG   550
TTGGCTGTCA TTCTTAAATT TGTGCTGGAC CATGAGGACG GGCTAAACCT   600
TAATGAGGAC CTAGAGAACT TCCTACAGAA AGCTCCTGTG CCTTCTACCT   650
GTTCTAGCAC ATTCCCTGAA GAGCTCTCCC CACCTAGCCA CCAGGCCAAG   700
AGGGAGATTC GCTTCCTAGA GCTACAGAAG GTTGCCTCCT CTTCCAGTGG   750
GAACAACTTT CTCTCAGGTT CTCCAGCTTC TCCCATGGGT GATATCCTGC   800
AGACCCCACA GTTCCAGATG AGACGGCTGA AGAAGCAGCT TGCTGATGAG   850
AGAAGTAATA GGGATGAGCT GGAGCTGGAG CTAGCTGAGA ACCGCAAGCT   900
CCTCACCGAG AAGGATGCAC AGATAGCCAT GATGCAGCAG CGCATTGACC   950
GCCTAGCCCT GCTGAATGAG AAGCAGGCGG CCAGCCCACT GGAGCCCAAG  1000
GAGCTTGAGG AGCTGCGTGA CAAGAATGAG AGCCTTACCA TGCGGCTGCA  1050
TGAAACCCTG AAGCAGTGCC AGGACCTGAA GACAGAGAAG AGCCAGATGG  1100
ATCGCAAAAT CAACCAGCTT TCGGAGGAGA ATGGAGACCT TTCCTTTAAG  1150
CTGCGGGAGT TTGCCAGTCA TCTGCAGCAG CTACAGGATG CCCTCAATGA  1200
GCTGACGGAG GAGCACAGCA AGGCCACTCA GGAGTGGCTA GAGAAGCAGG  1250
CCCAGCTGGA GAAGGAGCTC AGCGCAGCCC TGCAGGACAA GAAATGCCTT  1300
GAAGAGAAGA ACGAAATCCT TCAGGGAAAA CTTTCACAGC TGGAAGAACA  1350
CTTGTCCCAG CTGCAGGATA ACCCACCCCA GGAGAAGGGC GAGGTGCTGG  1400
GTGATGTCTT GCAGCTGGAA ACCTTGAAGC AAGAGGCAGC CACTCTTGCT  1450
GCAAACAACA CACAGCTCCA AGCCAGGGTA GAGATGCTGG AGACTGAGCG  1500
AGGCCAGCAG GAAGCCAAGC TGCTTGCTGA GCGGGGCCAC TTCGAAGAAG  1550
AAAAGCAGCA GCTGTCTAGC CTGATCACTG ACCTGCAGAG CTCCATCTCC  1600
AACCTCAGCC AGGCCAAGGA AGAGCTGGAG CAGGCCTCCC AGGCTCATGG  1650
GGCCCGGTTG ACTGCCCAGG TGGCCTCTCT GACCTCTGAG CTCACCACAC  1700
TCAATGCCAC CATCCAGCAA CAGGATCAAG AACTGGCTGG CCTGAAGCAG  1750
CAGGCCAAAG AGAAGCAGGC CCAGCTAGCA CAGACCCTCC AACAGCAAGA  1800
ACAGGCCTCC CAGGGCCTCC GCCACCAGGT GGAGCAGCTA AGCAGTAGCC  1850
TGAAGCAGAA GGAGCAGCAG TTGAAGGAGG TAGCGGAGAA GCAGGAGGCA  1900
ACTAGGCAGG ACCATGCCCA GCAACTGGCC ACTGCTGCAG AGGAGCGAGA  1950
GGCCTCCTTA AGGGAGCGGG ATGCGGCTCT CAAGCAGCTG GAGGCACTGG  2000
AGAAGGAGAA GGCTGCCAAG CTGGAGATTC TGCAGCAGCA ACTTCAGGTG  2050
GCTAATGAAG CCCGGGACAG TGCCCAGACC TCAGTGACAC AGGCCCAGCG  2100
GGAGAAGGCA GAGCTGAGCC GGAAGGTGGA GGAACTCCAG GCCTGTGTTG  2150
AGACAGCCCG CCAGGAACAG CATGAGGCCC AGGCCCAGGT TGCAGAGCTA  2200
GAGTTGCAGC TGCGGTCTGA GCAGCAAAAA GCAACTGAGA AGAAAGGGT   2250
GGCCCAGGAG AAGGACCAGC TCCAGGAGCA GCTCCAGGCC CTCAAAGAGT  2300
CCTTGAAGGT CACCAAGGGC AGCCTTGAAG AGGAGAAGCG CAGGGCTGCA  2350
GATGCCCTGG AAGAGCAGCA GCGTTGTATC TCTGAGCTGA AGGCAGAGAC  2400
CCGAAGCCTG GTGGAGCAGC ATAAGCGGGA ACGAAAGGAG CTGGAAGAAG  2450
AGAGGGCTGG GCGCAAGGGG CTGGAGGCTC GATTACAGCA GCTTGGGGAG  2500
GCCCATCAGG CTGAGACTGA AGTCCTGCGG CGGGAGCTGG CAGAGGCCAT  2550
```

FIG. 65B

```
GGCTGCCCAG CACACAGCTG AGAGTGAGTG TGAGCAGCTC GTCAAAGAAG 2600
TAGCTGCCTG GCGTGAGCGG TATGAGGATA GCCAGCAAGA GGAGGCACAG 2650
TATGGCGCCA TGTTCCAGGA ACAGCTGATG ACTTTGAAGG AGGAATGTGA 2700
GAAGGCCCGC CAGGAGCTGC AGGAGGCAAA GGAGAAGGTG GCAGGCATAG 2750
AATCCCACAG CGAGCTCCAG ATAAGCCGGC AGCAGAACGA ACTAGCTGAG 2800
CTCCATGCCA ACCTGGCCAG AGCACTCCAG CAGGTCCAAG AGAAGGAAGT 2850
CAGGGCCCAG AAGCTTGCAG ATGACCTCTC CACTCTGCAG GAAAAGATGG 2900
CTGCCACCAG CAAAGAGGTG GCCCGCTTGG AGACCTTGGT GCGCAAGGCA 2950
GGTGAGCAGC AGGAAACAGC CTCCCGGGAG TTAGTCAAGG AGCCTGCGAG 3000
GGCAGGAGAC AGACAGCCCG AGTGGCTGGA AGAGCAACAG GGACGCCAGT 3050
TCTGCAGCAC ACAGGCAGCG CTGCAGGCTA TGGAGCGGGA GGCAGAGCAG 3100
ATGGGCAATG AGCTGGAACG GCTGCGGGCC GCGCTGATGG AGAGCCAGGG 3150
GCAGCAGCAG GAGGAGCGTG GGCAGCAGGA AAGGGAGGTG GCGCGGCTGA 3200
CCCAGGAGCG GGGCCGTGCC CAGGCTGACC TTGCCCTGGA GAAGGCGGCC 3250
AGAGCAGAGC TTGAGATGCG GCTGCAGAAC GCCCTCAACG AGCAGCGTGT 3300
GGAGTTCGCT ACCCTGCAAG AGGCACTGGC TCATGCCCTG ACGGAAAAGG 3350
AAGGCAAGGA CCAGGAGTTG GCCAAGCTTC GTGGTCTGGA GGCAGCCCAG 3400
ATAAAAGAGC TGGAGGAACT TCGGCAAACC GTGAAGCAAC TGAAGGAACA 3450
GCTGGCTAAG AAAGAAAAGG AGCACGCATC TGGCTCAGGA GCCCAATCTG 3500
AGGCTGCTGG CAGGACAGAG CCAACAGGCC CCAAGCTGGA GGCACTGCGG 3550
GCAGAGGTGA GCAAGCTGGA ACAGCAATGC CAGAAGCAGC AGGAGCAGGC 3600
TGACAGCCTG GAACGCAGCC TCGAGGCTGA GCGGGCCTCC CGGGCTGAGC 3650
GGGACAGTGC TCTGGAGACT CTGCAGGGCC AGTTAGAGGA GAAGGCCCAG 3700
GAGCTAGGGC ACAGTCAGAG TGCCTTAGCC TCGGCCCAAC GGGAGTTGGC 3750
TGCCTTCCGC ACCAAGGTAC AAGACCACAG CAAGGCTGAA GATGAGTGGA 3800
AGGCCCAGGT GGCCCGGGGC CGGCAAGAGG CTGAGAGGAA AAATAGCCTC 3850
ATCAGCAGCT TGGAGGAGGA GGTGTCCATC CTGAATCGCC AGGTCCTGGA 3900
GAAGGAGGGG GAGAGCAAGG AGTTGAAGCG GCTGGTGATG GCCGAGTCAG 3950
AGAAGAGCCA GAAGCTGGAG GAGAGGCTGC GCCTGCTGCA GGCAGAGACA 4000
GCCAGCAACA GTGCCAGAGC TGCAGAACGC AGCTCTGCTC TGCGGGAGGA 4050
GGTGCAGAGC CTCCGGGAGG AGGCTGAGAA ACAGCGGGTG GCTTCAGAGA 4100
ACCTGCGGCA GGAGCTGACC TCACAGGCTG AGCGTGCGGA GGAGCTGGGC 4150
CAAGAATTGA AGGCGTGGCA GGAGAAGTTC TTCCAGAAAG AGCAGGCCCT 4200
CTCCACCCTG CAGCTCGAGC ACACCAGCAC ACAGGCCCTG GTGAGTGAGC 4250
TGCTGCCAGC TAAGCACCTC TGCCAGCAGC TGCAGGCCGA GCAGGCCGCT 4300
GCCGAGAAAC GCCACCGTGA GGAGCTGGAG CAGAGCAAGC AGGCCGCTGG 4350
GGGACTGCGG GCAGAGCTGC TGCGGGCCCA GCGGGAGCTT GGGGAGCTGA 4400
TTCCTCTGCG GCAGAAGGTG GCAGAGCAGG AGCGAACAGC TCAGCAGCTG 4450
CGGGCAGAGA AGGCCAGCTA TGCAGAGCAG CTGAGCATGC TGAAGAAGGC 4500
GCATGGCCTG CTGGCAGAGG AGAACCGGGG GCTGGGTGAG CGGGCCAACC 4550
TTGGCCGGCA GTTTCTGGAA GTGGAGTTGG ACCAGGCCCG GGAGAAGTAT 4600
GTCCAAGAGT TGGCAGCCGT ACGTGCTGAT GCTGAGACCC GTCTGGCTGA 4650
GGTGCAGCGA GAAGCACAGA GCACTGCCCG GGAGCTGGAG GTGATGACTG 4700
CCAAGTATGA GGGTGCCAAG GTCAAGGTCC TGGAGGAGAG GCAGCGGTTC 4750
CAGGAAGAGA GGCAGAAACT CACTGCCCAG GTGGAGCAGC TAGAGGTATT 4800
TCAGAGAGAG CAAACTAAGC AGGTGGAAGA ACTGAGTAAG AAACTGGCTG 4850
ACTCTGACCA AGCCAGCAAG GTGCAGCAGC AGAAGCTGAA GGCTGTCCAG 4900
GCTCAGGGAG GCGAGAGCCA GCAGGAGGCC CAGCGCCTCC AGGCCCAGCT 4950
GAATGAACTG CAAGCCCAGT TGAGCCAGAA GGAGCAGGCA GCTGAGCACT 5000
ATAAGCTGCA GATGGAGAAA GCCAAAACAC ATTATGATGC CAAGAAGCAG 5050
CAGAACCAAG AGCTGCAGGA GCAGCTGCGG AGCCTGGAGC AGCTGCAGAA 5100
```

FIG. 65C

```
GGAAAACAAA GAGCTGCGAG CTGAAGCTGA ACGGCTGGGC CATGAGCTAC  5150
AGCAGGCTGG GCTGAAGACC AAGGAGGCTG AACAGACCTG CCGCCACCTT  5200
ACTGCCCAGG TGCGCAGCCT GGAGGCACAG GTTGCCCATG CAGACCAGCA  5250
GCTTCGAGAC CTGGGCAAAT TCCAGGTGGC AACTGATGCT TTAAAGAGCC  5300
GTGAGCCCCA GGCTAAGCCC CAGCTGGACT TGAGTATTGA CAGCCTGGAT  5350
CTGAGCTGCG AGGAGGGGAC CCCACTCAGT ATCACCAGCA AGCTGCCTCG  5400
TACCCAGCCA GACGGCACCA GCGTCCCTGG AGAACCAGCC TCACCTATCT  5450
CCCAGCGCCT GCCCCCCAAG GTAGAATCCC TGGAGAGTCT CTACTTCACT  5500
CCCATCCCTG CTCGGAGTCA GGCCCCCCTG GAGAGCAGCC TGGACTCCCT  5550
GGGAGACGTC TTCCTGGACT CGGGTCGTAA GACCCGCTCC GCTCGTCGGC  5600
GCACCACGCA GATCATCAAC ATCACCATGA CCAAGAAGCT AGATGTGGAA  5650
GAGCCAGACA GCGCCAACTC ATCGTTCTAC AGCACGCGGT CTGCTCCTGC  5700
TTCCCAGGCT AGCCTGCGAG CCACCTCCTC TACTCAGTCT CTAGCTCGCC  5750
TGGGTTCTCC CGATTATGGC AACTCAGCCC TGCTCAGCTT GCCTGGCTAC  5800
CGCCCCACCA CTCGCAGTTC TGCTCGTCGT TCCCAGGCCG GGGTGTCCAG  5850
TGGGGCCCCT CCAGGAAGGA ACAGCTTCTA CATGGGCACT TGCCAGGATG  5900
AGCCTGAGCA GCTGGATGAC TGGAACCGCA TTGCAGAGCT GCAGCAGCGC  5950
AATCGAGTGT GCCCCCCACA TCTGAAGACC TGCTATCCCC TGGAGTCCAG  6000
GCCTTCCCTG AGCCTGGGCA CCATCACAGA TGAGGAGATG AAAACTGGAG  6050
ACCCCCAAGA GACCCTGCGC CGAGCCAGCA TGCAGCCAAT CCAGATAGCC  6100
GAGGGCACTG GCATCACCAC CCGGCAGCAG CGCAAACGGG TCTCCCTAGA  6150
GCCCCACCAG GGCCCTGGAA CTCCTGAGTC TAAGAAGGCC ACCAGCTGTT  6200
TCCCACGCCC CATGACTCCC CGAGACCGAC ATGAAGGGCG CAAACAGAGC  6250
ACTACTGAGG CCCAGAAGAA AGCAGCTCCA GCTTCTACTA AACAGGCTGA  6300
CCGGCGCCAG TCGATGGCCT TCAGCATCCT CAACACACCC AAGAAGCTAG  6350
GGAACAGCCT TCTGCGGCGG GGAGCCTCAA AGAAGGCCCT GTCCAAGGCT  6400
TCCCCCAACA CTCGCAGTGG AACCCGCCGT TCTCCGCGCA TTGCCACCAC  6450
CACAGCCAGC GCCGCCACTG CTGCCGCCAT TGGTGCCACC CCTCGAGCCA  6500
AGGGCAAGGC AAAGCACTAA AGGGCCAGTA CCAGTGAGTG GCCCCACCTG  6550
TGTCCCCGAT GCTGACCTCA CCTGGTCCTC CGCCTACTGT CCCTCTCAGT  6600
GCCTTCTCTC AGCTCCCAGG CCAACAGTAG CCAAACCCCT AGAGACAGTG  6650
ATGCCTGCCC GCACCCTGGC CTGGTCCCTG GTCCTTCACT GGCGCCTTCT  6700
CGGAGCTGGC CCAGGGGGCC TGGAGCATGG ACAGTGTGGG CGCTCTCCCT  6750
ACCTTGCCTC CTTTTTTCTT AAAGCAAAGT CACTTCTCCA TCACAACCAG  6800
ATTTGAGGCT GGTTTTGATG GCTGGGTCCT TGGGCCTGGC CAGTCTTCCT  6850
CTTAGCCTCT GGATCTAGAA GGGACCATAA GAGGAGTAGG CCCTGGTTCC  6900
TGCTGTCCTG GTGGCTGGGC CAGCAGGGG CCCTCACTCT TGAAGTCCAG  6950
GACTGGGTCT GACCTGGTGG GAGCACCTGC CAGAGGATGC TCTTTCCCAG  7000
GACGGATGGG CCCTATGTCT CAGGAGTGGG GTTGGGGGAC AGCCTTCAGC  7050
AGCAGCTCAC ACCCTACCTT CCCCAGACTT GCACTGGGGT GGGATTTGGA  7100
GTGATGGGAA GGTTTTTAAG GGCCGGGGAT GGATCTTTTC TAAATGTTAT  7150
TACTTGTAAA TAAAGTCTAT TTTTCTCCCG TG (SEQ ID NO: 65)
```

FIG. 66

```
MTLHATRGAALLSWVNSLHVADPVEAVLQLQDCSIFIKIIDRIHGTEEGQQILKQPVSER
LDFVCSFLQKNRKHPSSPECLVSAQKVLEGSELELAKMTMLLLYHSTMSSKSPRDWEQFE
YKIQAELAVILKFVLDHEDGLNLNEDLENFLQKAPVPSTCSSTFPEELSPPSHQAKREIR
FLELQKVASSSSGNNFLSGSPASPMGDILQTPQFQMRRLKKQLADERSNRDELELELAEN
RKLLTEKDAQIAMMQQRIDRLALLNEKQAASPLEPKELEELRDKNESLTMRLHETLKQCQ
DLKTEKSQMDRKINQLSEENGDLSFKLREFASHLQQLQDALNELTEEHSKATQEWLEKQA
QLEKELSAALQDKKCLEEKNEILQGKLSQLEEHLSQLQDNPPQEKGEVLGDVLQLETLKQ
EAATLAANNTQLQARVEMLETERGQQEAKLLAERGHFEEEKQQLSSLITDLQSSISNLSQ
AKEELEQASQAHGARLTAQVASLTSELTTLNATIQQQDQELAGLKQQAKEKQAQLAQTLQ
QQEQASQGLRHQVEQLSSSLKQKEQQLKEVAEKQEATRQDHAQQLATAAEEREASLRERD
AALKQLEALEKEKAAKLEILQQQLQVANEARDSAQTSVTQAQREKAELSRKVEELQACVE
TARQEQHEAQAQVAELELQLRSEQQKATEKERVAQEKDQLQEQLQALKESLKVTKGSLEE
EKRRAADALEEQQRCISELKAETRSLVEQHKRERKELEEERAGRKGLEARLQQLGEAHQA
ETEVLRRELAEAMAAQHTAESECEQLVKEVAAWRERYEDSQQEEAQYGAMFQEQLMTLKE
ECEKARQELQEAKEKVAGIESHSELQISRQQNELAELHANLARALQQVQEKEVRAQKLAD
DLSTLQEKMAATSKEVARLETLVRKAGEQQETASRELVKEPARAGDRQPEWLEEQQGRQF
CSTQAALQAMEREAEQMGNELERLRAALMESQGQQQEERGQQEREVARLTQERGRAQADL
ALEKAARAELEMRLQNALNEQRVEFATLQEALAHALTEKEGKDQELAKLRGLEAAQIKEL
EELRQTVKQLKEQLAKKEKEHASGSGAQSEAAGRTEPTGPKLEALRAEVSKLEQQCQKQQ
EQADSLERSLEAERASRAERDSALETLQGQLEEKAQELGHSQSALASAQRELAAFRTKVQ
DHSKAEDEWKAQVARGRQEAERKNSLISSLEEEVSILNRQVLEKEGESKELKRLVMAESE
KSQKLEERLRLLQAETASNSARAAERSSALREEVQSLREEAEKQRVASENLRQELTSQAE
RAEELGQELKAWQEKFFQKEQALSTLQLEHTSTQALVSELLPAKHLCQQLQAEQAAAEKR
HREELEQSKQAAGGLRAELLRAQRELGELIPLRQKVAEQERTAQQLRAEKASYAEQLSML
KKAHGLLAEENRGLGERANLGRQFLEVELDQAREKYVQELAAVRADAETRLAEVQREAQS
TARELEVMTAKYEGAKVKVLEERQRFQEERQKLTAQVEQLEVFQREQTKQVEELSKKLAD
SDQASKVQQQKLKAVQAQGGESQQEAQRLQAQLNELQAQLSQKEQAAEHYKLQMEKAKTH
YDAKKQQNQELQEQLRSLEQLQKENKELRAEAERLGHELQQAGLKTKEAEQTCRHLTAQV
RSLEAQVAHADQQLRDLGKFQVATDALKSREPQAKPQLDLSIDSLDLSCEEGTPLSITSK
LPRTQPDGTSVPGEPASPISQRLPPKVESLESLYFTPIPARSQAPLESSLDSLGDVFLDS
GRKTRSARRRTTQIINITMTKKLDVEEPDSANSSFYSTRSAPASQASLRATSSTQSLARL
GSPDYGNSALLSLPGYRPTTRSSARRSQAGVSSGAPPGRNSFYMGTCQDEPEQLDDWNRI
AELQQRNRVCPPHLKTCYPLESRPSLSLGTITDEEMKTGDPQETLRRASMQPIQIAEGTG
ITTRQQRKRVSLEPHQGPGTPESKKATSCFPRPMTPRDRHEGRKQSTTEAQKKAAPASTK
QADRRQSMAFSILNTPKKLGNSLLRRGASKKALSKASPNTRSGTRRSPRIATTTASAATA
AAIGATPRAKGKAKH- (SEQ ID NO: 66)
```

FIG. 67A

```
atggctgggatcaccaccatcgaggcggtgaagcgcaagatccaggttctgcagcagcag    60
 M  A  G  I  T  T  I  E  A  V  K  R  K  I  Q  V  L  Q  Q  Q    20 gcagatgatgcagaggagcgagctgagcgcctccagcgagaagttgagggagaaaggcgg   120
 A  D  D  A  E  E  R  A  E  R  L  Q  R  E  V  E  G  E  R  R    40 gcccgggaacaggctgaggctgaggtggcctccttgaaccgtaggatccagctggttgaa   180
 A  R  E  Q  A  E  A  E  V  A  S  L  N  R  R  I  Q  L  V  E    60 gaagagctggaccgtgctcaggagcgcctggccactgccctgcaaaagctggaagaagct   240
 E  E  L  D  R  A  Q  E  R  L  A  T  A  L  Q  K  L  E  E  A    80 gaaaaagctgctgatgagagtgagagaggtatgaaggttattgaaaaccgggccttaaaa   300
 E  K  A  A  D  E  S  E  R  G  M  K  V  I  E  N  R  A  L  K   100 gatgaagaaaagatggaactccaggaaatccaactcaaagaagctaagcacattgcagaa   360
 D  E  E  K  M  E  L  Q  E  I  Q  L  K  E  A  K  H  I  A  E   120 gaggcagataggaagtatgaagaggtggctcgtaagttggtgatcattgaaggagacttg   420
 E  A  D  R  K  Y  E  E  V  A  R  K  L  V  I  I  E  G  D  L   140 gaacgcacagaggaacgagctgagctggcagagtcccgttgccgagagatggatgagcag   480
 E  R  T  E  E  R  A  E  L  A  E  S  R  C  R  E  M  D  E  Q   160 attagactgatggaccagaacctgaagtgtctgagtgctgctgaagaaaagtactctcaa   540
 I  R  L  M  D  Q  N  L  K  C  L  S  A  A  E  E  K  Y  S  Q   180 aaagaagataaatatgaggaagaaatcaagattcttactgataaactcaaggaggcagag   600
 K  E  D  K  Y  E  E  E  I  K  I  L  T  D  K  L  K  E  A  E   200 acccgtgctgagtttgctgagagatcggtagccaagctggaaaagacaattgatgacctg   660
 T  R  A  E  F  A  E  R  S  V  A  K  L  E  K  T  I  D  D  L   220 gaagtctccttctcgccggtggacactaacagcacatctggagacccggtggagaagaag   720
 E  V  S  F  S  P  V  D  T  N  S  T  S  G  D  P  V  E  K  K   240 gacgaaacaccttttggggtctcggtggctgtgggcctggccgtctttgcctgcctcttc   780
 D  E  T  P  F  G  V  S  V  A  V  G  L  A  V  F  A  C  L  F   260 ctttctacgctgctccttgtgctcaacaaatgtggacggagaaacaagtttgggatcaac   840
 L  S  T  L  L  L  V  L  N  K  C  G  R  R  N  K  F  G  I  N   280 cgcccggctgtgctggctccagaggatgggctggccatgtccctgcatttcatgacattg   900
 R  P  A  V  L  A  P  E  D  G  L  A  M  S  L  H  F  M  T  L   300 ggtggcagctccctgtcccccaccgagggcaaaggctctgggctccaaggccacatcatc   960
 G  G  S  S  L  S  P  T  E  G  K  G  S  G  L  Q  G  H  I  I   320 gagaacccacaatacttcagtgatgcctgtgttcaccacatcaagcgccgggacatcgtg  1020
 E  N  P  Q  Y  F  S  D  A  C  V  H  H  I  K  R  R  D  I  V   340
```

FIG. 67B

```
ctcaagtgggagctgggggagggcgccttTgggaaggtcttccttgctgagtgccacaac 1080
  L  K  W  E  L  G  E  G  A  F  G  K  V  F  L  A  E  C  H  N   360 ctcctgcctgagcaggacaagatgctggtggctgtcaaggcactgaaggaggcgtccgag 1140
  L  L  P  E  Q  D  K  M  L  V  A  V  K  A  L  K  E  A  S  E   380 agtgctcggcaggacttccagcgtgaggctgagctgctcaccatgctgcagcaccagcac 1200
  S  A  R  Q  D  F  Q  R  E  A  E  L  L  T  M  L  Q  H  Q  H   400 atcgtgcgcttcttcggcgtctgcaccgagggccgccccctgctcatggtctttgagtat 1260
  I  V  R  F  F  G  V  C  T  E  G  R  P  L  L  M  V  F  E  Y   420 atgcggcacggggacctcaaccgcttcctccgatcccatggacctgatgccaagctgctg 1320
  M  R  H  G  D  L  N  R  F  L  R  S  H  G  P  D  A  K  L  L   440 gctggtggggaggatgtggctccaggcccCctgggtctggggcagctgctggccgtggct 1380
  A  G  G  E  D  V  A  P  G  P  L  G  L  G  Q  L  L  A  V  A   460 agccaggtcgctgcggggatggtgtacctggcgggtctgcattttgtgcaccgggacctg 1440
  S  Q  V  A  A  G  M  V  Y  L  A  G  L  H  F  V  H  R  D  L   480 gccacacgcaactgtctagtgggccagggactggtggtcaagattggtgattttggcatg 1500
  A  T  R  N  C  L  V  G  Q  G  L  V  V  K  I  G  D  F  G  M   500 agcagggatatctacagcaccgactattaccgtgtgggaggccgcaccatgctgcccatt 1560
  S  R  D  I  Y  S  T  D  Y  Y  R  V  G  G  R  T  M  L  P  I   520 cgctggatgccgcccgagagcatcctgtaccgtaagttcaccaccgagagcgacgtgtgg 1620
  R  W  M  P  P  E  S  I  L  Y  R  K  F  T  T  E  S  D  V  W   540 agcttcggcgtggtgctctgggagatcttcacctacggcaagcagccctggtaccagctc 1680
  S  F  G  V  V  L  W  E  I  F  T  Y  G  K  Q  P  W  Y  Q  L   560 tccaacacggaggcaatcgactgcatcacgcagggacgtgagttggagcggccacgtgcc 1740
  S  N  T  E  A  I  D  C  I  T  Q  G  R  E  L  E  R  P  R  A   580 tgcccaccagaggtctacgccatcatgcggggctgctggcagcgggagccccagcaacgc 1800
  C  P  P  E  V  Y  A  I  M  R  G  C  W  Q  R  E  P  Q  Q  R   600 cacagcatcaaggatgtgcacgcccggctgcaagccctggcccaggcacctcctgtctac 1860
  H  S  I  K  D  V  H  A  R  L  Q  A  L  A  Q  A  P  P  V  Y   620 ctggatgtcctgggctag 1878 (SEQ ID NO: 67)
  L  D  V  L  G  -    626 (SEQ ID NO: 68)
```

FIG. 68A

```
GTCACATCCG GGCGGGTTGG TGAGTTCCGG TATTTCAGGG CGTAGCAGGC   50
GGAAGTAAGG GTGAGAGGAG GCTGCAACGC CGAGCGGAGG AGGCAGGAAC  100
CGGAGCGCGA GCAGTAGCTG GGTGGGCACC ATGGCTGGGA TCACCACCAT  150
CGAGGCGGTG AAGCGCAAGA TCCAGGTTCT GCAGCAGCAG GCAGATGATG  200
CAGAGGAGCG AGCTGAGCGC CTCCAGCGAG AAGTTGAGGG AGAAAGGCGG  250
GCCCGGGAAC AGGCTGAGGC TGAGGTGGCC TCCTTGAACC GTAGGATCCA  300
GCTGGTTGAA GAAGAGCTGG ACCGTGCTCA GGAGCGCCTG GCCACTGCCC  350
TGCAAAAGCT GGAAGAAGCT GAAAAAGCTG CTGATGAGAG TGAGAGAGGT  400
ATGAAGGTTA TTGAAAACCG GGCCTTAAAA GATGAAGAAA AGATGGAACT  450
CCAGGAAATC CAACTCAAAG AAGCTAAGCA CATTGCAGAA GAGGCAGATA  500
GGAAGTATGA AGAGGTGGCT CGTAAGTTGG TGATCATTGA AGGAGACTTG  550
GAACGCACAG AGGAACGAGC TGAGCTGGCA GAGTCCCGTT GCCGAGAGAT  600
GGATGAGCAG ATTAGACTGA TGGACCAGAA CCTGAAGTGT CTGAGTGCTG  650
CTGAAGAAAA GTACTCTCAA AAAGAAGATA AATATGAGGA AGAAATCAAG  700
ATTCTTACTG ATAAACTCAA GGAGGCAGAG ACCCGTGCTG AGTTTGCTGA  750
GAGATCGGTA GCCAAGCTGG AAAAGACAAT TGATGACCTG GAAGATAAAC  800
TGAAATGCAC CAAAGAGGAG CACCTCTGTA CACAAAGGAT GCTGGACCAG  850
ACCCTGCTTG ACCTGAATGA GATGTAGAAC GCCCAGTCC CACCCTGCTG  900
CTGCTCCTCC CTCTGACCCA GACTCCGCCT GAGGCCAGCC TGCGGGAAGC  950
TGACCTTTAA CTGAGGGCTG ATCTTTAACT GGAAGGCTGC TTTCTCCTTT 1000
CACCACCCCC TCCTTCCCTG TGTCTTTTTC GCCAAACTGT CTCTGCCTCT 1050
TCCCGGAGAA TCCAGCTGGG CTAGAGGCTG AGCACCTTTG GAAACAACAT 1100
TTAAGGGAAT GTGAGCACAA TGCATAATGT CTTTAAAAAG CATGTTGTGA 1150
TGTACACATT TTGTAATTAC CTTTTTTGTT GTTTGTAGC AACCATTTGT 1200
AAAACATTCC AAATAATTCC ACAGTCCTGA AGCAGCAATC GAATCCCTTT 1250
CTCACTTTTG GAAGGTGACT TTTCACCTTA ATGCATATTC CCCTCTCCAT 1300
AGAGGAGAGG AAAAGGTGTA GGCCTGCCTT ACCGAGAGCC AAACAGAGCC 1350
CAGGGAGACT CCGCTGTGGG AAACCTCATT GTTCTGTACA AAGTACTAGC 1400
TAAACCAGAA AGGTGATTCC AGGAGGAGTT AGCCAAACAA CAACAAAAAC 1450
AAAAAATGTG CTGTTCAAGT TTTCAGCTTT AAGATATCTT TGGATAATGT 1500
TATTTCTATT TTTTATTTTT TCATTAGAA GTTACCAAAT TAAGATGGTA 1550
AGACCTCTGA GACCAAAATT TTGTCCCATC TCTACCCCCT CACAACTGCT 1600
TACAGAATGG ATCATGTCCC CCTTATGTTG AGGTGACCAC TTAATTGCTT 1650
TCCTGCCTCC TTGAAAGAAA GAAAGAAAGA AGACTGTGTT TTTGCCACTG 1700
ATTTAGCCAT GTGAAACTCA TCTCATTACC CTTTTCTGGG TTTGAAGCTG 1750
CTGTCTCTAG AAGTGCCATC TCAATTGTGC TTTGTATCAG TCAGTGCTGG 1800
AGAAATCTTG AATAGCTTAT GTACAAAACT TTTTAAATTT TATATTATTT 1850
TGAAACTTTG CTTTGGGTTT GTGGCACCCT GGCCACCCCA TCTGGCTGTG 1900
ACAGCCTCTG CAGTCCGTGG GCTGGCAGTT TGTTGATCTT TTAAGTTTCC 1950
TTCCCTACCC AGTCCCCATT TTCTGGTAAG GTTTCTAGGA GGTCTGTTAG 2000
GTGTACATCC TGCAGCTTAT TGGCTTAAAA TGTACTCTCC TTTTATGTGG 2050
TCTCTTTGGG GCCGATTGGG AGAAAGAGAA ATCAATAGTG CAACTGTTTT 2100
GATACTGAAT ATTGACAAGT GTCTTTTGA AATAAAGAAC CAGTCCCTCC 2150
AACCCTCAGA CCTATTTGAC TTTTATTTAT TAAAACTAAA TGTGCTTTCT 2200
CCACAGAAGC TATGAGGTTT GGGTTAAAAA TAGCATCTTT GTGGGTGGTA 2250
GCAACAGGAT TTATTCTTTA TTATTATTAT TTTTGAGATG AAGTTTCATT 2300
CTTGTTGCCT GGGCTGGAGC GTAATGGCTC GATCTCGGCT CACTGCAACC 2350
TCCGCCTCCT GGTTCAAGAG ATTCTCCTGC CTCAGCCTCC CGAGTAGCTG 2400
GGATTACAGG CACCTGCCAC CATGCCCGGG TAATTTTTTA TATTTTAAGT 2450
AGAGACAGGG CTTCACCATG TTGGCCAGGC TGGTCTCGAA CTCCTGACCT 2500
```

FIG. 68B

```
TCAGGTGATC CACCTGCCTC AGCTTCCCAA AATGCTGGGA TTACGGGCGT  2550
GAGCCACCGC ACCCAGCTGG AGCAACAGGA TTTAATATAG AGCAAATGTT  2600
TAGTTTTATC ATCTGTAAAA TGGAGATAAG TATTGTCAGA GTAAACATGA  2650
AGATTAGAAA GAACACTTAA TGTGCTGGGC CTTTTATAGG TTAACACTGA  2700
CATCTCAGGC TGAACTATAT ACATTTCCT TCACAACCAT ATCAATCCTT  2750
ATAAACTATG GATTTATGCT CCTTAAAACA ATATATAATG CTGATCACTA  2800
CTATAAATGC GTGGTTTAA CCAACTGTAC TGAAACAGCT TTGAGTTTAT  2850
ATTCTGTTTG GATATTTGGA GAAAACAACA AGTGCTCTCA AGAGTATTTG  2900
CTTAGAGGCC GGCTGTGTGA GTGGATAACT TTGAAAGCTG CTTTTGAGAC  2950
GCCAGTGTCT GGCATTTCCT GCATTCTGGC CTGGAGGCCG GACGTGAATC  3000
TGACTTCTAG TAAAAATACA CGGTTCCCTT GACAAAGTCG AGCTGTTTAT  3050
CCCAGAGACT GCACAATTTT CCGTTGATAG GCATGGACCA ATGCTAACTG  3100
GAAATCATTG CAAAAAGTTT TTTTGTCGGG CGGAGGGTGT GGTGTTAAGA  3150
TAAACAGTGT GCAACAGAAG AAATTAAAAC TGGAAGAAAT TAAAGGGTTT  3200
TTTTAGACT TT (SEQ ID NO: 69)
```

FIG. 69

```
MAGITTIEAVKRKIQVLQQQADDAEERAERLQREVEGERRAREQAEAEVASLNRRIQLVE
EELDRAQERLATALQKLEEAEKAADESERGMKVIENRALKDEEKMELQEIQLKEAKHIAE
EADRKYEEVARKLVIIEGDLERTEERAELAESRCREMDEQIRLMDQNLKCLSAAEEKYSQ
KEDKYEEEIKILTDKLKEAETRAEFAERSVAKLEKTIDDLEDKLKCTKEEHLCTQRMLDQ
TLLDLNEM- (SEQ ID NO: 70)
```

FIG. 70A

```
atggatgtagatgctgaaagagagaagataacacaggagatcaaggagctggaaaggatt    60
 M   D   V   D   A   E   R   E   K   I   T   Q   E   I   K   E   L   E   R   I    20 ttggatcccggctcctcgggctcccacgtggagatctcagaatcaagtctcgagtcagat   120
 L   D   P   G   S   S   G   S   H   V   E   I   S   E   S   S   L   E   S   D    40 tctgaagcaggtgagaccgtggagccgcccccgccggcgcagctgcacttcatgtacgtg   180
 S   E   A   G   E   T   V   E   P   P   P   P   A   Q   L   H   F   M   Y   V    60 gcggcggccgccttt gtgcttctgttcttcgtgggctgcggggtgctgctgtcccgcaag   240
 A   A   A   A   F   V   L   L   F   F   V   G   C   G   V   L   L   S   R   K    80 cgccggcggcagcatggccagctctggttccctgagggcttcaaagtgtctgaggccagc   300
 R   R   R   Q   H   G   Q   L   W   F   P   E   G   F   K   V   S   E   A   S   100 aagaagaagcggcgggagcccctcggcgaggactccgtgggcctcaagcccctgaagaac   360
 K   K   K   R   R   E   P   L   G   E   D   S   V   G   L   K   P   L   K   N   120 gcttcagacggtgccctcatggacgacaaccagaatgagtgggggggacgaggacctggag   420
 A   S   D   G   A   L   M   D   D   N   Q   N   E   W   G   D   E   D   L   E   140 accaagaagttccggttcgaggagcccgtggttctgcctgacctggacgaccagacagac   480
 T   K   K   F   R   F   E   E   P   V   V   L   P   D   L   D   D   Q   T   D   160 caccggcagtggactcagcagcacctggatgccgctgacctgcgcatgtctgccatggcc   540
 H   R   Q   W   T   Q   Q   H   L   D   A   A   D   L   R   M   S   A   M   A   180 cccacaccgccccagggtgaggttgacgccgactgcatggacgtcaatgtccgcgggcct   600
 P   T   P   P   Q   G   E   V   D   A   D   C   M   D   V   N   V   R   G   P   200 gatggcttcacccccgctcatgatcgcctcctgcagcgggggcggcctggagacgggcaac   660
 D   G   F   T   P   L   M   I   A   S   C   S   G   G   G   L   E   T   G   N   220 agcgaggaagaggaggacgcgccggccgtcatctccgacttcatctaccagggcgccagc   720
 S   E   E   E   E   D   A   P   A   V   I   S   D   F   I   Y   Q   G   A   S   240 ctgcacaaccagacagaccgcacgggcgagaccgccttgcacctggccgcccgctactca   780
 L   H   N   Q   T   D   R   T   G   E   T   A   L   H   L   A   A   R   Y   S   260 cgctctgatgccgccaagcgcctgctggaggccagcgcagatgccaacatccaggacaac   840
 R   S   D   A   A   K   R   L   L   E   A   S   A   D   A   N   I   Q   D   N   280 atgggccgcacccccgctgcatgcggctgtgtctgccgacgcacaaggtgtcttccagatc   900
 M   G   R   T   P   L   H   A   A   V   S   A   D   A   Q   G   V   F   Q   I   300 ctgatccggaaccgagccacagacctggatgcccgcatgcatgatggcacgacgccactg   960
 L   I   R   N   R   A   T   D   L   D   A   R   M   H   D   G   T   T   P   L   320 atcctggctgcccgcctggccgtggagggcatgctggaggacctcatcaactcacacgcc  1020
 I   L   A   A   R   L   A   V   E   G   M   L   E   D   L   I   N   S   H   A   340
```

FIG. 70B

```
gacgtcaacgccgtagatgacctgggcaagtccgccctgcactgggccgccgccgtgaac 1080
 D   V   N   A   V   D   D   L   G   K   S   A   L   H   W   A   A   A   V   N   360 aatgtggatgccgcagttgtgctcctgaagaacggggctaacaaagatatgcagaacaac 1140
 N   V   D   A   A   V   V   L   L   K   N   G   A   N   K   D   M   Q   N   N   380 agggaggagacacccctgtttctggccgcccgggagggcagctacgagaccgccaaggtg 1200
 R   E   E   T   P   L   F   L   A   A   R   E   G   S   Y   E   T   A   K   V   400 ctgctggaccactttgccaaccgggacatcacggatcatatggaccgcctgccgcgcgac 1260
 L   L   D   H   F   A   N   R   D   I   T   D   H   M   D   R   L   P   R   D   420 atcgcacaggagcgcatgcatcacgacatcgtgaggctgctggacgagtacaacctggtg 1320
 I   A   Q   E   R   M   H   H   D   I   V   R   L   L   D   E   Y   N   L   V   440 cgcagcccgcagctgcacggagccccgctggggggcacgcccaccctgtcgcccccgctc 1380
 R   S   P   Q   L   H   G   A   P   L   G   G   T   P   T   L   S   P   P   L   460 tgctcgcccaacggctacctgggcagcctcaagcccggcgtgcagggcaagaaggtccgc 1440
 C   S   P   N   G   Y   L   G   S   L   K   P   G   V   Q   G   K   K   V   R   480 aagcccagcagcaaaggcctggcctgtggaagcaaggaggccaaggacctcaaggcacgg 1500
 K   P   S   S   K   G   L   A   C   G   S   K   E   A   K   D   L   K   A   R   500 aggaagaagtcccaggacggcaagggctgcctgctggacagctccggcatgctctcgccc 1560
 R   K   K   S   Q   D   G   K   G   C   L   L   D   S   S   G   M   L   S   P   520 gtggactccctggagtcacccccatggctacctgtcagacgtggcctcgccgccactgctg 1620
 V   D   S   L   E   S   P   H   G   Y   L   S   D   V   A   S   P   P   L   L   540 ccctccccgttccagcagtctccgtccgtgcccctcaaccacctgcctgggatgcccgac 1680
 P   S   P   F   Q   Q   S   P   S   V   P   L   N   H   L   P   G   M   P   D   560 acccacctgggcatcgggcacctgaacgtggcggccaagcccgagatggcggcgctgggt 1740
 T   H   L   G   I   G   H   L   N   V   A   A   K   P   E   M   A   A   L   G   580 gggggcggccggctggcctttgagactggcccacctcgtctctcccacctgcctgtggcc 1800
 G   G   G   R   L   A   F   E   T   G   P   P   R   L   S   H   L   P   V   A   600 tctggcaccagcaccgtcctgggctccagcagcggaggggccctgaatttcactgtgggc 1860
 S   G   T   S   T   V   L   G   S   S   S   G   A   L   N   F   T   V   G   620 gggtccaccagtttgaatggtcaatgcgagtggctgtcccggctgcagagcggcatggtg 1920
 G   S   T   S   L   N   G   Q   C   E   W   L   S   R   L   Q   S   G   M   V   640 ccgaaccaatacaaccctctgcggggagtgtggcaccaggcccctgagcacacaggcc 1980
 P   N   Q   Y   N   P   L   R   G   S   V   A   P   G   P   L   S   T   Q   A   660 ccctcccctgcagcatggcatggtaggcccgctgcacagtagccttgctgccagcgccctg 2040
 P   S   L   Q   H   G   M   V   G   P   L   H   S   S   L   A   A   S   A   L   680
```

FIG. 70C

```
tcccagatgatgagctaccagggcctgcccagcacccggctggccacccagcctcacctg 2100
  S   Q   M   M   S   Y   Q   G   L   P   S   T   R   L   A   T   Q   P   H   L    700 gtgcagacccagcaggtgcagccacaaaacttacagatgcagcagcagaacctgcagcca 2160
  V   Q   T   Q   Q   V   Q   P   Q   N   L   Q   M   Q   Q   Q   N   L   Q   P    720 gcaaacatccagcagcagcaaagcctgcagccgccaccaccaccaccacagccgcacctt 2220
  A   N   I   Q   Q   Q   Q   S   L   Q   P   P   P   P   P   P   Q   P   H   L    740 ggcgtgagctcagcagccagcggccacctgggccggagcttcctgagtggagagccgagc 2280
  G   V   S   S   A   A   S   G   H   L   G   R   S   F   L   S   G   E   P   S    760 caggcagacgtgcagccactgggccccagcagcctggcggtgcacactattctgccccag 2340
  Q   A   D   V   Q   P   L   G   P   S   S   L   A   V   H   T   I   L   P   Q    780 gagagccccgccctgcccacgtcgctgccatcctcgctggtcccacccgtgaccgcagcc 2400
  E   S   P   A   L   P   T   S   L   P   S   S   L   V   P   P   V   T   A   A    800 cagttcctgacgccccccctcgcagcacagctactcctcgcctgtggacaacacccccagc 2460
  Q   F   L   T   P   P   S   Q   H   S   Y   S   S   P   V   D   N   T   P   S    820 caccagctacaggtgcctgagcacccctcctcaccccgtccctgagtcccctgaccag 2520
  H   Q   L   Q   V   P   E   H   P   F   L   T   P   S   P   E   S   P   D   Q    840 tggtccagctcgtccccgcattccaacgtctccgactggtccgagggcgtctccagccct 2580
  W   S   S   S   S   P   H   S   N   V   S   D   W   S   E   G   V   S   S   P    860 cccaccagcatgcagtcccagatcgcccgcattccggaggccttcaagtaa 2631
  P   T   S   M   Q   S   Q   I   A   R   I   P   E   A   F   K   -    817
```

(SEQ ID NO: 71)
(SEQ ID NO: 72)

FIG. 71A

```
GCGGGAGTCA TGGATGTAGA TGCTGAAAGA GAGAAGATAA CACAGGAGAT   50
CAAGGAGCTG GAAAGGATTT TGGATCCCGG CTCCTCGGGC TCCCACGTGG  100
AGATCTCAGA ATCAAGTCTC GAGTCAGATT CTGAAGCAGA TTCACTGCCT  150
TCTGAGGACT TGGATCCTGC CGATCCCCCG ATCTCGGAAG AAGAAAGGTG  200
GGGCGAAGCC AGCAATGACG AGGACGATCC CAAGGATAAA ACCCTCCCTG  250
AAGACCCAGA AACCTGCCTG CAGCTGAACA TGGTCTACCA GGAGGTCATC  300
CAGGAGAAGC TGGCTGAGGC CAACCTGCTG CTGGCCCAGA ACCGGGAGCA  350
GCAGGAGGAA CTCATGAGGG ATCTGGCTGG GTCCAAAGGC ACCAAGGTGA  400
AAGATGGCAA AAGCCTGCCC CCAAGCACAT ACATGGGGCA CTTCATGAAG  450
CCGTATTTCA AGGACAAGGT CACGGGCGTG GGGCCACCTG CCAACGAGGA  500
CACACGAGAG AAGGCTGCCC AGGGGATCAA GGCTTTCGAG GAGCTCCTTG  550
TGACCAAATG GAAAAACTGG GAAAAGGCCT TGCTCCGAAA GTCAGTGGTG  600
AGTGACCGCC TGCAGCGATT GCTTCAGCCC AAGTTACTGA AGCTGAGTA   650
CTTGCACCAG AAGCAGAGCA AAGTCTCCAG TGAGCTGGAG AGGCAAGCCC  700
TGGAGAAGCA GGGCAGGGAA GCCGAGAAGG AGATCCAGGA CATCAACCAG  750
CTTCCAGAAG AGGCCTTGCT GGGAAACAGG CTGGACAGCC ACGACTGGGA  800
GAAGATTTCC AATATTAACT TGAAGGCAG CCGCAGTGCA GAGGAGATCC   850
GGAAGTTCTG GCAGAACTCG GAGCACCCCA GCATCAACAA GCAGGAGTGG  900
AGCAGGGAGG AGGAGGAGCG GCTGCAGGCG ATCGCGGCTG CACACGGCCA  950
CCTGGAGTGG CAGAAGATTG CAGAGGAGCT GGGGACCAGC CGCAGCGCCT 1000
TCCAGTGCCT GCAGAAATTC CAGCAGCACA ACAAAGCTCT GAAACGCAAG 1050
GAGTGGACAG AGGAGGAGGA CCGCATGCTC ACGCAGCTGG TGCAGGAGAT 1100
GCGCGTCGGC AGCCACATCC CCTACGCAG ATTGTCTAC TATATGGAAG    1150
GGAGAGACTC CATGCAGCTG ATCTACCGAT GGACCAAGAG CTTGGATCCT 1200
GGTCTGAAGA AGGGTTACTG GCCCCGGAG GAAGATGCTA AGTTGCTTCA   1250
AGCTGTTGCC AAATACGGGG AGCAGGATTG GTTTAAAATC CGGGAAGAGG 1300
TGCCAGGTAG GAGCGATGCC CAGTGCCGAG ATCGGTATCT CAGGAGATTA 1350
CATTTCAGCT TGAAAAAGGG TCGGTGGAAT TTAAAAGAAG AGGAACAGTT 1400
AATTGAATTA ATAGAAAAAT ATGGTGTCGG TCACTGGGCA AAAATAGCTT 1450
CTGAGCTGCC CCATCGGTCT GGCTCCCAGT GTCTGAGCAA GTGGAAGATC 1500
ATGATGGGGA AGAAGCAGGG TCTCCGGAGG CGGCGGCGGA GGGCCCGTCA 1550
CAGCGTCCGG TGGAGCTCTA CCAGCAGCAG CGGCAGCAGC AGTGGCAGCA 1600
GTGGAGGGAG CAGCAGCAGC AGCAGCAGCA GCAGCGAGGA GGACGAGCCA 1650
GAGCAGGCGC AGGCCGGGGA GGGTGACAGA GCGCTGCTGT CCCCACAGTA 1700
CATGGTCCCG GACATGGACC TGTGGGTTCC TGCCAGGCAG AGCACCAGCC 1750
AGCCATGGAG AGGAGGGCA GGGGCCTGGC TGGGAGGCCC CGCTGCCTCC   1800
CTCAGCCCTC CCAAGGGGTC CAGTGCCAGC CAGGGCGGCA GCAAGGAAGC 1850
TTCCACCACA GCCGCGGCTC CTGGAGAGGA GACGAGTCCG GTGCAGGTCC 1900
CTGCCAGGGC CCACGGCCCT GTCCCGAGGT CTGCCCAGGC CTCCCACTCA 1950
GCAGACACTC GCCCGGCGGG CGCAGAGAAG CAGGCCCTGG AGGGTGGGAG 2000
GCGTCTGCTG ACAGTGCCTG TGGAGACCGT GCTGAGGGTG CTCAGGGCCA 2050
ACACGGCTGC TCGGAGCTGC ACACAGAAAG AGCAGCTGAG GCAGCCACCC 2100
CTGCCCACCT CATCCCCAGG GGTCAGCTCT GGTGACAGCG TGGCCCGATC 2150
CCATGTGCAG TGGCTACGGC ACAGAGCCAC CCAGAGTGGG CAGCGGCGCT 2200
GGAGACACGC TCTGCACCGG AGGCTCCTGA ACCGCAGGCT GCTGCTGGCT 2250
GTGACCCCTT GGGTAGGGGA CGTTGTCGTG CCCTGCACAC AGGCTTCCCA 2300
GAGACCCGCC GTAGTGCAGA CTCAAGCGGA TGGCCTCAGG GAGCAGCTGC 2350
AGCAGGCCCG CCTGGCCAGC ACCCCTGTGT TTACCCTGTT TACCCAGCTG 2400
TTCCACATCG ATACTGCCGG CTGCTTGGAG GTCGTCCGAG AGAGGAAGGC 2450
CCTGCCACCC AGGCTGCCCC AGGCTGGTGC TCGGGACCCA CCAGTTCATC 2500
```

FIG. 71B

```
TTCTGCAGGC ATCCTCAAGT GCCCAGAGCA CCCCAGGCCA CCTCTTCCCA  2550
AACGTGCCGG CTCAAGAAGC CTCAAAGAGT GCCAGCCACA AAGGGAGCCG  2600
AAGACTGGCG TCCAGCCGGG TGGAGCGCAC CCTACCCCAG GCGTCCCTGC  2650
TGGCTTCAAC CGGCCCCCGG CCCAAGCCCA AGACTGTGTC GGAGCTGCTT  2700
CAGGAGAAGC GGCTTCAGGA GGCCCGTGCC AGGGAGGCCA CCCGGGGCCC  2750
GGTGGTGCTC CCGTCCCAGC TGCTGGTCTC CTCGTCTGTG ATCCTCCAGC  2800
CCCCTCTACC ACACACCCCA CACGGCCGCC CAGCCCCGGG TCCCACCGTC  2850
TTAAATGTAC CGCTCTCTGG GCCTGGGGCC CCCGCGGCAG CCAAACCTGG  2900
CACTTCTGGC TCCTGGCAGG AGGCTGGGAC TTCAGCCAAG GACAAGAGAC  2950
TCTCCACCAT GCAAGCCCTG CCCCTCGCTC CTGTCTTCTC AGAGGCCGAG  3000
GGCACAGCCC CTGCTGCTTC CCAAGCCCCT GCCCTGGGCC CCGGCCAGAT  3050
CTCTGTGAGC TGCCCCGAGA GTGGTCTCGG ACAGTCTCAG GCCCCCGCTG  3100
CATCCCGGAA GCAGGGCCTG CCTGAGGCGC CACCCTTTCT CCCCGCAGCC  3150
CCCAGCCCCA CCCCACTGCC CGTCCAGCCC CTCAGCCTGA CGCACATAGG  3200
AGGGCCACAT GTGGCGACCA GTGTCCCCCT GCCTGTCACC TGGGTGCTCA  3250
CAGCCCAGGG GCTTCTCCCT GTTCCTGTAC CAGCTGTGGT GAGCCTTCCC  3300
AGGCCAGCAG GGACCCCTGG CCCCGCAGGG CTGCTGGCCA CTCTGCTGCC  3350
TCCCCTGACT GAGACTCGGG CGGCCCAGGG CCCCAGGGCC CCAGCGTTGA  3400
GCAGCTCTTG GCAGCCCCCA GCCAATATGA ACAGGGAACC GGAGCCTTCC  3450
TGCAGGACAG ACACCCCAGC TCCTCCCACA CACGCCCTCT CCCAAAGTCC  3500
TGCAGAAGCG GATGGCAGTG TGGCCTTTGT CCCTGGAGAG GCCCAGGTGG  3550
CCAGGGAGAT ACCTGAGCCC AGGACGTCCT CCCACGCTGA CCCTCCTGAA  3600
GCAGAACCCC CTTGGTCCGG GAGGCTGCCA GCCTTCGGTG GTGTCATCCC  3650
AGCAACTGAG CCAAGGGGGA CGCCGGGGTC CCCCTCAGGG ACACAGGAGC  3700
CCAGGGGGCC TCTGGGCCTG GAGAAGCTGC CCCTGCGCCA GCCTGGGCCT  3750
GAGAAGGGGG CCCTGGACCT GGAGAAGCCG CCCCTACCCC AGCCTGGGCC  3800
TGAGAAGGGG GCCCTGGACC TGGGCCTGCT GTCCCAGGAG GGCGAGGCGG  3850
CCACACAGCA GTGGCTGGGG GGCCAGCGGG GGGTGCGTGT GCCTCTTCTG  3900
GGCAGCAGAC TGCCCTATCA GCCCCCAGCC CTGTGCAGCC TGCGAGCTCT  3950
GTCCGGTCTC CTACTCCACA AGAAGGCCCT GGAGCACAAG GCCACCTCCC  4000
TGGTGGTGGG GGGCGAGGCT GAGCGGCCGG CCGGAGCACT GCAAGCCTCA  4050
CTGGGGCTGG TGCGGGGCA GCTCCAGGAC AACCCGGCCT ACCTCCTGTT  4100
GCGGGCGCGG TTCCTGGCAG CCTTCACCCT CCCTGCGCTC CTGGCCACCC  4150
TGGCCCCCCA AGGCGTCCGC ACCACCCTCT CAGTACCTTC GAGGGTGGGC  4200
TCTGAGAGTG AGGATGAAGA CCTCCTGAGT GAGCTGGAAC TTGCAGACAG  4250
GGACGGGCAG CCGGGCTGCA CGACAGCCAC ATGCCCCATT CAGGGAGCCC  4300
CAGACTCTGG TAAATGCTCT GCTTCCTCCT GCCTGGATAC TTCTAATGAC  4350
CCTGACGACC TGGACGTGCT CAGAACCCGG CATGCCAGGC ACACCCGGAA  4400
GCGGAGGCGG CTGGTGTGAG CAGCAGGACA AGCACTTTCT CAGAAGCCCG  4450
TGGCCCTGCT GACGAGAGAC AGCCCACCCC CAGCCTGCAA GAGAGGCAGC  4500
CAGAGGCCAG GTATCTGCTG GCCGCTGACT GACCAGGTCC GCAGTGAACA  4550
GAGGCGGGCC TGCCGACTGA CTGTGTGGCA TGGAGCATGG CTGTTCCCCA  4600
AGTGCACACC TGAACACTTG GAGGAATAAA GTTCTGTTTT TAATTGTGGA  4650
aaaaaaaaaa a (SEQ ID NO: 73)
```

FIG. 72

```
MDVDAEREKITQEIKELERILDPGSSGSHVEISESSLESDSEADSLPSEDLDPADPPISE
EERWGEASNDEDDPKDKTLPEDPETCLQLNMVYQEVIQEKLAEANLLLAQNREQQEELMR
DLAGSKGTKVKDGKSLPPSTYMGHFMKPYFKDKVTGVGPPANEDTREKAAQGIKAFEELL
VTKWKNWEKALLRKSVVSDRLQRLLQPKLLKLEYLHQKQSKVSSELERQALEKQGREAEK
EIQDINQLPEEALLGNRLDSHDWEKISNINFEGSRSAEEIRKFWQNSEHPSINKQEWSRE
EEERLQAIAAAHGHLEWQKIAEELGTSRSAFQCLQKFQQHNKALKRKEWTEEEDRMLTQL
VQEMRVGSHIPYRRIVYYMEGRDSMQLIYRWTKSLDPGLKKGYWAPEEDAKLLQAVAKYG
EQDWFKIREEVPGRSDAQCRDRYLRRLHFSLKKGRWNLKEEEQLIELIEKYGVGHWAKIA
SELPHRSGSQCLSKWKIMMGKKQGLRRRRRARHSVRWSSTSSSGSSSGSSGGSSSSSSS
SSEEDEPEQAQAGEGDRALLSPQYMVPDMDLWVPARQSTSQPWRGGAGAWLGGPAASLSP
PKGSSASQGGSKEASTTAAAPGEETSPVQVPARAHGPVPRSAQASHSADTRPAGAEKQAL
EGGRRLLTVPVETVLRVLRANTAARSCTQKEQLRQPPLPTSSPGVSSGDSVARSHVQWLR
HRATQSGQRRWRHALHRRLLNRRLLLAVTPWVGDVVVPCTQASQRPAVVQTQADGLREQL
QQARLASTPVFTLFTQLFHIDTAGCLEVVRERKALPPRLPQAGARDPPVHLLQASSSAQS
TPGHLFPNVPAQEASKSASHKGSRRLASSRVERTLPQASLLASTGPRPKPKTVSELLQEK
RLQEARAREATRGPVVLPSQLLVSSSVILQPPLPHTPHGRPAPGPTVLNVPLSGPGAPAA
AKPGTSGSWQEAGTSAKDKRLSTMQALPLAPVFSEAEGTAPAASQAPALGPGQISVSCPE
SGLGQSQAPAASRKQGLPEAPPFLPAAPSPTPLPVQPLSLTHIGGPHVATSVPLPVTWVL
TAQGLLPVPVPAVVSLPRPAGTPGPAGLLATLLPPLTETRAAQGPRAPALSSSWQPPANM
NREPEPSCRTDTPAPPTHALSQSPAEADGSVAFVPGEAQVAREIPEPRTSSHADPPEAEP
PWSGRLPAFGGVIPATEPRGTPGSPSGTQEPRGPLGLEKLPLRQPGPEKGALDLEKPPLP
QPGPEKGALDLGLLSQEGEAATQQWLGGQRGVRVPLLGSRLPYQPPALCSLRALSGLLLH
KKALEHKATSLVVGGEAERPAGALQASLGLVRGQLQDNPAYLLLRARFLAAFTLPALLAT
LAPQGVRTTLSVPSRVGSESEDEDLLSELELADRDGQPGCTTATCPIQGAPDSGKCSASS
CLDTSNDPDDLDVLRTRHARHTRKRRRLV- (SEQ ID NO: 74)
```

FIG. 73A

```
ATGCCGCCGC TCCTGGCGCC CCTGCTCTGC CTGGCGCTGC TGCCCGCGCT    50
CGCCGCACGA GGCCCGCGAT GCTCCCAGCC CGGTGAGACC TGCCTGAATG   100
GCGGGAAGTG TGAAGCGGCC AATGGCACGG AGGCCTGCGT CTGTGGCGGG   150
GCCTTCGTGG GCCCGCGATG CCAGGACCCC AACCCGTGCC TCAGCACCCC   200
CTGCAAGAAC GCCGGGACAT GCCACGTGGT GGACCGCAGA GGCGTGGCAG   250
ACTATGCCTG CAGCTGTGCC CTGGGCTTCT CTGGGCCCCT CTGCCTGACA   300
CCCCTGGACA ATGCCTGCCT CACCAACCCC TGCCGCAACG GGGCACCTG    350
CGACCTGCTC ACGCTGACGG AGTACAAGTG CCGCTGCCCG CCCGGCTGGT   400
CAGGGAAATC GTGCCAGCAG GCTGACCCGT GCGCCTCCAA CCCCTGCGCC   450
AACGGTGGCC AGTGCCTGCC CTTCGAGGCC TCCTACATCT GCCACTGCCC   500
ACCCAGCTTC CATGGCCCCA CCTGCCGGCA GGATGTCAAC GAGTGTGGCC   550
AGAAGCCCGG GCTTTGCCGC CACGGAGGCA CCTGCCACAA CGAGGTCGGC   600
TCCTACCGCT GCGTCTGCCG CGCCACCCAC ACTGGCCCCA ACTGCGAGCG   650
GCCCTACGTG CCCTGCAGCC CCTCGCCCTG CCAGAACGGG GGCACCTGCC   700
GCCCCACGGG CGACGTCACC CACGAGTGTG CCTGCCTGCC AGGCTTCACC   750
GGCCAGAACT GTGAGGAAAA TATCGACGAT TGTCCAGGAA ACAACTGCAA   800
GAACGGGGGT GCCTGTGTGG ACGGCGTGAA CACCTACAAC TGCCGCTGCC   850
CGCCAGAGTG GACAGGTCAG TACTGTACCG AGGATGTGGA CGAGTGCCAG   900
CTGATGCCAA ATGCCTGCCA GAACGGCGGG ACCTGCCACA ACACCCACGG   950
TGGCTACAAC TGCGTGTGTG TCAACGGCTG GACTGGTGAG GACTGCAGCG  1000
AGAACATTGA TGACTGTGCC AGCGCCGCCT GCTTCCACGG CGCCACCTGC  1050
CATGACCGTG TGGCCTCCTT CTACTGCGAG TGTCCCATG GCCGCACAGG   1100
TCTGCTGTGC CACCTCAACG ACGCATGCAT CAGCAACCCC TGTAACGAGG  1150
GCTCCAACTG CGACACCAAC CCTGTCAATG CAAGGCCAT CTGCACCTGC   1200
CCCTCGGGGT ACACGGGCCC GGCCTGCAGC CAGGACGTGG ATGAGTGCTC  1250
GCTGGGTGCC AACCCCTGCG AGCATGCGGG CAAGTGCATC AACACGCTGG  1300
GCTCCTTCGA GTGCCAGTGT CTGCAGGGCT ACACGGGCCC CCGATGCGAG  1350
ATCGACGTCA ACGAGTGCGT CTCGAACCCG TGCCAGAACG ACGCCACCTG  1400
CCTGGACCAG ATTGGGGAGT TCCAGTGCAT CTGCATGCCC GGCTACGAGG  1450
GTGTGCACTG CGAGGTCAAC ACAGACGAGT GTGCCAGCAG CCCCTGCCTG  1500
CACAATGGCC GCTGCCTGGA CAAGATCAAT GAGTTCCAGT GCGAGTGCCC  1550
CACGGCTTC ACTGGGCATC TGTGCCAGTA CGATGTGGAC GAGTGTGCCA   1600
GCACCCCCTG CAAGAATGGT GCCAAGTGCC TGGACGGACC CAACACTTAC  1650
ACCTGTGTGT GCACGGAAGG GTACACGGGG ACGCACTGCG AGGTGGACAT  1700
CGATGAGTGC GACCCCGACC CCTGCCACTA CGGCTCCTGC AAGGACGGCG  1750
TCGCCACCTT CACCTGCCTC TGCCGCCCAG GCTACACGGG CCACCACTGC  1800
GAGACCAACA TCAACGAGTG CTCCAGCCAG CCCTGCCGCC ACGGGGCAC    1850
CTGCCAGGAC CGCGACAACG CCTACCTCTG CTTCTGCCTG AAGGGGACCA  1900
CAGGACCCAA CTGCGAGATC AACCTGGATG ACTGTGCCAG CAGCCCCTGC  1950
GACTCGGGCA CCTGTCTGGA CAAGATCGAT GGCTACGAGT GTGCCTGTGA  2000
GCCGGGCTAC ACAGGAGCA TGTGTAACAT CAACATCGAT GAGTGTGCGG   2050
GCAACCCCTG CCACAACGGG GGCACCTGCG AGGACGGCAT CAATGGCTTC  2100
ACCTGCCGCT GCCCCGAGGG CTACCACGAC CCCACCTGCC TGTCTGAGGT  2150
CAATGAGTGC AACAGCAACC CCTGCGTCCA CGGGGCCTGC CGGGACAGCC  2200
TCAACGGGTA CAAGTGCGAC TGTGACCCTG GGTGGAGTGG GACCAACTGT  2250
GACATCAACA ACAATGAGTG TGAATCCAAC CCTTGTGTCA ACGGCGGCAC  2300
CTGCAAAGAC ATGACCAGTG GCTACGTGTG CACCTGCCGG GAGGGCTTCA  2350
GCGGTCCCAA CTGCCAGACC AACATCAACG AGTGTGCGTC CAACCCATGT  2400
CTGAACCAGG GCACGTGTAT TGACGACGTT GCCGGGTACA AGTGCAACTG  2450
CCTGCTGCCC TACACAGGTG CCACGTGTGA GGTGGTGCTG GCCCCGTGTG  2500
```

FIG. 73B

```
CCCCCAGCCC CTGCAGAAAC GGCGGGGAGT GCAGGCAATC CGAGGACTAT  2550
GAGAGCTTCT CCTGTGTCTG CCCCACGGGC TGGCAAGGGC AGACCTGTGA  2600
GGTCGACATC AACGAGTGCG TTCTGAGCCC GTGCCGGCAC GGCGCATCCT  2650
GCCAGAACAC CCACGGCGGC TACCGCTGCC ACTGCCAGGC CGGCTACAGT  2700
GGGCGCAACT GCGAGACCGA CATCGACGAC TGCCGGCCCA ACCCGTGTCA  2750
CAACGGGGGC TCCTGCACAG ACGGCATCAA CACGGCCTTC TGCGACTGCC  2800
TGCCCGGCTT CCGGGGCACT TTCTGTGAGG AGGACATCAA CGAGTGTGCC  2850
AGTGACCCCT GCCGCAACGG GGCCAACTGC ACGGACTGCG TGGACAGCTA  2900
CACGTGCACC TGCCCCGCAG GCTTCAGCGG GATCCACTGT GAGAACAACA  2950
CGCCTGACTG CACAGAGAGC TCCTGCTTCA ACGGTGGCAC CTGCGTGGAC  3000
GGCATCAACT CGTTCACCTG CCTGTGTCCA CCCGGCTTCA CGGGCAGCTA  3050
CTGCCAGCAC GATGTCAATG AGTGCGACTC ACAGCCCTGC CTGCATGGCG  3100
GCACCTGTCA GGACGGCTGC GGCTCCTACA GGTGCACCTG CCCCAGGGGC  3150
TACACTGGCC CCAACTGCCA GAACCTTGTG CACTGGTGTG ACTCCTCGCC  3200
CTGCAAGAAC GGCGGCAAAT GCTGGCAGAC CCACACCCAG TACCGCTGCG  3250
AGTGCCCCAG CGGCTGGACC GGCCTTTACT GCGACGTGCC CAGCGTGTCC  3300
TGTGAGGTGG CTGCGCAGCG ACAAGGTGTT GACGTTGCCC GCCTGTGCCA  3350
GCATGGAGGG CTCTGTGTGG ACGCGGGCAA CACGCACCAC TGCCGCTGCC  3400
AGGCGGGCTA CACAGGCAGC TACTGTGAGG ACCTGGTGGA CGAGTGCTCA  3450
CCCAGCCCCT GCCAGAACGG GGCCACCTGC ACGGACTACC TGGGCGGCTA  3500
CTCCTGCAAG TGCGTGGCCG GCTACCACGG GGTGAACTGC TCTGAGGAGA  3550
TCGACGAGTG CCTCTCCCAC CCCTGCCAGA ACGGGGGCAC CTGCCTCGAC  3600
CTCCCCAACA CCTACAAGTG CTCCTGCCCA CGGGGCACTC AGGGTGTGCA  3650
CTGTGAGATC AACGTGGACG ACTGCAATCC CCCCGTTGAC CCCGTGTCCC  3700
GGAGCCCCAA GTGCTTTAAC AACGGCACCT GCGTGGACCA GGTGGGCGGC  3750
TACAGCTGCA CCTGCCCGCC GGGCTTCGTG GGTGAGCGCT GTGAGGGGA  3800
TGTCAACGAG TGCCTGTCCA ATCCCTGCGA CGCCCGTGGC ACCCAGAACT  3850
GCGTGCAGCG CGTCAATGAC TTCCACTGCG AGTGCCGTGC TGGTCACACC  3900
GGGCGCCGCT GCGAGTCCGT CATCAATGGC TGCAAAGGCA AGCCCTGCAA  3950
GAATGGGGGC ACCTGCGCCG TGGCCTCCAA CACCGCCCGC GGGTTCATCT  4000
GCAAGTGCCC TGCGGCTTC GAGGGCGCCA CGTGTGAGAA TGACGCTCGT  4050
ACCTGCGGCA GCCTGCGCTG CCTCAACGGC GGCACATGCA TCTCCGGCCC  4100
GCGCAGCCCC ACCTGCCTGT GCCTGGGCCC CTTCACGGGC CCCGAATGCC  4150
AGTTCCCGGC CAGCAGCCCC TGCCTGGGCG GCAACCCCTG CTACAACCAG  4200
GGGACCTGTG AGCCCACATC CGAGAGCCCC TTCTACCGTT GCCTGTGCCC  4250
CGCCAAATTC AACGGGCTCT TGTGCCACAT CCTGGACTAC AGCTTCGGGG  4300
GTGGGGCCGG GCGCGACATC CCCCGCCGC TGATCGAGGA GGCGTGCGAG  4350
CTGCCCGAGT GCCAGGAGGA CGCGGGCAAC AAGGTCTGCA GCCTGCAGTG  4400
CAACAACCAC GCGTGCGGCT GGGACGGCGG TGACTGCTCC CTCAACTTCA  4450
ATGACCCCTG GAAGAACTGC ACGCAGTCTC TGCAGTGCTG GAAGTACTTC  4500
AGTGACGGCC ACTGTGACAG CCAGTGCAAC TCAGCCGGCT GCCTCTTCGA  4550
CGGCTTTGAC TGCCAGCGTG CGGAAGGCCA GTGCAACCCC CTGTACGACC  4600
AGTACTGCAA GGACCACTTC AGCGACGGGC ACTGCGACCA GGGCTGCAAC  4650
AGCGCGGAGT GCGAGTGGGA CGGGCTGGAC TGTGCGGAGC ATGTACCCGA  4700
GAGGCTGGCG GCCGGCACGC TGGTGGTGGT GGTGCTGATG CCGCCGGAGC  4750
AGCTGCGCAA CAGCTCCTTC CACTTCCTGC GGGAGCTCAG CCGCGTGCTG  4800
CACACCAACG TGGTCTTCAA GCGTGACGCA CACGGCCAGC AGATGATCTT  4850
CCCCTACTAC GGCCGCGAGG AGGAGCTGCG CAAGCACCCC ATCAAGCGTG  4900
CCGCCGAGGG CTGGGCCGCA CCTGACGCCC TGCTGGGCCA GGTGAAGGCC  4950
TCGCTGCTCC CTGGTGGCAG CGAGGGTGGG CGGCGGCGGA GGGAGCTGGA  5000
```

FIG. 73C

```
CCCCATGGAC GTCCGCGGCT CCATCGTCTA CCTGGAGATT GACAACCGGC  5050
AGTGTGTGCA GGCCTCCTCG CAGTGCTTCC AGAGTGCCAC CGACGTGGCC  5100
GCATTCCTGG GAGCGCTCGC CTCGCTGGGC AGCCTCAACA TCCCCTACAA  5150
GATCGAGGCC GTGCAGAGTG AGACCGTGGA GCCGCCCCG  CCGGCGCAGC  5200
TGCACTTCAT GTACGTGGCG GCGGCCGCCT TTGTGCTTCT GTTCTTCGTG  5250
GGCTGCGGGG TGCTGCTGTC CCGCAAGCGC CGGCGGCAGC ATGGCCAGCT  5300
CTGGTTCCCT GAGGGCTTCA AAGTGTCTGA GGCCAGCAAG AAGAAGCGGC  5350
GGGAGCCCCT CGGCGAGGAC TCCGTGGGCC TCAAGCCCCT GAAGAACGCT  5400
TCAGACGGTG CCCTCATGGA CGACAACCAG AATGAGTGGG GGGACGAGGA  5450
CCTGGAGACC AAGAAGTTCC GGTTCGAGGA GCCCGTGGTT CTGCCTGACC  5500
TGGACGACCA GACAGACCAC CGGCAGTGGA CTCAGCAGCA CCTGGATGCC  5550
GCTGACCTGC GCATGTCTGC CATGGCCCCC ACACCGCCCC AGGGTGAGGT  5600
TGACGCCGAC TGCATGGACG TCAATGTCCG CGGGCCTGAT GGCTTCACCC  5650
CGCTCATGAT CGCCTCCTGC AGCGGGGGCG GCCTGGAGAC GGGCAACAGC  5700
GAGGAAGAGG AGGACGCGCC GGCCGTCATC TCCGACTTCA TCTACCAGGG  5750
CGCCAGCCTG CACAACCAGA CAGACCGCAC GGGCGAGACC GCCTTGCACC  5800
TGGCCGCCCG CTACTCACGC TCTGATGCCG CCAAGCGCCT GCTGGAGGCC  5850
AGCGCAGATG CCAACATCCA GGACAACATG GGCCGCACCC CGCTGCATGC  5900
GGCTGTGTCT GCCGACGCAC AAGGTGTCTT CCAGATCCTG ATCCGGAACC  5950
GAGCCACAGA CCTGGATGCC CGCATGCATG ATGGCACGAC GCCACTGATC  6000
CTGGCTGCCC GCCTGGCCGT GGAGGGCATG CTGGAGGACC TCATCAACTC  6050
ACACGCCGAC GTCAACGCCG TAGATGACCT GGGCAAGTCC GCCCTGCACT  6100
GGGCCGCCGC CGTGAACAAT GTGGATGCCG CAGTTGTGCT CCTGAAGAAC  6150
GGGGCTAACA AAGATATGCA GAACAACAGG GAGGAGACAC CCCTGTTTCT  6200
GGCCGCCCGG GAGGGCAGCT ACGAGACCGC CAAGGTGCTG CTGGACCACT  6250
TTGCCAACCG GGACATCACG GATCATATGG ACCGCCTGCC GCGCGACATC  6300
GCACAGGAGC GCATGCATCA CGACATCGTG AGGCTGCTGG ACGAGTACAA  6350
CCTGGTGCGC AGCCCGCAGC TGCACGGAGC CCCGCTGGGG GGCACGCCCA  6400
CCCTGTCGCC CCCGCTCTGC TCGCCCAACG GCTACCTGGG CAGCCTCAAG  6450
CCCGGCGTGC AGGGCAAGAA GGTCCGCAAG CCCAGCAGCA AAGGCCTGGC  6500
CTGTGGAAGC AAGGAGGCCA AGGACCTCAA GGCACGGAGG AAGAAGTCCC  6550
AGGACGGCAA GGGCTGCCTG CTGGACAGCT CCGGCATGCT CTCGCCCGTG  6600
GACTCCCTGG AGTCACCCCA TGGCTACCTG TCAGACGTGG CCTCGCCGCC  6650
ACTGCTGCCC TCCCCGTTCC AGCAGTCTCC GTCCGTGCCC CTCAACCACC  6700
TGCCTGGGAT GCCCGACACC CACCTGGGCA TCGGGCACCT GAACGTGGCG  6750
GCCAAGCCCG AGATGGCGGC GCTGGGTGGG GGCGGCCGGC TGGCCTTTGA  6800
GACTGGCCCA CCTCGTCTCT CCCACCTGCC TGTGGCCTCT GGCACCAGCA  6850
CCGTCCTGGG CTCCAGCAGC GGAGGGCCC  TGAATTTCAC TGTGGGCGGG  6900
TCCACCAGTT TGAATGGTCA ATGCGAGTGG CTGTCCCGGC TGCAGAGCGG  6950
CATGGTGCCG AACCAATACA ACCCTCTGCG GGGGAGTGTG GCACCAGGCC  7000
CCCTGAGCAC ACAGGCCCCC TCCCTGCAGC ATGGCATGGT AGGCCCGCTG  7050
CACAGTAGCC TTGCTGCCAG CGCCCTGTCC CAGATGATGA GCTACCAGGG  7100
CCTGCCCAGC ACCCGGCTGG CCACCCAGCC TCACCTGGTG CAGACCCAGC  7150
AGGTGCAGCC ACAAAACTTA CAGATGCAGC AGCAGAACCT GCAGCCAGCA  7200
AACATCCAGC AGCAGCAAAG CCTGCAGCCG CCACCACCAC CACCACAGCC  7250
GCACCTTGGC GTGAGCTCAG CAGCCAGCGG CCACCTGGGC CGGAGCTTCC  7300
TGAGTGGAGA GCCGAGCCAG GCAGACGTGC AGCCACTGGG CCCCAGCAGC  7350
CTGGCGGTGC ACACTATTCT GCCCCAGGAG AGCCCCGCCC TGCCCACGTC  7400
GCTGCCATCC TCGCTGGTCC CACCCGTGAC CGCAGCCCAG TTCCTGACGC  7450
CCCCCTCGCA GCACAGCTAC TCCTCGCCTG TGGACAACAC CCCCAGCCAC  7500
```

FIG. 73D

```
CAGCTACAGG TGCCTGAGCA CCCCTTCCTC ACCCCGTCCC CTGAGTCCCC  7550
TGACCAGTGG TCCAGCTCGT CCCCGCATTC AACGTCTCC  GACTGGTCCG  7600
AGGGCGTCTC CAGCCCTCCC ACCAGCATGC AGTCCCAGAT CGCCCGCATT  7650
CCGGAGGCCT TCAAGTAAAC GGCGCGCCCC ACGAGACCCC GGCTTCCTTT  7700
CCCAAGCCTT CGGGCGTCTG TGTGCGCTCT GTGGATGCCA GGGCCGACCA  7750
GAGGAGCCTT TTTAAAACAC ATGTTTTAT  ACAAAATAAG AACGAGGATT  7800
TTAATTTTTT TTAGTATTTA TTTATGTACT TTTATTTTAC ACAGAAACAC  7850
TGCCTTTTTA TTTATATGTA CTGTTTTATC TGGCCCCAGG TAGAAACTTT  7900
TATCTATTCT GAGAAAACAA GCAAGTTCTG AGAGCCAGGG TTTTCCTACG  7950
TAGGATGAAA AGATTCTTCT GTGTTTATAA AATATAAACA AAGATTCATG  8000
ATTTATAAAT GCCATTTATT TATTGATTCC TTTTTTCAAA ATCCAAAAAG  8050
AAATGATGTT GGAGAAGGGA AGTTGAACGA GCATAGTCCA AAAAGCTCCT  8100
GGGGCGTCCA GGCCGCGCCC TTTCCCCGAC GCCCACCCAA CCCCAAGCCA  8150
GCCCGGCCGC TCCACCAGCA TCACCTGCCT GTTAGGAGAA GCTGCATCCA  8200
GAGGCAAACG GAGGCAAAGC TGGCTCACCT TCCGCACGCG GATTAATTTG  8250
CATCTGAAAT AGGAAACAAG TGAAAGCATA TGGGTTAGAT GTTGCCATGT  8300
GTTTAGATG  GTTTCTTGCA AGCATGCTTG TGAAAATGTG TTCTCGGAGT  8350
GTGTATGCCA AGAGTGCACC CATGGTACCA ATCATGAATC TTTGTTTCAG  8400
GTTCAGTATT ATGTAGTTGT TCGTTGGTTA TACAAGTTCT TGGTCCCTCC  8450
AGAACCACCC CGGCCCCCTG CCCGTTCTTG AAATGTAGGC ATCATGCATG  8500
TCAAACATGA GATGTGTGGA CTGTGGCACT TGCCTGGGTC ACACACGGAG  8550
GCATCCTACC CTTTCTGGG  GAAAGACACT GCCTGGGCTG ACCCCGGTGG  8600
CGGCCCCAGC ACCTCAGCCT GCACAGTGTC CCCCAGGTTC GAAGAAGAT   8650
GCTCCAGCAA CACAGCCTGG GCCCCAGCTC GCGGGACCCG ACCCCCGTG   8700
GGCTCCCGTG TTTTGTAGGA GACTTGCCAG AGCCGGGCAC ATTGAGCTGT  8750
GCAACGCCGT GGGCTGCGTC CTTTGGTCCT GTCCCGCAG  CCCTGGCAGG  8800
GGGCATGCGG TCGGGCAGGG GCTGGAGGGA GGCGGGGGCT GCCCTTGGGC  8850
CACCCCTCCT AGTTTGGGAG GAGCAGATTT TTGCAATACC AAGTATAGCC  8900
TATGGCAGAA AAAATGTCTG TAAATATGTT TTTAAAGGTG GATTTTGTTT  8950
AAAAAATCTT AATGAATGAG TCTGTTGTGT GTCATGCCAG TGAGGGACGT  9000
CAGACTTGGC TCAGCTCGGG GAGCCTTAGC CGCCCATGCA CTGGGGACGC  9050
TCCGCTGCCG TGCCGCCTGC ACTCCTCAGG GCAGCCTCCC CCGGCTCTAC  9100
GGGGGCCGCG TGGTGCCATC CCCAGGGGGC ATGACCAGAT GCGTCCCAAG  9150
ATGTTGATTT TTACTGTGTT TTATAAAATA GAGTGTAGTT TACAGAAAAA  9200
GACTTTAAAA GTGATCTACA TGAGGAACTG TAGATGATGT ATTTTTTCA   9250
TCTTTTTTGT TAACTGATTT GCAATAAAAA TGATACTGAT GGTGAaaaaa  9300
aaaaaaaaa (SEQ ID NO: 75)
```

FIG. 74

```
MPPLLAPLLCLALLPALAARGPRCSQPGETCLNGGKCEAANGTEACVCGGAFVGPRCQDP
NPCLSTPCKNAGTCHVVDRRGVADYACSCALGFSGPLCLTPLDNACLTNPCRNGGTCDLL
TLTEYKCRCPPGWSGKSCQQADPCASNPCANGGQCLPFEASYICHCPPSFHGPTCRQDVN
ECGQKPGLCRHGGTCHNEVGSYRCVCRATHTGPNCERPYVPCSPSPCQNGGTCRPTGDVT
HECACLPGFTGQNCEENIDDCPGNNCKNGGACVDGVNTYNCRCPPEWTGQYCTEDVDECQ
LMPNACQNGGTCHNTHGGYNCVCVNGWTGEDCSENIDDCASAACFHGATCHDRVASFYCE
CPHGRTGLLCHLNDACISNPCNEGSNCDTNPVNGKAICTCPSGYTGPACSQDVDECSLGA
NPCEHAGKCINTLGSFECQCLQGYTGPRCEIDVNECVSNPCQNDATCLDQIGEFQCICMP
GYEGVHCEVNTDECASSPCLHNGRCLDKINEFQCECPTGFTGHLCQYDVDECASTPCKNG
AKCLDGPNTYTCVCTEGYTGTHCEVDIDECDPDPCHYGSCKDGVATFTCLCRPGYTGHHC
ETNINECSSQPCRHGGTCQDRDNAYLCFCLKGTTGPNCEINLDDCASSPCDSGTCLDKID
GYECACEPGYTGSMCNINIDECAGNPCHNGGTCEDGINGFTCRCPEGYHDPTCLSEVNEC
NSNPCVHGACRDSLNGYKCDCDPGWSGTNCDINNNECESNPCVNGGTCKDMTSGYVCTCR
EGFSGPNCQTNINECASNPCLNQGTCIDDVAGYKCNCLLPYTGATCEVVLAPCAPSPCRN
GGECRQSEDYESFSCVCPTGWQGQTCEVDINECVLSPCRHGASCQNTHGGYRCHCQAGYS
GRNCETDIDDCRPNPCHNGGSCTDGINTAFCDCLPGFRGTFCEEDINECASDPCRNGANC
TDCVDSYTCTCPAGFSGIHCENNTPDCTESSCFNGGTCVDGINSFTCLCPPGFTGSYCQH
DVNECDSQPCLHGGTCQDGCGSYRCTCPQGYTGPNCQNLVHWCDSSPCKNGGKCWQTHTQ
YRCECPSGWTGLYCDVPSVSCEVAAQRQGVDVARLCQHGGLCVDAGNTHHCRCQAGYTGS
YCEDLVDECSPSPCQNGATCTDYLGGYSCKCVAGYHGVNCSEEIDECLSHPCQNGGTCLD
LPNTYKCSCPRGTQGVHCEINVDDCNPPVDPVSRSPKCFNNGTCVDQVGGYSCTCPPGFV
GERCEGDVNECLSNPCDARGTQNCVQRVNDFHCECRAGHTGRRCESVINGCKGKPCKNGG
TCAVASNTARGFICKCPAGFEGATCENDARTCGSLRCLNGGTCISGPRSPTCLCLGPFTG
PECQFPASSPCLGGNPCYNQGTCEPTSESPFYRCLCPAKFNGLLCHILDYSFGGGAGRDI
PPPLIEEACELPECQEDAGNKVCSLQCNNHACGWDGGDCSLNFNDPWKNCTQSLQCWKYF
SDGHCDSQCNSAGCLFDGFDCQRAEGQCNPLYDQYCKDHFSDGHCDQGCNSAECEWDGLD
CAEHVPERLAAGTLVVVVLMPPEQLRNSSFHFLRELSRVLHTNVVFKRDAHGQQMIFPYY
GREEELRKHPIKRAAEGWAAPDALLGQVKASLLPGGSEGGRRRRELDPMDVRGSIVYLEI
DNRQCVQASSQCFQSATDVAAFLGALASLGSLNIPYKIEAVQSETVEPPPPAQLHFMYVA
AAAFVLLFFVGCGVLLSRKRRRQHGQLWFPEGFKVSEASKKKRREPLGEDSVGLKPLKNA
SDGALMDDNQNEWGDEDLETKKFRFEEPVVLPDLDDQTDHRQWTQQHLDAADLRMSAMAP
TPPQGEVDADCMDVNVRGPDGFTPLMIASCSGGGLETGNSEEEEDAPAVISDFIYQGASL
HNQTDRTGETALHLAARYSRSDAAKRLLEASADANIQDNMGRTPLHAAVSADAQGVFQIL
IRNRATDLDARMHDGTTPLILAARLAVEGMLEDLINSHADVNAVDDLGKSALHWAAAVNN
VDAAVVLLKNGANKDMQNNREETPLFLAAREGSYETAKVLLDHFANRDITDHMDRLPRDI
AQERMHHDIVRLLDEYNLVRSPQLHGAPLGGTPTLSPPLCSPNGYLGSLKPGVQGKKVRK
PSSKGLACGSKEAKDLKARRKKSQDGKGCLLDSSGMLSPVDSLESPHGYLSDVASPPLLP
SPFQQSPSVPLNHLPGMPDTHLGIGHLNVAAKPEMAALGGGGRLAFETGPPRLSHLPVAS
GTSTVLGSSSGGALNFTVGGSTSLNGQCEWLSRLQSGMVPNQYNPLRGSVAPGPLSTQAP
SLQHGMVGPLHSSLAASALSQMMSYQGLPSTRLATQPHLVQTQQVQPQNLQMQQQNLQPA
NIQQQQSLQPPPPPPQPHLGVSSAASGHLGRSFLSGEPSQADVQPLGPSSLAVHTILPQE
SPALPTSLPSSLVPPVTAAQFLTPPSQHSYSSPVDNTPSHQLQVPEHPFLTPSPESPDQW
SSSSPHSNVSDWSEGVSSPPTSMQSQIARIPEAFK-  (SEQ ID NO: 76)
```

FIG. 75A

```
atggccaaaccaacaagcaaagattcaggcttgaaggagaagtttaagattctgttggga    60
 M  A  K  P  T  S  K  D  S  G  L  K  E  K  F  K  I  L  L  G     20 ctgggaacaccgaggccaaatcccaggtctgcagagggtaaacagacggagtttatcatc   120
 L  G  T  P  R  P  N  P  R  S  A  E  G  K  Q  T  E  F  I  I     40 accgcggaaatactgagagaactgagcatggaatgtggcctcaacaatcgcatccggatg   180
 T  A  E  I  L  R  E  L  S  M  E  C  G  L  N  N  R  I  R  M     60 atagggcagatttgtgaagtcgcaaaaaccaagaaatttgaagagcacgcagtggaagca   240
 I  G  Q  I  C  E  V  A  K  T  K  K  F  E  E  H  A  V  E  A     80 ctctggaaggcggtcgcggatctgttgcagccggagcggccgctggaggcccggcacgcg   300
 L  W  K  A  V  A  D  L  L  Q  P  E  R  P  L  E  A  R  H  A    100 gtgctggctctgctgaaggccatcgtgcaggggcagggcgagcgttttggggtcctcaga   360
 V  L  A  L  L  K  A  I  V  Q  G  Q  G  E  R  L  G  V  L  R    120 gccctcttctttaaggtcatcaaggattacccttccaacgaagaccttcacgaaaggctg   420
 A  L  F  F  K  V  I  K  D  Y  P  S  N  E  D  L  H  E  R  L    140 gaggttttcaaggccctcacagacaatgggagacacatcacctacttggaggaagagctg   480
 E  V  F  K  A  L  T  D  N  G  R  H  I  T  Y  L  E  E  E  L    160 gctgactttgtcctgcagtggatggatgttggcttgtcctcggaattccttctggtgctg   540
 A  D  F  V  L  Q  W  M  D  V  G  L  S  S  E  F  L  L  V  L    180 gtgaacttggtcaaattcaatagctgttacctcgacgagtacatcgcaaggatggttcag   600
 V  N  L  V  K  F  N  S  C  Y  L  D  E  Y  I  A  R  M  V  Q    200 atgatctgtctgctgtgcgtccggaccgcgtcctctgtggacatagaggtctccctgcag   660
 M  I  C  L  L  C  V  R  T  A  S  S  V  D  I  E  V  S  L  Q    220 gtgctggacgccgtggtctgctacaactgcctgccggctgagagcctcccgctgttcatc   720
 V  L  D  A  V  V  C  Y  N  C  L  P  A  E  S  L  P  L  F  I    240 gttaccctctgtcgcaccatcaacgtcaaggagctctgcgagccttgctggaagctgatg   780
 V  T  L  C  R  T  I  N  V  K  E  L  C  E  P  C  W  K  L  M    260 cggaacctccttggcacccacctgggccacagcgccatctacaacatgtgccacctcatg   840
 R  N  L  L  G  T  H  L  G  H  S  A  I  Y  N  M  C  H  L  M    280 gaggacagagcctacatggaggacgcgcccctgctgagaggagccgtgttttttgtgggc   900
 E  D  R  A  Y  M  E  D  A  P  L  L  R  G  A  V  F  F  V  G    300 atggctctctggggagcccaccggctctattctctcaggaactcgccgacatctgtgttg   960
 M  A  L  W  G  A  H  R  L  Y  S  L  R  N  S  P  T  S  V  L    320 ccatcattttaccaggccatggcatgtccgaacgaggtggtgtcctatgagatcgtcctg  1020
 P  S  F  Y  Q  A  M  A  C  P  N  E  V  V  S  Y  E  I  V  L    340
```

FIG. 75B

```
tccatcaccaggctcatcaagaagtataggaaggagctccaggtggtggcgtgggacatt 1080
 S   I   T   R   L   I   K   K   Y   R   K   E   L   Q   V   V   A   W   D   I    360 ctgctgaacatcatcgaacggctccttcagcagctccagaccttggacagcccggagctc 1140
 L   L   N   I   I   E   R   L   L   Q   Q   L   Q   T   L   D   S   P   E   L    380 aggaccatcgtccatgacctgttgaccacggtggaggagctgtgtgaccagaacgagttc 1200
 R   T   I   V   H   D   L   L   T   T   V   E   E   L   C   D   Q   N   E   F    400 cacgggtctcaggagagatactttgaactggtggagagatgtgcggaccagaggcctgag 1260
 H   G   S   Q   E   R   Y   F   E   L   V   E   R   C   A   D   Q   R   P   E    420 tcctccctcctgaacctgatctcctatagagcgcagtccatccacccggccaaggacggc 1320
 S   S   L   L   N   L   I   S   Y   R   A   Q   S   I   H   P   A   K   D   G    440 tggattcagaacctgcaggcgctgatggagagattcttcaggagcgagtcccgaggcgcc 1380
 W   I   Q   N   L   Q   A   L   M   E   R   F   F   R   S   E   S   R   G   A    460 gtgcgcatcaaggtgctggacgtgctgtcctttgtgctgctcatcaacaggcagttctat 1440
 V   R   I   K   V   L   D   V   L   S   F   V   L   L   I   N   R   Q   F   Y    480 gaggaggagctgattaactcagtggtcatctcgcagctctcccacatccccgaggataaa 1500
 E   E   E   L   I   N   S   V   V   I   S   Q   L   S   H   I   P   E   D   K    500 gaccaccaggtccgaaagctggccacccagttgctggtggacctggcagagggctgccac 1560
 D   H   Q   V   R   K   L   A   T   Q   L   L   V   D   L   A   E   G   C   H    520 acacaccacttcaacagcctgctggacatcatcgagaaggtgatggcccgctccctctcc 1620
 T   H   H   F   N   S   L   L   D   I   I   E   K   V   M   A   R   S   L   S    540 ccaccccggagctggaagaaagggatgtggccgcatactcggcctccttggaggatgtg 1680
 P   P   P   E   L   E   E   R   D   V   A   A   Y   S   A   S   L   E   D   V    560 aagacagccgtcctgggcttctggtcatccttcagaccaagctgtacacctgcctgca 1740
 K   T   A   V   L   G   L   L   V   I   L   Q   T   K   L   Y   T   L   P   A    580 agccacgccacgcgtgtgtatgagatgctggtcagccacattcagctccactacaagcac 1800
 S   H   A   T   R   V   Y   E   M   L   V   S   H   I   Q   L   H   Y   K   H    600 agctacaccctgccaatcgcgagcagcatccggctgcaggcctttgacttcctgttgctg 1860
 S   Y   T   L   P   I   A   S   S   I   R   L   Q   A   F   D   F   L   L   L    620 ctgcgggccgactcactgcaccgcctgggcctgcccaacaaggatggagtcgtgcggttc 1920
 L   R   A   D   S   L   H   R   L   G   L   P   N   K   D   G   V   V   R   F    640 agccctactgcgtctgcgactacatggagccagagagaggctctgagaagaagaccagc 1980
 S   P   Y   C   V   C   D   Y   M   E   P   E   R   G   S   E   K   K   T   S    660 ggccccctttctcctcccacagggcctcctggcccggcgcctgcaggccccgccgtgcgg 2040
 G   P   L   S   P   P   T   G   P   P   G   P   A   P   A   G   P   A   V   R    680
```

FIG. 75C

```
ctggggtccgtgccctactccctgctcttccgcgtcctgctgcagtgcttgaagcaggag  2100
 L   G   S   V   P   Y   S   L   L   F   R   V   L   L   Q   C   L   K   Q   E    700 tctgactggaaggtgctgaagctggttctgggcaggctgcctgagtccctgcgctataaa  2160
 S   D   W   K   V   L   K   L   V   L   G   R   L   P   E   S   L   R   Y   K    720 gtgctcatctttacttccccttgcagtgtggaccagctgtgctctgctctctgctccatg  2220
 V   L   I   F   T   S   P   C   S   V   D   Q   L   C   S   A   L   C   S   M    740 cttcaggcccaaagacactggagcggctccgaggcgccccagaaggcttctccagaact  2280
 L   S   G   P   K   T   L   E   R   L   R   G   A   P   E   G   F   S   R   T    760 gacttgcacctggccgtggttccagtgctgacagcattaatctcttaccataactacctg  2340
 D   L   H   L   A   V   V   P   V   L   T   A   L   I   S   Y   H   N   Y   L    780 gacaaaaccaaacagcgcgagatggtctactgcctggagcagggcctcatccaccgctgt  2400
 D   K   T   K   Q   R   E   M   V   Y   C   L   E   Q   G   L   I   H   R   C    800 gccagccagtgcgtcgtggccttgtccatctgcagcgtggagatgcctgacatcatcatc  2460
 A   S   Q   C   V   V   A   L   S   I   C   S   V   E   M   P   D   I   I   I    820 aaggcgctgcctgttctggtggtgaagctcacgcacatctcagccacagccagcatggcc  2520
 K   A   L   P   V   L   V   V   K   L   T   H   I   S   A   T   A   S   M   A    840 gtcccactgctggagttcctgtccactctggccaggctgccgcacctctacaggaacttt  2580
 V   P   L   L   E   F   L   S   T   L   A   R   L   P   H   L   Y   R   N   F    860 gccgcggagcagtatgccagtgtgttcgccatctccctgccgtacaccaaccccctccaag  2640
 A   A   E   Q   Y   A   S   V   F   A   I   S   L   P   Y   T   N   P   S   K    880 tttaatcagtacatcgtgtgtctggcccatcacgtcatagccatgtggttcatcaggtgc  2700
 F   N   Q   Y   I   V   C   L   A   H   H   V   I   A   M   W   F   I   R   C    900 cgcctgcccttccggaaggattttgtccctttcatcactaagggcctgcggtccaatgtc  2760
 R   L   P   F   R   K   D   F   V   P   F   I   T   K   G   L   R   S   N   V    920 ctcttgtcttttgatgacacccccgagaaggacagcttcagggcccggagtactagtctc  2820
 L   L   S   F   D   D   T   P   E   K   D   S   F   R   A   R   S   T   S   L    940 aacgagagacccaagaggatacagacgtccctcaccagtgccagcttggggtctgcagat  2880
 N   E   R   P   K   R   I   Q   T   S   L   T   S   A   S   L   G   S   A   D    960 gagaactccgtggcccaggctgacgatagcctgaaaaacctccacctggagctcacggaa  2940
 E   N   S   V   A   Q   A   D   D   S   L   K   N   L   H   L   E   L   T   E    980 acctgtctggacatgatggctcgatacgtcttctccaacttcacggctgtcccgaagagg  3000
 T   C   L   D   M   M   A   R   Y   V   F   S   N   F   T   A   V   P   K   R   1000 tctcctgtgggcgagttcctcctagcgggtggcaggaccaaaacctggctggttgggaac  3060
 S   P   V   G   E   F   L   L   A   G   G   R   T   K   T   W   L   V   G   N   1020
```

FIG. 75D

```
aagcttgtcactgtgacgacaagcgtgggaaccgggacccggtcgttactaggcctggac 3120
  K   L   V   T   V   T   T   S   V   G   T   G   T   R   S   L   L   G   L   D   1040 tcggggagctgcagtccggcccggagtcgagctccagccccggggtgcatgtgagacag 3180
  S   G   E   L   Q   S   G   P   E   S   S   S   S   P   G   V   H   V   R   Q   1060 accaaggaggcgccggccaagctggagtcccaggctgggcagcaggtgtcccgtggggcc 3240
  T   K   E   A   P   A   K   L   E   S   Q   A   G   Q   Q   V   S   R   G   A   1080 cgggatcgggtccgttccatgtcggggggccatggtcttcgagttggcgccctggacgtg 3300
  R   D   R   V   R   S   M   S   G   G   H   G   L   R   V   A   L   D   V   1100 ccggcctcccagttcctgggcagtgccacttctccaggaccacggactgcaccagccgcg 3360
  P   A   S   Q   F   L   G   S   A   T   S   P   G   P   R   T   A   P   A   A   1120 aaacctgagaaggcctcagctggcacccgggttcctgtgcaggagaagacgaacctggcg 3420
  K   P   E   K   A   S   A   G   T   R   V   P   V   Q   E   K   T   N   L   A   1140 gcctatgtgcccctgctgacccagggctgggcggagatcctggtccggaggcccacaggg 3480
  A   Y   V   P   L   L   T   Q   G   W   A   E   I   L   V   R   R   P   T   G   1160 aacaccagctggctgatgagcctggagaacccgctcagccctttctcctcggacatcaac 3540
  N   T   S   W   L   M   S   L   E   N   P   L   S   P   F   S   S   D   I   N   1180 aacatgcccctgcaggagctgtctaacgccctcatggcggctgagcgcttcaaggagcac 3600
  N   M   P   L   Q   E   L   S   N   A   L   M   A   A   E   R   F   K   E   H   1200 cgggacacagccctgtacaagtcactgtcggtgccggcagccagcacggccaaaccccct 3660
  R   D   T   A   L   Y   K   S   L   S   V   P   A   A   S   T   A   K   P   P   1220 cctctgcctcgctccaacacagactccgccgtggtcatggaggagggaagtccgggcgag 3720
  P   L   P   R   S   N   T   D   S   A   V   V   M   E   E   G   S   P   G   E   1240 gttcctgtgctggtggagcccccagggttggaggacgttgaggcagcgctaggcatggac 3780
  V   P   V   L   V   E   P   P   G   L   E   D   V   E   A   A   L   G   M   D   1260

Aggcgcacggatgcctacagcaggtcgtcctcagtctccagccaggaggagaagtcgctc 3840
  R   R   T   D   A   Y   S   R   S   S   S   V   S   S   Q   E   E   K   S   L   1280 cacgcggaggagctggttggcaggggcatccccatcgagcgagtcgtctcctcggaggt 3900
  H   A   E   E   L   V   G   R   G   I   P   I   E   R   V   V   S   S   E   G   1300 ggccggccctctgtggacctctccttccagccctcgcagcccctgagcaagtccagctcc 3960
  G   R   P   S   V   D   L   S   F   Q   P   S   Q   P   L   S   K   S   S   S   1320 tctcccgagctgcagactctgcaggacatcctcggggaccctggggacaaggccgacgtg 4020
  S   P   E   L   Q   T   L   Q   D   I   L   G   D   P   G   D   K   A   D   V   1340 ggccggctgagccctgaggttaaggcccggtcacagtcagggaccctggacggggaaagt 4080
  G   R   L   S   P   E   V   K   A   R   S   Q   S   G   T   L   D   G   E   S   1360
```

FIG. 75E

```
gctgcctggtcggcctcgggcgaagacagtcggggccagcccgagggtcccttgccttcc  4140
 A  A  W  S  A  S  G  E  D  S  R  G  Q  P  E  G  P  L  P  S    1380 agctcccccgctcgcccagtggcctccggccccgaggttacaccatctccgactcggcc   4200
 S  S  P  R  S  P  S  G  L  R  P  R  G  Y  T  I  S  D  S  A    1400 ccatcacgcaggggcaagagagtagagagggacgccttaaagagcagagccacagcctcc  4260
 P  S  R  R  G  K  R  V  E  R  D  A  L  K  S  R  A  T  A  S    1420 aatgcagagaaagtgccaggcatcaaccccagtttcgtgttcctgcagctctaccattcc  4320
 N  A  E  K  V  P  G  I  N  P  S  F  V  F  L  Q  L  Y  H  S    1440 cccttctttggcgacgagtcaaacaagccaatcctgctgcccaatgagtcacagtccttt  4380
 P  F  F  G  D  E  S  N  K  P  I  L  L  P  N  E  S  Q  S  F    1460 gagcggtcggtgcagctcctcgaccagatcccatcatacgacacccacaagatcgccgtc  4440
 E  R  S  V  Q  L  L  D  Q  I  P  S  Y  D  T  H  K  I  A  V    1480 ctgtatgttggagaaggccagagcaacagcgagctcgccatcctgtccaatgagcatggc  4500
 L  Y  V  G  E  G  Q  S  N  S  E  L  A  I  L  S  N  E  H  G    1500 tcctacaggtacacggagttcctgacgggcctgggccggctcatcgagctgaaggactgc  4560
 S  Y  R  Y  T  E  F  L  T  G  L  G  R  L  I  E  L  K  D  C    1520 cagccggacaaggtgtacctgggaggcctggacgtgtgtggtgaggacggccagttcacc  4620
 Q  P  D  K  V  Y  L  G  G  L  D  V  C  G  E  D  G  Q  F  T    1540 tactgctggcacgatgacatcatgcagggctgcagaccacaagactgggaaaccacttg   4680
 Y  C  W  H  D  D  I  M  Q  G  L  Q  T  T  R  L  G  N  H  L    1560 gaagaccgagtgaacaaattttttgcggcgccagaatcaccctgaagccggggaggttttt 4740
 E  D  R  V  N  K  F  L  R  R  Q  N  H  P  E  A  G  E  V  F    1580 gtccgagtggtggccagctcagacaagacggtggaggtcaagcccgggatgaagtcacgg 4800
 V  R  V  V  A  S  S  D  K  T  V  E  V  K  P  G  M  K  S  R    1600 tttgtggattctggggaaatgtctgaatctttcccatatcgaaccaaagctctgtttgct  4860
 F  V  D  S  G  E  M  S  E  S  F  P  Y  R  T  K  A  L  F  A    1620 tttgaggaaattgacggcgtggatgtctgcttttttggaatgcacgtccaagaatacggc  4920
 F  E  E  I  D  G  V  D  V  C  F  F  G  M  H  V  Q  E  Y  G    1640 tctgattgccccccctccaaacacgaggcgtgtgtacatttcttatctggatagtattcat 4980
 S  D  C  P  P  P  N  T  R  R  V  Y  I  S  Y  L  D  S  I  H    1660 ttcttccggccacgttgcctccgcacagccgtttaccatgagatccttattggatattta  5040
 F  F  R  P  R  C  L  R  T  A  V  Y  H  E  I  L  I  G  Y  L    1680 gagtatgtgaagaaattagggtatgtgacagggcacatctgggcctgtcctccaagtgaa  5100
 E  Y  V  K  K  L  G  Y  V  T  G  H  I  W  A  C  P  P  S  E    1700
```

FIG. 75F

```
ggagatgattacatcttccattgccacccacctgatcaaaaaatacccaagccaaaacga 5160
 G  D  D  Y  I  F  H  C  H  P  P  D  Q  K  I  P  K  P  K  R   1720 ctgcaggagtggtacaaaaagatgctggacaaggcgtttgcagagcggatcatccatgac 5220
 L  Q  E  W  Y  K  K  M  L  D  K  A  F  A  E  R  I  I  H  D   1740 tacaaggatattttcaaacaagcaactgaagacaggctcaccagtgccaaggaactgccc 5280
 Y  K  D  I  F  K  Q  A  T  E  D  R  L  T  S  A  K  E  L  P   1760 tattttgaaggtgatttctggcccaatgtgttagaagagagcattaaggaactagaacaa 5340
 Y  F  E  G  D  F  W  P  N  V  L  E  E  S  I  K  E  L  E  Q   1780 gaagaagaggagaggaaaaaggaagagagcactgcagccagtgaaaccactgagggcagt 5400
 E  E  E  R  K  K  E  E  S  T  A  A  S  E  T  T  E  G  S     1800 cagggcgacagcaagaatgccaagaagaagaacaacaagaaaaccaacaagaacaaaagc 5460
 Q  G  D  S  K  N  A  K  K  K  N  N  K  K  T  N  K  N  K  S   1820 agcatcagccgcgccaacaagaagaagcccagcatgcccaacgtgtccaatgacctgtcc 5520
 S  I  S  R  A  N  K  K  K  P  S  M  P  N  V  S  N  D  L  S   1840 cagaagctgtatgccaccatggagaagcacaaggaggtcttcttcgtgatccacctgcac 5580
 Q  K  L  Y  A  T  M  E  K  H  K  E  V  F  F  V  I  H  L  H   1860 gctgggcctgtcatcaacaccctgccccccatcgtcgaccccgacccctgctcagctgt 5640
 A  G  P  V  I  N  T  L  P  P  I  V  D  P  D  P  L  L  S  C   1880 gacctcatggatgggcgcgacgccttcctcaccctcgccagagacaagcactgggagttc 5700
 D  L  M  D  G  R  D  A  F  L  T  L  A  R  D  K  H  W  E  F   1900 tcctccttgcgccgctccaagtggtccacgctctgcatgctggtggagctgcacacccag 5760
 S  S  L  R  R  S  K  W  S  T  L  C  M  L  V  E  L  H  T  Q   1920 ggccaggaccgctttgtctacacctgcaacgagtgcaagcaccacgtggagacgcgctgg 5820
 G  Q  D  R  F  V  Y  T  C  N  E  C  K  H  H  V  E  T  R  W   1940 cactgcactgtgtgcgaggactacgacctctgcatcaactgctataacacgaagagccat 5880
 H  C  T  V  C  E  D  Y  D  L  C  I  N  C  Y  N  T  K  S  H   1960 gcccataagatggtgaagtgggggctgggcctggatgacgagggcagcagccagggcgag 5940
 A  H  K  M  V  K  W  G  L  G  L  D  D  E  G  S  S  Q  G  E   1980 ccacagtcaaagagcccccaggagtcacgccggctgagcatccagcgctgcatccagtcg 6000
 P  Q  S  K  S  P  Q  E  S  R  R  L  S  I  Q  R  C  I  Q  S   2000 ctggtgcacgcgtgccagtgccgcaacgccaactgctcgctgccatcctgccagaagatg 6060
 L  V  H  A  C  Q  C  R  N  A  N  C  S  L  P  S  C  Q  K  M   2020 aagcgggtggtgcagcacaccaagggctgcaaacgcaagaccaacggggctgcccggtg 6120
 K  R  V  V  Q  H  T  K  G  C  K  R  K  T  N  G  G  C  P  V   2040
```

FIG. 75G

```
tgcaagcagctcatcgccctctgctgctaccacgccaagcactgccaagaaaacaaatgc 6180
 C  K  Q  L  I  A  L  C  C  Y  H  A  K  H  C  Q  E  N  K  C  2060 cccgtgcccttctgcctcaacatcaaacacaagctccgccagcagcagatccagcaccgc 6240
 P  V  P  F  C  L  N  I  K  H  K  L  R  Q  Q  Q  I  Q  H  R  2080 ctgcagcaggcccagctcatgcgccggcggatggccaccatgaacacccgcaacgtgcct 6300
 L  Q  Q  A  Q  L  M  R  R  R  M  A  T  M  N  T  R  N  V  P  2100 cagcagagtctgccttctcctacctcagcaccgcccgggaccccacacagcagcccagc 6360
 Q  Q  S  L  P  S  P  T  S  A  P  P  G  T  P  T  Q  Q  P  S  2120 acaccccagacgccgcagccccctgcccagccccaaccctcacccgtgagcatgtcacca 6420
 T  P  Q  T  P  Q  P  P  A  Q  P  Q  P  S  P  V  S  M  S  P  2140 gctggcttccccagcgtggcccggactcagcccccaccacggtgtccacagggaagcct 6480
 A  G  F  P  S  V  A  R  T  Q  P  P  T  T  V  S  T  G  K  P  2160 accagccaggtgccggccccccccaccccggcccagccccctcctgcagcggtggaagcg 6540
 T  S  Q  V  P  A  P  P  P  P  A  Q  P  P  P  A  A  V  E  A  2180 gctcggcagatcgagcgtgaggcccagcagcagcagcacctgtaccgggtgaacatcaac 6600
 A  R  Q  I  E  R  E  A  Q  Q  Q  Q  H  L  Y  R  V  N  I  N  2200 aacagcatgccccaggacgcacgggcatggggaccccggggagccagatggcccccgtg 6660
 N  S  M  P  P  G  R  T  G  M  G  T  P  G  S  Q  M  A  P  V  2220 agcctgaatgtgccccgacccaaccaggtgagcgggcccgtcatgcccagcatgcctccc 6720
 S  L  N  V  P  R  P  N  Q  V  S  G  P  V  M  P  S  M  P  P  2240 gggcagtggcagcaggcgccccttccccagcagcagcccatgccaggcttgcccaggcct 6780
 G  Q  W  Q  Q  A  P  L  P  Q  Q  Q  P  M  P  G  L  P  R  P  2260 gtgatatccatgcaggcccaggcggccgtggctgggccccggatgcccagcgtgcagcca 6840
 V  I  S  M  Q  A  Q  A  A  V  A  G  P  R  M  P  S  V  Q  P  2280 cccaggagcatctcacccagcgctctgcaagacctgctgcggaccctgaagtcgcccagc 6900
 P  R  S  I  S  P  S  A  L  Q  D  L  L  R  T  L  K  S  P  S  2300 tcccctcagcagcaacagcaggtgctgaacattctcaaatcaaacccgcagctaatggca 6960
 S  P  Q  Q  Q  Q  Q  V  L  N  I  L  K  S  N  P  Q  L  M  A  2320 gctttcatcaaacagcgcacagccaagtacgtggccaatcagcccggcatgcagccccag 7020
 A  F  I  K  Q  R  T  A  K  Y  V  A  N  Q  P  G  M  Q  P  Q  2340 cctggcctccagtcccagcccggcatgcaacccagcctggcatgcaccagcagcccagc 7080
 P  G  L  Q  S  Q  P  G  M  Q  P  Q  P  G  M  H  Q  Q  P  S  2360 ctgcagaacctgaatgccatgcaggctggcgtgccgcggcccggtgtgcctccacagcag 7140
 L  Q  N  L  N  A  M  Q  A  G  V  P  R  P  G  V  P  P  Q  Q  2380
```

FIG. 75H

```
caggcgatgggaggcctgaaccccccagggccaggccttgaacatcatgaacccaggacac 7200
  Q  A  M  G  G  L  N  P  Q  G  Q  A  L  N  I  M  N  P  G  H  2400 aaccccaacatggcgagtatgaatccacagtaccgagaaatgttacggaggcagctgctg 7260
  N  P  N  M  A  S  M  N  P  Q  Y  R  E  M  L  R  R  Q  L  L  2420 cagcagcagcagcaacagcagcagcaacaacagcagcaacagcagcagcagcaagggagt 7320
  Q  Q  Q  Q  Q  Q  Q  Q  Q  Q  Q  Q  Q  Q  Q  Q  Q  Q  G  S  2440 gccggcatggctgggggcatggcggggcacggccagttccagcagcctcaaggacccgga 7380
  A  G  M  A  G  G  M  A  G  H  G  Q  F  Q  Q  P  Q  G  P  G  2460 ggctacccaccggccatgcagcagcagcagcgcatgcagcagcatctcccccctccagggc 7440
  G  Y  P  P  A  M  Q  Q  Q  Q  R  M  Q  Q  H  L  P  L  Q  G  2480 agctccatgggccagatggcggctcagatgggacagcttggccagatggggcagccgggg 7500
  S  S  M  G  Q  M  A  A  Q  M  G  Q  L  G  Q  M  G  Q  P  G  2500 ctgggggcagacagcacccccaacatccagcaagccctgcagcagcggattctgcagcaa 7560
  L  G  A  D  S  T  P  N  I  Q  Q  A  L  Q  Q  R  I  L  Q  Q  2520 cagcagatgaagcagcagattgggtccccaggccagccgaacccccatgagcccccagcaa 7620
  Q  Q  M  K  Q  Q  I  G  S  P  G  Q  P  N  P  M  S  P  Q  Q  2540 cacatgctctcaggacagccacaggcctcgcatctccctggccagcagatcgccacgtcc 7680
  H  M  L  S  G  Q  P  Q  A  S  H  L  P  G  Q  Q  I  A  T  S  2560 cttagtaaccaggtgcggtctccagcccctgtccagtctccacggccccagtcccagcct 7740
  L  S  N  Q  V  R  S  P  A  P  V  Q  S  P  R  P  Q  S  Q  P  2580 ccacattccagcccgtcaccacggatacagccccagccttcgccacaccacgtctcaccc 7800
  P  H  S  S  P  S  P  R  I  Q  P  Q  P  S  P  H  H  V  S  P  2600 cagactggttcccccacccccggactcgcagtcaccatggccagctccatagatcaggga 7860
  Q  T  G  S  P  H  P  G  L  A  V  T  M  A  S  S  I  D  Q  G  2620 cacttggggaaccccgaacagagtgcaatgctcccccagctgaacaccccccagcaggagt 7920
  H  L  G  N  P  E  Q  S  A  M  L  P  Q  L  N  T  P  S  R  S  2640 gcgctgtccagcgaactgtccctggtcggggacaccacggggggacacgctagagaagttt 7980
  A  L  S  S  E  L  S  L  V  G  D  T  T  G  D  T  L  E  K  F  2660

Gtggagggcttgtag    (SEQ ID NO: 77)
  V  E  G  L  -    (SEQ ID NO: 78)
```

FIG. 76A

| | | | | | |
|---|---|---|---|---|---|
|CCGGCGGCGT|CCCGGGGCCA|GGGGGGTGCG|CCTTTCTCCG|CGTCGGGGCG|50|
|GCCCGGAGCG|CGGTGGCGCG|GCGCGGGAGG|GGTTTTCTGG|TGCGTCCTGG|100|
|TCCACCATGG|CCAAACCAAC|AAGCAAAGAT|TCAGGCTTGA|AGGAGAAGTT|150|
|TAAGATTCTG|TTGGGACTGG|GAACACCGAG|GCCAAATCCC|AGGTCTGCAG|200|
|AGGGTAAACA|GACGGAGTTT|ATCATCACCG|CGGAAATACT|GAGAGAACTG|250|
|AGCATGGAAT|GTGGCCTCAA|CAATCGCATC|CGGATGATAG|GGCAGATTTG|300|
|TGAAGTCGCA|AAAACCAAGA|AATTTGAAGA|GCACGCAGTG|GAAGCACTCT|350|
|GGAAGGCGGT|CGCGGATCTG|TTGCAGCCGG|AGCGGCCGCT|GGAGGCCCGG|400|
|CACGCGGTGC|TGGCTCTGCT|GAAGGCCATC|GTGCAGGGGC|AGGGCGAGCG|450|
|TTTGGGGGTC|CTCAGAGCCC|TCTTCTTTAA|GGTCATCAAG|GATTACCCTT|500|
|CCAACGAAGA|CCTTCACGAA|AGGCTGGAGG|TTTTCAAGGC|CCTCACAGAC|550|
|AATGGGAGAC|ACATCACCTA|CTTGGAGGAA|GAGCTGGCTG|ACTTTGTCCT|600|
|GCAGTGGATG|GATGTTGGCT|TGTCCTCGGA|ATTCCTTCTG|GTGCTGGTGA|650|
|ACTTGGTCAA|ATTCAATAGC|TGTTACCTCG|ACGAGTACAT|CGCAAGGATG|700|
|GTTCAGATGA|TCTGTCTGCT|GTGCGTCCGG|ACCGCGTCCT|CTGTGGACAT|750|
|AGAGGTCTCC|CTGCAGGTGC|TGGACGCCGT|GGTCTGCTAC|AACTGCCTGC|800|
|CGGCTGAGAG|CCTCCCGCTG|TTCATCGTTA|CCCTCTGTCG|CACCATCAAC|850|
|GTCAAGGAGC|TCTGCGAGCC|TTGCTGGAAG|CTGATGCGGA|ACCTCCTTGG|900|
|CACCCACCTG|GGCCACAGCG|CCATCTACAA|CATGTGCCAC|CTCATGGAGG|950|
|ACAGAGCCTA|CATGGAGGAC|GCGCCCCTGC|TGAGAGGAGC|CGTGTTTTTT|1000|
|GTGGGCATGG|CTCTCTGGGG|AGCCCACCGG|CTCTATTCTC|TCAGGAACTC|1050|
|GCCGACATCT|GTGTTGCCAT|CATTTTACCA|GGCCATGGCA|TGTCCGAACG|1100|
|AGGTGGTGTC|CTATGAGATC|GTCCTGTCCA|TCACCAGGCT|CATCAAGAAG|1150|
|TATAGGAAGG|AGCTCCAGGT|GGTGGCGTGG|GACATTCTGC|TGAACATCAT|1200|
|CGAACGGCTC|CTTCAGCAGC|TCCAGACCTT|GGACAGCCCG|GAGCTCAGGA|1250|
|CCATCGTCCA|TGACCTGTTG|ACCACGGTGG|AGGAGCTGTG|TGACCAGAAC|1300|
|GAGTTCCACG|GGTCTCAGGA|GAGATACTTT|GAACTGGTGG|AGAGATGTGC|1350|
|GGACCAGAGG|CCTGAGTCCT|CCCTCCTGAA|CCTGATCTCC|TATAGAGCGC|1400|
|AGTCCATCCA|CCCGGCCAAG|GACGGCTGGA|TTCAGAACCT|GCAGGCGCTG|1450|
|ATGGAGAGAT|TCTTCAGGAG|CGAGTCCCGA|GGCGCCGTGC|GCATCAAGGT|1500|
|GCTGGACGTG|CTGTCCTTTG|TGCTGCTCAT|CAACAGGCAG|TTCTATGAGG|1550|
|AGGAGCTGAT|TAACTCAGTG|GTCATCTCGC|AGCTCTCCCA|CATCCCCGAG|1600|
|GATAAAGACC|ACCAGGTCCG|AAAGCTGGCC|ACCCAGTTGC|TGGTGGACCT|1650|
|GGCAGAGGGC|TGCCACACAC|ACCACTTCAA|CAGCCTGCTG|GACATCATCG|1700|
|AGAAGGTGAT|GGCCCGCTCC|CTCTCCCCAC|CCCCGGAGCT|GGAAGAAAGG|1750|
|GATGTGGCCG|CATACTCGGC|CTCCTTGGAG|GATGTGAAGA|CAGCCGTCCT|1800|
|GGGGCTTCTG|GTCATCCTTC|AGACCAAGCT|GTACACCCTG|CCTGCAAGCC|1850|
|ACGCCACGCG|TGTGTATGAG|ATGCTGGTCA|GCCACATTCA|GCTCCACTAC|1900|
|AAGCACAGCT|ACACCCTGCC|AATCGCGAGC|AGCATCCGGC|TGCAGGCCTT|1950|
|TGACTTCCTG|TTGCTGCTGC|GGGCCGACTC|ACTGCACCGC|CTGGGCCTGC|2000|
|CCAACAAGGA|TGGAGTCGTG|CGGTTCAGCC|CCTACTGCGT|CTGCGACTAC|2050|
|ATGGAGCCAG|AGAGAGGCTC|TGAGAAGAAG|ACCAGCGGCC|CCTTTCTCC|2100|
|TCCCACAGGG|CCTCCTGGCC|CGGCGCCTGC|AGGCCCCGCC|GTGCGGCTGG|2150|
|GGTCCGTGCC|CTACTCCCTG|CTCTTCCGCG|TCCTGCTGCA|GTGCTTGAAG|2200|
|CAGGAGTCTG|ACTGGAAGGT|GCTGAAGCTG|GTTCGGGCA|GGCTGCCTGA|2250|
|GTCCCTGCGC|TATAAAGTGC|TCATCTTTAC|TTCCCCTTGC|AGTGTGGACC|2300|
|AGCTGTGCTC|TGCTCTCTGC|TCCATGCTTT|CAGGCCCAAA|GACACTGGAG|2350|
|CGGCTCCGAG|GCGCCCCAGA|AGGCTTCTCC|AGAACTGACT|TGCACCTGGC|2400|
|CGTGGTTCCA|GTGCTGACAG|CATTAATCTC|TTACCATAAC|TACCTGGACA|2450|
|AAACCAAACA|GCGCGAGATG|GTCTACTGCC|TGGAGCAGGG|CCTCATCCAC|2500|

FIG. 76B

```
CGCTGTGCCA GCCAGTGCGT CGTGGCCTTG TCCATCTGCA GCGTGGAGAT 2550
GCCTGACATC ATCATCAAGG CGCTGCCTGT TCTGGTGGTG AAGCTCACGC 2600
ACATCTCAGC CACAGCCAGC ATGGCCGTCC CACTGCTGGA GTTCCTGTCC 2650
ACTCTGGCCA GGCTGCCGCA CCTCTACAGG AACTTTGCCG CGGAGCAGTA 2700
TGCCAGTGTG TTCGCCATCT CCCTGCCGTA CACCAACCCC TCCAAGTTTA 2750
ATCAGTACAT CGTGTGTCTG GCCCATCACG TCATAGCCAT GTGGTTCATC 2800
AGGTGCCGCC TGCCCTTCCG GAAGGATTTT GTCCCTTTCA TCACTAAGGG 2850
CCTGCGGTCC AATGTCCTCT TGTCTTTTGA TGACACCCCC GAGAAGGACA 2900
GCTTCAGGGC CCGGAGTACT AGTCTCAACG AGAGACCCAA GAGGATACAG 2950
ACGTCCCTCA CCAGTGCCAG CTTGGGGTCT GCAGATGAGA ACTCCGTGGC 3000
CCAGGCTGAC GATAGCCTGA AAAACCTCCA CCTGGAGCTC ACGGAAACCT 3050
GTCTGGACAT GATGGCTCGA TACGTCTTCT CCAACTTCAC GGCTGTCCCG 3100
AAGAGGTCTC CTGTGGGCGA GTTCCTCCTA GCGGGTGGCA GGACCAAAAC 3150
CTGGCTGGTT GGGAACAAGC TTGTCACTGT GACGACAAGC GTGGGAACCG 3200
GGACCCGGTC GTTACTAGGC CTGGACTCGG GGGAGCTGCA GTCCGGCCCG 3250
GAGTCGAGCT CCAGCCCCGG GGTGCATGTG AGACAGACCA AGGAGGCGCC 3300
GGCCAAGCTG GAGTCCCAGG CTGGGCAGCA GGTGTCCCGT GGGGCCCGGG 3350
ATCGGGTCCG TTCCATGTCG GGGGGCCATG GTCTTCGAGT TGGCGCCCTG 3400
GACGTGCCGG CCTCCCAGTT CCTGGGCAGT GCCACTTCTC CAGGACCACG 3450
GACTGCACCA GCCGCGAAAC CTGAGAAGGC CTCAGCTGGC ACCCGGGTTC 3500
CTGTGCAGGA GAAGACGAAC CTGGCGGCCT ATGTGCCCCT GCTGACCCAG 3550
GGCTGGGCGG AGATCCTGGT CCGGAGGCCC ACAGGGAACA CCAGCTGGCT 3600
GATGAGCCTG GAGAACCCGC TCAGCCCTTT CTCCTCGGAC ATCAACAACA 3650
TGCCCCTGCA GGAGCTGTCT AACGCCCTCA TGGCGGCTGA GCGCTTCAAG 3700
GAGCACCGGG ACACAGCCCT GTACAAGTCA CTGTCGGTGC CGGCAGCCAG 3750
CACGGCCAAA CCCCCTCCTC TGCCTCGCTC CAACACAGAC TCCGCCGTGG 3800
TCATGGAGGA GGGAAGTCCG GGCGAGGTTC CTGTGCTGGT GGAGCCCCCA 3850
GGGTTGGAGG ACGTTGAGGC AGCGCTAGGC ATGGACAGGC GCACGGATGC 3900
CTACAGCAGG TCGTCCTCAG TCTCCAGCCA GGAGGAGAAG TCGCTCCACG 3950
CGGAGGAGCT GGTTGGCAGG GGCATCCCCA TCGAGCGAGT CGTCTCCTCG 4000
GAGGGTGGCC GGCCCTCTGT GGACCTCTCC TTCCAGCCCT CGCAGCCCCT 4050
GAGCAAGTCC AGCTCCTCTC CCGAGCTGCA GACTCTGCAG GACATCCTCG 4100
GGGACCCTGG GGACAAGGCC GACGTGGGCC GGCTGAGCCC TGAGGTTAAG 4150
GCCCGGTCAC AGTCAGGGAC CCTGGACGGG GAAAGTGCTG CCTGGTCGGC 4200
CTCGGGCGAA GACAGTCGGG GCCAGCCCGA GGGTCCCTTG CCTTCCAGCT 4250
CCCCCCGCTC GCCCAGTGGC CTCCGGCCCC GAGGTTACAC CATCTCCGAC 4300
TCGGCCCCAT CACGCAGGGG CAAGAGAGTA GAGAGGGACG CCTTAAAGAG 4350
CAGAGCCACA GCCTCCAATG CAGAGAAAGT GCCAGGCATC AACCCCAGTT 4400
TCGTGTTCCT GCAGCTCTAC CATTCCCCCT TCTTTGGCGA CGAGTCAAAC 4450
AAGCCAATCC TGCTGCCCAA TGAGTCACAG TCCTTTGAGC GGTCGGTGCA 4500
GCTCCTCGAC CAGATCCCAT CATACGACAC CCACAAGATC GCCGTCCTGT 4550
ATGTTGGAGA AGGCCAGAGC AACAGCGAGC TCGCCATCCT GTCCAATGAG 4600
CATGGCTCCT ACAGGTACAC GGAGTTCCTG ACGGGCCTGG GCCGGCTCAT 4650
CGAGCTGAAG GACTGCCAGC CGGACAAGGT GTACCTGGGA GGCCTGGACG 4700
TGTGTGGTGA GGACGGCCAG TTCACCTACT GCTGGCACGA TGACATCATG 4750
CAAGCCGTCT TCCACATCGC CACCCTGATG CCCACCAAGG ACGTGGACAA 4800
GCACCGCTGC GACAAGAAGC GCCACCTGGG CAACGACTTT GTGTCCATTG 4850
TCTACAATGA CTCCGGTGAG GACTTCAAGC TTGGCACCAT CAAGGGCCAG 4900
TTCAACTTTG TCCACGTGAT CGTCACCCCG CTGGACTACG AGTGCAACCT 4950
GGTGTCCCTG CAGTGCAGGA AAGACATGGA GGGCCTTGTG GACACCAGCG 5000
```

FIG. 76C

```
TGGCCAAGAT CGTGTCTGAC CGCAACCTGC CCTTCGTGGC CCGCCAGATG   5050
GCCCTGCACG CAAATATGGC CTCACAGGTG CATCATAGCC GCTCCAACCC   5100
CACCGATATC TACCCCTCCA AGTGGATTGC CCGGCTCCGC CACATCAAGC   5150
GGCTCCGCCA GCGGATCTGC GAGGAAGCCG CCTACTCCAA CCCCAGCCTA   5200
CCTCTGGTGC ACCCTCCGTC CCATAGCAAA GCCCCTGCAC AGACTCCAGC   5250
CGAGCCCACA CCTGGCTATG AGGTGGGCCA GCGGAAGCGC CTCATCTCCT   5300
CGGTGGAGGA CTTCACCGAG TTTGTGTGAG GCCGGGGCCC TCCCTCCTGC   5350
ACTGGCCTTG GACGGTATTG CCTGTCAGTG AAATAAATAA AGTCCTGACC   5400
CCAGTGCACA GACATAGAGG CACAGATTGC Aaaaaaaaaa aaaaaaaaaa   5450
aaaaaaaaaa aaaaaaaaaa aaaa (SEQ ID NO: 79)
```

FIG. 77

```
MAKPTSKDSGLKEKFKILLGLGTPRPNPRSAEGKQTEFIITAEILRELSMECGLNNRIRM
IGQICEVAKTKKFEEHAVEALWKAVADLLQPERPLEARHAVLALLKAIVQGQGERLGVLR
ALFFKVIKDYPSNEDLHERLEVFKALTDNGRHITYLEEELADFVLQWMDVGLSSEFLLVL
VNLVKFNSCYLDEYIARMVQMICLLCVRTASSVDIEVSLQVLDAVVCYNCLPAESLPLFI
VTLCRTINVKELCEPCWKLMRNLLGTHLGHSAIYNMCHLMEDRAYMEDAPLLRGAVFFVG
MALWGAHRLYSLRNSPTSVLPSFYQAMACPNEVVSYEIVLSITRLIKKYRKELQVVAWDI
LLNIIERLLQQLQTLDSPELRTIVHDLLTTVEELCDQNEFHGSQERYFELVERCADQRPE
SSLLNLISYRAQSIHPAKDGWIQNLQALMERFFRSESRGAVRIKVLDVLSFVLLINRQFY
EEELINSVVISQLSHIPEDKDHQVRKLATQLLVDLAEGCHTHHFNSLLDIIEKVMARSLS
PPPELEERDVAAYSASLEDVKTAVLGLLVILQTKLYTLPASHATRVYEMLVSHIQLHYKH
SYTLPIASSIRLQAFDFLLLLRADSLHRLGLPNKDGVVRFSPYCVCDYMEPERGSEKKTS
GPLSPPTGPPGPAPAGPAVRLGSVPYSLLFRVLLQCLKQESDWKVLKLVLGRLPESLRYK
VLIFTSPCSVDQLCSALCSMLSGPKTLERLRGAPEGFSRTDLHLAVVPVLTALISYHNYL
DKTKQREMVYCLEQGLIHRCASQCVVALSICSVEMPDIIIKALPVLVVKLTHISATASMA
VPLLEFLSTLARLPHLYRNFAAEQYASVFAISLPYTNPSKFNQYIVCLAHHVIAMWFIRC
RLPFRKDFVPFITKGLRSNVLLSFDDTPEKDSFRARSTSLNERPKRIQTSLTSASLGSAD
ENSVAQADDSLKNLHLELTETCLDMMARYVFSNFTAVPKRSPVGEFLLAGGRTKTWLVGN
KLVTVTTSVGTGTRSLLGLDSGELQSGPESSSSPGVHVRQTKEAPAKLESQAGQQVSRGA
RDRVRSMSGGHGLRVGALDVPASQFLGSATSPGPRTAPAAKPEKASAGTRVPVQEKTNLA
AYVPLLTQGWAEILVRRPTGNTSWLMSLENPLSPFSSDINNMPLQELSNALMAAERFKEH
RDTALYKSLSVPAASTAKPPPLPRSNTDSAVVMEEGSPGEVPVLVEPPGLEDVEAALGMD
RRTDAYSRSSSVSSQEEKSLHAEELVGRGIPIERVVSSEGGRPSVDLSFQPSQPLSKSSS
SPELQTLQDILGDPGDKADVGRLSPEVKARSQSGTLDGESAAWSASGEDSRGQPEGPLPS
SSPRSPSGLRPRGYTISDSAPSRRGKRVERDALKSRATASNAEKVPGINPSFVFLQLYHS
PFFGDESNKPILLPNESQSFERSVQLLDQIPSYDTHKIAVLYVGEGQSNSELAILSNEHG
SYRYTEFLTGLGRLIELKDCQPDKVYLGGLDVCGEDGQFTYCWHDDIMQAVFHIATLMPT
KDVDKHRCDKKRHLGNDFVSIVYNDSGEDFKLGTIKGQFNFVHVIVTPLDYECNLVSLQC
RKDMEGLVDTSVAKIVSDRNLPFVARQMALHANMASQVHHSRSNPTDIYPSKWIARLRHI
KRLRQRICEEAAYSNPSLPLVHPPSHSKAPAQTPAEPTPGYEVGQRKRLISSVEDFTEFV
- (SEQ ID NO: 80)
```

FIG. 78A

```
CTGCGGGGCG CTGTTGCTGT GGCTGAGATT TGGCCGCCGC CTCCCCCACC   50
CGGCCTGCGC CCTCCCTCTC CCTCGGCGCC CGCCCGCCCG CTCGCGGCCC  100
GCGCTCGCTC CTCTCCCTCG CAGCCGGCAG GGCCCCCGAC CCCCGTCCGG  150
GCCCTCGCCG GCCCGGCCGC CCGTGCCCGG GGCTGTTTTC GCGAGCAGGT  200
GAAAATGGCT GAGAACTTGC TGGACGGACC GCCCAACCCC AAAAGAGCCA  250
AACTCAGCTC GCCCGGTTTC TCGGCGAATG ACAGCACAGA TTTTGGATCA  300
TTGTTTGACT TGGAAAATGA TCTTCCTGAT GAGCTGATAC CCAATGGAGG  350
AGAATTAGGC CTTTTAAACA GTGGGAACCT TGTTCCAGAT GCTGCTTCCA  400
AACATAAACA ACTGTCGGAG CTTCTACGAG GAGGCAGCGG CTCTAGTATC  450
AACCCAGGAA TAGGAAATGT GAGCGCCAGC AGCCCCGTGC AGCAGGGCCT  500
GGGTGGCCAG GCTCAAGGGC AGCCGAACAG TGCTAACATG GCCAGCCTCA  550
GTGCCATGGG CAAGAGCCCT CTGAGCCAGG GAGATTCTTC AGCCCCCAGC  600
CTGCCTAAAC AGGCAGCCAG CACCTCTGGG CCCACCCCCG CTGCCTCCCA  650
AGCACTGAAT CCGCAAGCAC AAAAGCAAGT GGGGCTGGCG ACTAGCAGCC  700
CTGCCACGTC ACAGACTGGA CCTGGTATCT GCATGAATGC TAACTTTAAC  750
CAGACCCACC CAGGCCTCCT CAATAGTAAC TCTGGCCATA GCTTAATTAA  800
TCAGGCTTCA CAAGGGCAGG CGCAAGTCAT GAATGGATCT CTTGGGGCTG  850
CTGGCAGAGG AAGGGGAGCT GGAATGCCGT ACCCTACTCC AGCCATGCAG  900
GGCGCCTCGA GCAGCGTGCT GGCTGAGACC CTAACGCAGG TTTCCCCGCA  950
AATGACTGGT CACGCGGGAC TGAACACCGC ACAGGCAGGA GGCATGGCCA 1000
AGATGGGAAT AACTGGGAAC ACAAGTCCAT TTGGACAGCC CTTTAGTCAA 1050
GCTGGAGGGC AGCCAATGGG AGCCACTGGA GTGAACCCCC AGTTAGCCAG 1100
CAAACAGAGC ATGGTCAACA GTTGCCCAC CTTCCCTACA GATATCAAGA 1150
ATACTTCAGT CACCAACGTG CCAAATATGT CTCAGATGCA AACATCAGTG 1200
GGAATTGTAC CCACACAAGC AATTGCAACA GGCCCCACTG CAGATCCTGA 1250
AAAACGCAAA CTGATACAGC AGCAGCTGGT TCTACTGCTT CATGCTCATA 1300
AGTGTCAGAG ACGAGAGCAA GCAAACGGAG AGGTTCGGGC CTGCTCGCTC 1350
CCGCATTGTC GAACCATGAA AAACGTTTTG AATCACATGA CGCATTGTCA 1400
GGCTGGGAAA GCCTGCCAAG TTGCCCATTG TGCATCTTCA CGACAAATCA 1450
TCTCTCATTG GAAGAACTGC ACACGACATG ACTGTCCTGT TGCCTCCCT  1500
TTGAAAAATG CCAGTGACAA GCGAAACCAA CAAACCATCC TGGGGTCTCC 1550
AGCTAGTGGA ATTCAAAACA CAATTGGTTC TGTTGGCACA GGGCAACAGA 1600
ATGCCACTTC TTTAAGTAAC CCAAATCCCA TAGACCCCAG CTCCATGCAG 1650
CGAGCCTATG CTGCTCTCGG ACTCCCCTAC ATGAACCAGC CCCAGACGCA 1700
GCTGCAGCCT CAGGTTCCTG GCCAGCAACC AGCACAGCCT CAAACCCACC 1750
AGCAGATGAG GACTCTCAAC CCCCTGGGAA ATAATCCAAT GAACATTCCA 1800
GCAGGAGGAA TAACAACAGA TCAGCAGCCC CCAAACTTGA TTTCAGAATC 1850
AGCTCTTCCG ACTTCCCTGG GGGCCACAAA CCCACTGATG AACGATGGCT 1900
CCAACTCTGG TAACATTGGA ACCCTCAGCA CTATACCAAC AGCAGCTCCT 1950
CCTTCTAGCA CCGGTGTAAG GAAAGGCTGG CACGAACATG TCACTCAGGA 2000
CCTGCGGAGC CATCTAGTGC ATAAACTCGT CCAAGCCATC TTCCCAACAC 2050
CTGATCCCGC AGCTCTAAAG GATCGCCGCA TGGAAAACCT GGTAGCCTAT 2100
GCTAAGAAAG TGGAAGGGGA CATGTACGAG TCTGCCAACA GCAGGGATGA 2150
ATATTATCAC TTATTAGCAG AGAAAATCTA CAAGATACAA AAAGAACTAG 2200
AAGAAAAACG GAGGTCGCGT TTACATAAAC AAGGCATCTT GGGGAACCAG 2250
CCAGCCTTAC CAGCCCCGGG GGCTCAGCCC CCTGTGATTC CACAGGCACA 2300
ACCTGTGAGA CCTCCAAATG GACCCTGTC CCTGCCAGTG AATCGCATGC 2350
AAGTTTCTCA AGGGATGAAT TCATTTAACC CCATGTCCTT GGGGAACGTC 2400
CAGTTGCCAC AAGCACCCAT GGGACCTCGT GCAGCCTCCC CAATGAACCA 2450
CTCTGTCCAG ATGAACAGCA TGGGCTCAGT GCCAGGGATG GCCATTTCTC 2500
```

FIG. 78B

```
CTTCCCGAAT GCCTCAGCCT CCGAACATGA TGGGTGCACA CACCAACAAC 2550
ATGATGGCCC AGGCGCCCGC TCAGAGCCAG TTTCTGCCAC AGAACCAGTT 2600
CCCGTCATCC AGCGGGGCGA TGAGTGTGGG CATGGGGCAG CCGCCAGCCC 2650
AAACAGGCGT GTCACAGGGA CAGGTGCCTG GTGCTGCTCT TCCTAACCCT 2700
CTCAACATGC TGGGGCCTCA GGCCAGCCAG CTACCTTGCC CTCCAGTGAC 2750
ACAGTCACCA CTGCACCCAA CACCGCCTCC TGCTTCCACG GCTGCTGGCA 2800
TGCCATCTCT CCAGCACACG ACACCACCTG GGATGACTCC TCCCCAGCCA 2850
GCAGCTCCCA CTCAGCCATC AACTCCTGTG TCGTCTTCCG GGCAGACTCC 2900
CACCCCGACT CCTGGCTCAG TGCCCAGTGC TACCCAAACC CAGAGCACCC 2950
CTACAGTCCA GGCAGCAGCC CAGGCCCAGG TGACCCCGCA GCCTCAAACC 3000
CCAGTTCAGC CCCCGTCTGT GGCTACCCCT CAGTCATCGC AGCAACAGCC 3050
GACGCCTGTG CACGCCCAGC CTCCTGGCAC ACCGCTTTCC CAGGCAGCAG 3100
CCAGCATTGA TAACAGAGTC CCTACCCCCT CCTCGGTGGC CAGCGCAGAA 3150
ACCAATTCCC AGCAGCCAGG ACCTGACGTA CCTGTGCTGG AAATGAAGAC 3200
GGAGACCCAA GCAGAGGACA CTGAGCCCGA TCCTGGTGAA TCCAAAGGGG 3250
AGCCCAGGTC TGAGATGATG GAGGAGGATT TGCAAGGAGC TTCCCAAGTT 3300
AAAGAAGAAA CAGACATAGC AGAGCAGAAA TCAGAACCAA TGGAAGTGGA 3350
TGAAAAGAAA CCTGAAGTGA AGTAGAAGT TAAAGAGGAA GAAGAGAGTA 3400
GCAGTAACGG CACAGCCTCT CAGTCAACAT CTCCTTCGCA GCCGCGCAAA 3450
AAAATCTTTA AACCAGAGGA GTTACGCCAG GCCCTCATGC CAACCCTAGA 3500
AGCACTGTAT CGACAGGACC CAGAGTCATT ACCTTTCCGG CAGCCTGTAG 3550
ATCCCCAGCT CCTCGGAATT CCAGACTATT TTGACATCGT AAAGAATCCC 3600
ATGGACCTCT CCACCATCAA GCGGAAGCTG GACACAGGGC AATACCAAGA 3650
GCCCTGGCAG TACGTGGACG ACGTCTGGCT CATGTTCAAC AATGCCTGGC 3700
TCTATAATCG CAAGACATCC CGAGTCTATA AGTTTTGCAG TAAGCTTGCA 3750
GAGGTCTTTG AGCAGGAAAT TGACCCTGTC ATGCAGTCCC TTGGATATTG 3800
CTGTGGACGC AAGTATGAGT TTTCCCCACA GACTTTGTGC TGCTATGGGA 3850
AGCAGCTGTG TACCATTCCT CGCGATGCTG CCTACTACAG CTATCAGAAT 3900
AGGTATCATT TCTGTGAGAA GTGTTCACA GAGATCCAGG GCGAGAATGT 3950
GACCCTGGGT GACGACCCTT CACAGCCCCA GACGACAATT TCAAAGGATC 4000
AGTTTGAAAA GAAGAAAAT GATACCTTAG ACCCCGAACC TTTCGTTGAT 4050
TGCAAGGAGT GTGGCCGGAA GATGCATCAG ATTTGCGTTC TGCACTATGA 4100
CATCATTTGG CCTTCAGGTT TTGTGTGCGA CAACTGCTTG AAGAAAACTG 4150
GCAGACCTCG AAAAGAAAAC AAATTCAGTG CTAAGAGGCT GCAGACCACA 4200
AGACTGGGAA ACCACTTGGA AGACCGAGTG AACAAATTTT TGCGGCGCCA 4250
GAATCACCCT GAAGCCGGGG AGGTTTTTGT CCGAGTGGTG GCCAGCTCAG 4300
ACAAGACGGT GGAGGTCAAG CCCGGGATGA AGTCACGGTT TGTGGATTCT 4350
GGGGAAATGT CTGAATCTTT CCCATATCGA ACCAAAGCTC TGTTTGCTTT 4400
TGAGGAAATT GACGGCGTGG ATGTCTGCTT TTTTGGAATG CACGTCCAAG 4450
AATACGGCTC TGATTGCCCC CCTCCAAACA CGAGGCGTGT GTACATTTCT 4500
TATCTGGATA GTATTCATTT CTTCCGGCCA CGTTGCCTCC GCACAGCCGT 4550
TTACCATGAG ATCCTTATTG GATATTTAGA GTATGTGAAG AAATTAGGGT 4600
ATGTGACAGG GCACATCTGG GCCTGTCCTC CAAGTGAAGG AGATGATTAC 4650
ATCTTCCATT GCCACCCACC TGATCAAAAA ATACCCAAGC CAAAACGACT 4700
GCAGGAGTGG TACAAAAAGA TGCTGGACAA GGCGTTTGCA GAGCGGATCA 4750
TCCATGACTA CAAGGATATT TTCAAACAAG CAACTGAAGA CAGGCTCACC 4800
AGTGCCAAGG AACTGCCCTA TTTTGAAGGT GATTTCTGGC CAATGTGTT 4850
AGAAGAGAGC ATTAAGGAAC TAGAACAAGA AGAAGAGGAG AGGAAAAAGG 4900
AAGAGAGCAC TGCAGCCAGT GAAACCACTG AGGGCAGTCA GGGCGACAGC 4950
AAGAATGCCA AGAAGAAGAA CAACAAGAAA ACCAACAAGA ACAAAAGCAG 5000
```

FIG. 78C

```
CATCAGCCGC GCCAACAAGA AGAAGCCCAG CATGCCCAAC GTGTCCAATG 5050
ACCTGTCCCA GAAGCTGTAT GCCACCATGG AGAAGCACAA GGAGGTCTTC 5100
TTCGTGATCC ACCTGCACGC TGGGCCTGTC ATCAACACCC TGCCCCCCAT 5150
CGTCGACCCC GACCCCCTGC TCAGCTGTGA CCTCATGGAT GGGCGCGACG 5200
CCTTCCTCAC CCTCGCCAGA GACAAGCACT GGGAGTTCTC CTCCTTGCGC 5250
CGCTCCAAGT GGTCCACGCT CTGCATGCTG GTGGAGCTGC ACACCCAGGG 5300
CCAGGACCGC TTTGTCTACA CCTGCAACGA GTGCAAGCAC CACGTGGAGA 5350
CGCGCTGGCA CTGCACTGTG TGCGAGGACT ACGACCTCTG CATCAACTGC 5400
TATAACACGA AGAGCCATGC CCATAAGATG GTGAAGTGGG GCTGGGCCT 5450
GGATGACGAG GGCAGCAGCC AGGGCGAGCC ACAGTCAAAG AGCCCCCAGG 5500
AGTCACGCCG GCTGAGCATC CAGCGCTGCA TCCAGTCGCT GGTGCACGCG 5550
TGCCAGTGCC GCAACGCCAA CTGCTCGCTG CCATCCTGCC AGAAGATGAA 5600
GCGGGTGGTG CAGCACACCA AGGGCTGCAA ACGCAAGACC AACGGGGCT 5650
GCCCGGTGTG CAAGCAGCTC ATCGCCCTCT GCTGCTACCA CGCCAAGCAC 5700
TGCCAAGAAA ACAAATGCCC CGTGCCCTTC TGCCTCAACA TCAAACACAA 5750
GCTCCGCCAG CAGCAGATCC AGCACCGCCT GCAGCAGGCC CAGCTCATGC 5800
GCCGGCGGAT GGCCACCATG AACACCCGCA ACGTGCCTCA GCAGAGTCTG 5850
CCTTCTCCTA CCTCAGCACC GCCCGGGACC CCCACACAGC AGCCCAGCAC 5900
ACCCCAGACG CCGCAGCCCC CTGCCCAGCC CCAACCCTCA CCCGTGAGCA 5950
TGTCACCAGC TGGCTTCCCC AGCGTGGCCC GGACTCAGCC CCCCACCACG 6000
GTGTCCACAG GGAAGCCTAC CAGCCAGGTG CCGGCCCCCC CACCCCCGGC 6050
CCAGCCCCCT CCTGCAGCGG TGGAAGCGGC TCGGCAGATC GAGCGTGAGG 6100
CCCAGCAGCA GCAGCACCTG TACCGGGTGA ACATCAACAA CAGCATGCCC 6150
CCAGGACGCA CGGGCATGGG GACCCCGGGG AGCCAGATGG CCCCCGTGAG 6200
CCTGAATGTG CCCCGACCCA ACCAGGTGAG CGGGCCCGTC ATGCCCAGCA 6250
TGCCTCCCGG GCAGTGGCAG CAGGCGCCCC TTCCCCAGCA GCAGCCCATG 6300
CCAGGCTTGC CCAGGCCTGT GATATCCATG CAGGCCCAGG CGGCCGTGGC 6350
TGGGCCCCGG ATGCCCAGCG TGCAGCCACC CAGGAGCATC TCACCCAGCG 6400
CTCTGCAAGA CCTGCTGCGG ACCCTGAAGT CGCCCAGCTC CCCTCAGCAG 6450
CAACAGCAGG TGCTGAACAT TCTCAAATCA AACCCGCAGC TAATGGCAGC 6500
TTTCATCAAA CAGCGCACAG CCAAGTACGT GGCCAATCAG CCCGGCATGC 6550
AGCCCCAGCC TGGCCTCCAG TCCCAGCCCG GCATGCAACC CCAGCCTGGC 6600
ATGCACCAGC AGCCCAGCCT GCAGAACCTG AATGCCATGC AGGCTGGCGT 6650
GCCGCGGCCC GGTGTGCCTC CACAGCAGCA GGCGATGGGA GGCCTGAACC 6700
CCCAGGGCCA GGCCTTGAAC ATCATGAACC CAGGACACAA CCCCAACATG 6750
GCGAGTATGA ATCCACAGTA CCGAGAAATG TTACGGAGGC AGCTGCTGCA 6800
GCAGCAGCAG CAACAGCAGC AGCAACAACA GCAGCAACAG CAGCAGCAGC 6850
AAGGGAGTGC CGGCATGGCT GGGGGCATGG CGGGGCACGG CCAGTTCCAG 6900
CAGCCTCAAG GACCCGGAGG CTACCCACCG GCCATGCAGC AGCAGCAGCG 6950
CATGCAGCAG CATCTCCCCC TCCAGGGCAG CTCCATGGGC CAGATGGCGG 7000
CTCAGATGGG ACAGCTTGGC CAGATGGGGC AGCCGGGGCT GGGGGCAGAC 7050
AGCACCCCCA ACATCCAGCA AGCCCTGCAG CAGCGGATTC TGCAGCAACA 7100
GCAGATGAAG CAGCAGATTG GGTCCCCAGG CCAGCCGAAC CCCATGAGCC 7150
CCCAGCAACA CATGCTCTCA GGACAGCCAC AGGCCTCGCA TCTCCCTGGC 7200
CAGCAGATCG CCACGTCCCT TAGTAACCAG GTGCGGTCTC CAGCCCCTGT 7250
CCAGTCTCCA CGGCCCCAGT CCCAGCCTCC ACATTCCAGC CCGTCACCAC 7300
GGATACAGCC CCAGCCTTCG CCACACCACG TCTCACCCCA GACTGGTTCC 7350
CCCCACCCCG GACTCGCAGT CACCATGGCC AGCTCCATAG ATCAGGGACA 7400
CTTGGGGAAC CCCGAACAGA GTGCAATGCT CCCCCAGCTG AACACCCCCA 7450
GCAGGAGTGC GCTGTCCAGC GAACTGTCCC TGGTCGGGGA CACCACGGGG 7500
```

FIG. 78D

```
GACACGCTAG AGAAGTTTGT GGAGGGCTTG TAGCATTGTG AGAGCATCAC  7550
CTTTTCCCTT TCATGTTCTT GGACCTTTTG TACTGAAAAT CCAGGCATCT  7600
AGGTTCTTTT TATTCCTAGA TGGAACTGCG ACTTCCGAGC CATGGAAGGG  7650
TGGATTGATG TTTAAAGAAA CAATACAAAG AATATATTTT TTTGTTAAAA  7700
ACCAGTTGAT TTAAATATCT GGTCTCTCTC TTTGGTTTTT TTTTGGCGGG  7750
GGGGTGGGGG GGGTTCTTTT TTTTCCGTTT TGTTTTTGTT TGGGGGGAGG  7800
GGGGTTTTGT TTGGATTCTT TTTGTCGTCA TTGCTGGTGA CTCATGCCTT  7850
TTTTTAACGG GAAAAACAAG TTCATTATAT TCATATTTTT TATTTGTATT  7900
TTCAAGACTT TAAACATTTA TGTTTAAAAG TAAGAAGAAA AATAATATTC  7950
AGAACTGATT CCTGAAATAA TGCAAGCTTA TAATGTATCC CGATAACTTT  8000
GTGATGTTTC GGGAAGATTT TTTTCTATAG TGAACTCTGT GGGCGTCTCC  8050
CAGTATTACC CTGGATGATA GGAATTGACT CCGGCGTGCA CACACGTACA  8100
CACCCACACA CATCTATCTA TACATAATGG CTGAAGCCAA ACTTGTCTTG  8150
CAGATGTAGA AATTGTTGCT TTGTTTCTCT GATAAAACTG GTTTTAGACA  8200
AAAAATAGGG ATGATCACTC TTAGACCATG CTAATGTTAC TAGAGAAGAA  8250
GCCTTCTTTT CTTTCTTCTA TGTGAAACTT GAAATGAGGA AAAGCAATTC  8300
TAGTGTAAAT CATGCAAGCG CTCTAATTCC TATAAATACG AAACTCGAGA  8350
AGATTCAATC ACTGTATAGA ATGGTAAAAT ACCAACTCAT TTCTTATATC  8400
ATATTGTTAA ATAAACTGTG TGCAACAGAC AAAAAGGGTG GTCCTTCTTG  8450
AATTCATGTA CATGGTATTA ACACTTAGTG TTCGGGGTTT TTTGTTATGA  8500
AAATGCTGTT TTCAACATTG TATTTGGACT ATGCATGTGT TTTTTCCCCA  8550
TTGTATATAA AGTACCGCTT AAAATTGATA TAAATTACTG AGGTTTTTAA  8600
CATGTATTCT GTTCTTTAAG ATCCCTGTAA GAATGTTTAA GGTTTTTATT  8650
TATTTATATA TATTTTTTGA GTCTGTTCTT TGTAAGACAT GGTTCTGGTT  8700
GTTCGCTCAT AGCGGAGAGG CTGGGGCTGC GGTTGTGGTT GTGGCGGCGT  8750
GGGTGGTGGC TGGGAACTGT GGCCCAGGCT TAGCGGCCGC CCGGAGGCTT  8800
TTCTTCCCGG AGACTGAGGT GGGCGACTGA GGTGGGCGGC TCAGCGTTGG  8850
CCCCACACAT TCGAGGCTCA CAGGTGATTG TCGCTCACAC AGTTAGGGTC  8900
GTCAGTTGGT CTGAAACTGC ATTTGGCCCA CTCCTCCATC CTCCCTGTCC  8950
GTCGTAGCTG CCACCCCCAG AGGCGGCGCT TCTTCCCGTG TTCAGGCGGC  9000
TCCCCCCCCC CGTACACGAC TCCCAGAATC TGAGGCAGAG AGTGCTCCAG  9050
GCTCGCGAGG TGCTTTCTGA CTTCCCCCCA AATCCTGCCG CTGCCGCGCA  9100
GCATGTCCCG TGTGGCGTTT GAGGAAATGC TGAGGGACAG ACACCTTGGA  9150
GCACCAGCTC CGGTCCCTGT TACAGTGAGA AAGGTCCCCC ACTTCGGGGG  9200
ATACTTGCAC TTAGCCACAT GGTCCTGCCT CCCTTGGAGT CCAGTTCCAG  9250
GCTCCCTTAC TGAGTGGGTG AGACAAGTTC ACAAAAACCG TAAAACTGAG  9300
AGGAGGACCA TGGGCAGGGG AGCTGAAGTT CATCCCCTAA GTCTACCACC  9350
CCCAGCACCC AGAGAACCCA CTTTATCCCT AGTCCCCCAA CAAAGGCTGG  9400
TCTAGGTGGG GGTGATGGTA ATTTTAGAAA TCACGCCCCA AATAGCTTCC  9450
GTTTGGGCCC TTACATTCAC AGATAGGTTT TAAATAGCTG AATACTTGGT  9500
TTGGGAATCT GAATTCGAGG AACCTTTCTA AGAAGTTGGA AAGGTCCGAT  9550
CTAGTTTTAG CACAGAGCTT TGAACCTTGA GTTATAAAAT GCAGAATAAT  9600
TCAAGTAAAA ATAAGACCAC CATCTGGCAC CCTGACCAG CCCCCATTCA  9650
CCCCATCCCA GGAGGGGAAG CACAGGCCGG GCCTCCGGTG GAGATTGCTG  9700
CCACTGCTCG GCCTGCTGGG TTCTTAACCT CCAGTGTCCT CTTCATCTTT  9750
TCCACCCGTA GGGAAACCTT GAGCCATGTG TTCAAACAAG AAGTGGGGCT  9800
AGAGCCCGAG AGCAGCAGCT CTAAGCCCAC ACTCAGAAAG TGGCGCCCTC  9850
CTGGTTGTGC AGCCTTTTAA TGTGGGCAGT GGAGGGGCCT CTGTTTCAGG  9900
TTATCCTGGA ATTCAAAACG TTATGTACCA ACCTCATCCT CTTTGGAGTC  9950
TGCATCCTGT GCAACCGTCT TGGGCAATCC AGATGTCGAA GGATGTGACC  10000
```

FIG. 78E

```
GAGAGCATGG TCTGTGGATG CTAACCCTAA GTTTGTCGTA AGGAAATTTC  10050
TGTAAGAAAC CTGGAAAGCC CCAACGCTGT GTCTCATGCT GTATACTTAA  10100
GAGGAGAAGA AAAAGTCCTA TATTTGTGAT CAAAAAGAGG AAACTTGAAA  10150
TGTGATGGTG TTTATAATAA AAGATGGTAA AACTACTTGG ATTCAAa
(SEQ ID NO: 81)
```

FIG. 79

```
MAENLLDGPPNPKRAKLSSPGFSANDSTDFGSLFDLENDLPDELIPNGGELGLLNSGNLV
PDAASKHKQLSELLRGGSGSSINPGIGNVSASSPVQQGLGGQAQGQPNSANMASLSAMGK
SPLSQGDSSAPSLPKQAASTSGPTPAASQALNPQAQKQVGLATSSPATSQTGPGICMNAN
FNQTHPGLLNSNSGHSLINQASQGQAQVMNGSLGAAGRGRGAGMPYPTPAMQGASSSVLA
ETLTQVSPQMTGHAGLNTAQAGGMAKMGITGNTSPFGQPFSQAGGQPMGATGVNPQLASK
QSMVNSLPTFPTDIKNTSVTNVPNMSQMQTSVGIVPTQAIATGPTADPEKRKLIQQQLVL
LLHAHKCQRREQANGEVRACSLPHCRTMKNVLNHMTHCQAGKACQVAHCASSRQIISHWK
NCTRHDCPVCLPLKNASDKRNQQTILGSPASGIQNTIGSVGTGQQNATSLSNPNPIDPSS
MQRAYAALGLPYMNQPQTQLQPQVPGQQPAQPQTHQQMRTLNPLGNNPMNIPAGGITTDQ
QPPNLISESALPTSLGATNPLMNDGSNSGNIGTLSTIPTAAPPSSTGVRKGWHEHVTQDL
RSHLVHKLVQAIFPTPDPAALKDRRMENLVAYAKKVEGDMYESANSRDEYYHLLAEKIYK
IQKELEEKRRSRLHKQGILGNQPALPAPGAQPPVIPQAQPVRPPNGPLSLPVNRMQVSQG
MNSFNPMSLGNVQLPQAPMGPRAASPMNHSVQMNSMGSVPGMAISPSRMPQPPNMMGAHT
NNMMAQAPAQSQFLPQNQFPSSSGAMSVGMGQPPAQTGVSQGQVPGAALPNPLNMLGPQA
SQLPCPPVTQSPLHPTPPPASTAAGMPSLQHTTPPGMTPPQPAAPTQPSTPVSSSGQTPT
PTPGSVPSATQTQSTPTVQAAAQAQVTPQPQTPVQPPSVATPQSSQQQPTPVHAQPPGTP
LSQAAASIDNRVPTPSSVASAETNSQQPGPDVPVLEMKTETQAEDTEPDPGESKGEPRSE
MMEEDLQGASQVKEETDIAEQKSEPMEVDEKKPEVKVEVKEEEESSSNGTASQSTSPSQP
RKKIFKPEELRQALMPTLEALYRQDPESLPFRQPVDPQLLGIPDYFDIVKNPMDLSTIKR
KLDTGQYQEPWQYVDDVWLMFNNAWLYNRKTSRVYKFCSKLAEVFEQEIDPVMQSLGYCC
GRKYEFSPQTLCCYGKQLCTIPRDAAYYSYQNRYHFCEKCFTEIQGENVTLGDDPSQPQT
TISKDQFEKKKNDTLDPEPFVDCKECGRKMHQICVLHYDIIWPSGFVCDNCLKKTGRPRK
ENKFSAKRLQTTRLGNHLEDRVNKFLRRQNHPEAGEVFVRVVASSDKTVEVKPGMKSRFV
DSGEMSESFPYRTKALFAFEEIDGVDVCFFGMHVQEYGSDCPPPNTRRVYISYLDSIHFF
RPRCLRTAVYHEILIGYLEYVKKLGYVTGHIWACPPSEGDDYIFHCHPPDQKIPKPKRLQ
EWYKKMLDKAFAERIIHDYKDIFKQATEDRLTSAKELPYFEGDFWPNVLEESIKELEQEE
EERKKEESTAASETTEGSQGDSKNAKKKNNKKTNKNKSSISRANKKKPSMPNVSNDLSQK
LYATMEKHKEVFFVIHLHAGPVINTLPPIVDPDPLLSCDLMDGRDAFLTLARDKHWEFSS
LRRSKWSTLCMLVELHTQGQDRFVYTCNECKHHVETRWHCTVCEDYDLCINCYNTKSHAH
KMVKWGLGLDDEGSSQGEPQSKSPQESRRLSIQRCIQSLVHACQCRNANCSLPSCQKMKR
VVQHTKGCKRKTNGGCPVCKQLIALCCYHAKHCQENKCPVPFCLNIKHKLRQQQIQHRLQ
QAQLMRRRMATMNTRNVPQQSLPSPTSAPPGTPTQQPSTPQTPQPPAQPQPSPVSMSPAG
FPSVARTQPPTTVSTGKPTSQVPAPPPPAQPPPAAVEAARQIEREAQQQQHLYRVNINNS
MPPGRTGMGTPGSQMAPVSLNVPRPNQVSGPVMPSMPPGQWQQAPLPQQQPMPGLPRPVI
SMQAQAAVAGPRMPSVQPPRSISPSALQDLLRTLKSPSSPQQQQQVLNILKSNPQLMAAF
IKQRTAKYVANQPGMQPQPGLQSQPGMQPQPGMHQQPSLQNLNAMQAGVPRPGVPPQQQA
MGGLNPQGQALNIMNPGHNPNMASMNPQYREMLRRQLLQQQQQQQQQQQQQQQQQQGSAG
MAGGMAGHGQFQQPQGPGGYPPAMQQQQRMQQHLPLQGSSMGQMAAQMGQLGQMGQPGLG
ADSTPNIQQALQQRILQQQQMKQQIGSPGQPNPMSPQQHMLSGQPQASHLPGQQIATSLS
NQVRSPAPVQSPRPQSQPPHSSPSPRIQPQPSPHHVSPQTGSPHPGLAVTMASSIDQGHL
GNPEQSAMLPQLNTPSRSALSSELSLVGDTTGDTLEKFVEGL- (SEQ ID NO: 82)
```

FIG. 80A

```
atggagataagattagaaatcttgacatcaacaggtattaagcagaaaaaaccatggcca    60
 M  E  I  R  L  E  I  L  T  S  T  G  I  K  Q  K  K  P  W  P    20 cgtgtctcctggttgggaaaggaaaaagaagccgttttcttttggatgataaattcata   120
 R  V  S  W  L  G  K  E  K  E  A  V  F  L  L  D  D  K  F  I    40 aatgaaattaatttgctatcaggaaagataaagaagaaaattcctagtctgcagccttc   180
 N  E  I  N  L  L  S  G  K  I  K  K  K  I  P  S  L  Q  P  F    60 ttgaaggatgttattgtcctaacaacatccagtaatgatgcctggctggctggggtacta   240
 L  K  D  V  I  V  L  T  T  S  N  D  A  W  L  A  G  V  L       80 actacaggagagcttttcctttggaacaaagatcaagattgtttgaaaactataccaata   300
 T  T  G  E  L  F  L  W  N  K  D  Q  D  C  L  K  T  I  P  I   100 actgaaaagcctaaggaaatgatcaaagctacagtcgcaagctctttgagactgtacttg   360
 T  E  K  P  K  E  M  I  K  A  T  V  A  S  S  L  R  L  Y  L   120 tatgtatctggaaatgggaaaagaattgtgctcataacaccttctggatgcatatttctt   420
 Y  V  S  G  N  G  K  R  I  V  L  I  T  P  S  G  C  I  F  L   140 tgggaatatttggaattaaagaatatcttatcttctaaaagccttcattggcgggtcgg   480
 W  E  Y  L  E  L  K  N  I  L  S  S  K  S  L  S  L  A  G  R   160 tggtcccaggtcatacctgaagaagcagttctcttgccttccaccgaagataaagaagct   540
 W  S  Q  V  I  P  E  E  A  V  L  L  P  S  T  E  D  K  E  A   180 gtagtgaatgctgttttttataaaaaatgagttatttggagactgctgcctgtgttcattt   600
 V  V  N  A  V  F  I  K  N  E  L  F  G  D  C  C  L  C  S  F   200 acttttattctggggaatgcctgaagttaacatttctagcaattcggtggcatgagaat   660
 T  F  Y  S  G  E  C  L  K  L  T  F  L  A  I  R  W  H  E  N   220 gtatttacatctgtaagatcattgccataccatgttcattgggctcaacaagactgtcat   720
 V  F  T  S  V  R  S  L  P  Y  H  V  H  W  A  Q  Q  D  C  H   240 ctctgtagtttaattcctaaatgtgaatcagtaaagtcaagaggagctctaatttctgcc   780
 L  C  S  L  I  P  K  C  E  S  V  K  S  R  G  A  L  I  S  A   260 ttttcaagagatggccttaccctggcagtaactcttaatcagaaagaccccaaggcaact   840
 F  S  R  D  G  L  T  L  A  V  T  L  N  Q  K  D  P  K  A  T   280 caggtattatttataaacacactgaattttgttactctctgtggtagccttaaaggatgt   900
 Q  V  L  F  I  N  T  L  N  F  V  T  L  C  G  S  L  K  G  C   300 agtaacaagagtcccgtggttccagctacacttattaggtcctactgggtaggtgatatc   960
 S  N  K  S  P  V  V  P  A  T  L  I  R  S  Y  W  V  G  D  I   320 agctggacgcatgatagtctttttctggcttgtatgttaaaacgtggctctctggtttta  1020
 S  W  T  H  D  S  L  F  L  A  C  M  L  K  R  G  S  L  V  L   340
```

FIG. 80B

```
ttgacctgccaaggtgaattgctaacattaattacatttggttgctctatagaatttggc 1080
 L   T   C   Q   G   E   L   L   T   L   I   T   F   G   C   S   I   E   F   G      360 ccagcagaatttattcctcttcatccactaataacgtatagaccacagcagtttacgttt 1140
 P   A   E   F   I   P   L   H   P   L   I   T   Y   R   P   Q   Q   F   T   F      380 caagattcaaataattctgttgattcatcagcttctgatagtgaccctatgagacagaga 1200
 Q   D   S   N   N   S   V   D   S   S   A   S   D   S   D   P   M   R   Q   R      400 ttttctataaaagcacactcacggttaccctacctcgttatatctgatggatatatggtc 1260
 F   S   I   K   A   H   S   R   L   P   Y   L   V   I   S   D   G   Y   M   V      420 acaaccct tcgatttcttgatagcctatctccatcagtacacatgagatcacttctactt 1320
 T   T   L   R   F   L   D   S   L   S   P   S   V   H   M   R   S   L   L   L      440 gattcaacccagaggcttgagaaaatatatcaaagtgtgatattgtctaagccaaaaggc 1380
 D   S   T   Q   R   L   E   K   I   Y   Q   S   V   I   L   S   K   P   K   G      460 aaaggactgaacttgcgatcactgaattccctaaggtctagcctgttagaacaccaagga 1440
 K   G   L   N   L   R   S   L   N   S   L   R   S   S   L   L   E   H   Q   G      480 aatgaaagttcagccgatttcactgtccccaaattcttgcaggcagaagaaacaataaat 1500
 N   E   S   S   A   D   F   T   V   P   K   F   L   Q   A   E   E   T   I   N      500 gaaaatgcagcagattttcaggattttgaagcagaagaaactaacgaaggcagacacttt 1560
 E   N   A   A   D   F   Q   D   F   E   A   E   E   T   N   E   G   R   H   F      520 ccagacaacttatgtccttttggaacaaaagagatgatgtgctgtgtagtagtatgaag 1620
 P   D   N   L   C   P   F   W   N   K   R   D   D   V   L   C   S   S   M   K      540 gaaggaagattggaatttgcatctatgtttgatacgatacatgcaaaggatgatagtgag 1680
 E   G   R   L   E   F   A   S   M   F   D   T   I   H   A   K   D   D   S   E      560 gagacagatagaaccattacagaactgcattctatccagaaaagtctacttgcagcgtgg 1740
 E   T   D   R   T   I   T   E   L   H   S   I   Q   K   S   L   L   A   A   W      580 actataggaatttcaaaaactgtgacagaaaaaaatttaatgttaaattacatagtagtt 1800
 T   I   G   I   S   K   T   V   T   E   K   N   L   M   L   N   Y   I   V   V      600 tgtatcactcatttttttacattcttcaatttataaaatgtccttttcctaaacttgat 1860
 C   I   T   H   F   F   Y   I   L   Q   F   I   K   C   P   F   P   K   L   D      620 cttgttttaagcaaaagctcaagacataatgcatggatactttgtatctttcaactttt 1920
 L   V   L   S   K   S   S   R   H   N   A   W   I   L   C   I   F   Q   L   F      640 catcagtgtttatcaatccattattgggatataagatacaaacaagatgtggggcatttg 1980
 H   Q   C   L   S   I   H   Y   W   D   I   R   Y   K   Q   D   V   G   H   L      660 ataaagctgacctcaaatactgtaaaacttttgctgactcagcaacaaaagggtcagtta 2040
 I   K   L   T   S   N   T   V   K   L   L   L   T   Q   Q   Q   K   G   Q   L      680
```

FIG. 80C

```
ttctcagagaaacttttagcttgttttatttactcaaaatggtagctgacaatttaaat 2100
 F   S   E   K   L   L   A   C   F   Y   L   L   K   M   V   A   D   N   L   N     700 ggtgtatacattcttcaacctgaagttatttcagcatcagctgatggaagtaaaataaca 2160
 G   V   Y   I   L   Q   P   E   V   I   S   A   S   A   D   G   S   K   I   T     720 gctcaagactcattggtggtacctattttcagatgtttcaagatagtggttttcagaaa 2220
 A   Q   D   S   L   V   V   P   I   F   Q   M   F   Q   D   S   G   F   Q   K     740 aactggtcttggaactcattttcaagattcatcctcaagtagtaaatcctgtgcaacag 2280
 N   W   S   W   N   S   F   F   K   I   H   P   Q   V   V   N   P   V   Q   Q     760 ccaggacacagattgcttattctctggagaatactgtacaaaaaactttatggtatcaa 2340
 P   G   H   R   L   L   I   L   W   R   I   L   Y   K   K   T   L   W   Y   Q     780 gcacaattaaatcgaagagttcctgaagctgatagtcagttaactgaaaagatgacacat 2400
 A   Q   L   N   R   R   V   P   E   A   D   S   Q   L   T   E   K   M   T   H     800 gaagcatctactgtcaagtccctgttatgtcatttgcaggctaacctacagagtactgga 2460
 E   A   S   T   V   K   S   L   L   C   H   L   Q   A   N   L   Q   S   T   G     820 gattgcttgaatcaaaccttagaacttaaatctatcaatggggaagaatgtttttatta 2520
 D   C   L   N   Q   T   L   E   L   K   S   I   N   G   E   E   C   F   L   L     840 ggatcatatgaaaagtctgttcagctgtggaaaaaagctctacaagaaatcgaagagaaa 2580
 G   S   Y   E   K   S   V   Q   L   W   K   K   A   L   Q   E   I   E   E   K     860 ggaggaagaaggacgtattttcttcagatacgctattatctttctctcttatactgccac 2640
 G   G   R   R   T   Y   F   L   Q   I   R   Y   Y   L   S   L   L   Y   C   H     880 ctctatagctataatttaaatgatgctcaaggattgtgtgatcagctagcaagagaaatc 2700
 L   Y   S   Y   N   L   N   D   A   Q   G   L   C   D   Q   L   A   R   E   I     900 ctgagatggtcccaactacctgtaaaagaaaataaagattttcaggtgctgcaaagtct 2760
 L   R   W   S   Q   L   P   V   K   E   N   K   D   F   S   G   A   A   K   S     920 catttgagtgtggaatggtgggcggtgttcatcctgaggcagcagtgagagtcgtccag 2820
 H   F   E   C   G   M   V   G   G   V   H   P   E   A   A   V   R   V   V   Q     940 tccatggctcgtttcatggctgcctattcaccaatcagcagctttgcattttgccccct 2880
 S   M   A   R   F   M   A   A   Y   F   T   N   Q   Q   L   C   I   L   P   P     960 catcatgtgaatgttcttcccccacttcatattaaaacagagcagtcctttcgacttatt 2940
 H   H   V   N   V   L   P   P   L   H   I   K   T   E   Q   S   F   R   L   I     980 cctctgcaacactctaaggtggccagtgttgttagagatcagaatctctctaatgtgtgg 3000
 P   L   Q   H   S   K   V   A   S   V   V   R   D   Q   N   L   S   N   V   W    1000 acagttgaatatgcacttgaattactatttattggtggcctggttccagaggctgtgtgg 3060
 T   V   E   Y   A   L   E   L   L   F   I   G   G   L   V   P   E   A   V   W    1020
```

FIG. 80D

```
ttggcatataaacttggagactggaagacgtctgtttcaattggtgtggcttttccagctg 3120
 L  A  Y  K  L  G  D  W  K  T  S  V  S  I  G  V  A  F  Q  L  1040 ttctgtaaacgtgatagcaatttcatgaggtccaagaaaaagagtctgaatctaccactc 3180
 F  C  K  R  D  S  N  F  M  R  S  K  K  K  S  L  N  L  P  L  1060 cgtatgactccagcacagattttcaggaaaaactgcagtgtgttttaggtcaaccagcc 3240
 R  M  T  P  A  Q  I  F  Q  E  K  L  Q  C  V  L  G  Q  P  A  1080 tctttggaagcaaaaaatgaaatgggctcaaaatataaacagtttacagatcccattgaa 3300
 S  L  E  A  K  N  E  M  G  S  K  Y  K  Q  F  T  D  P  I  E  1100 gaggaagatgcaaatctgctatttggttcagtacaagaagtactgaaagcatcagttatg 3360
 E  E  D  A  N  L  L  F  G  S  V  Q  E  V  L  K  A  S  V  M  1120 gccgatgcagatattctttcggagacatttcaacttctgatagactctgccaaggacttc 3420
 A  D  A  D  I  L  S  E  T  F  Q  L  L  I  D  S  A  K  D  F  1140 agtaaaagactgtggggcttagtgccattcggcttgtatcttccagctcctccattgtac 3480
 S  K  R  L  W  G  L  V  P  F  G  L  Y  L  P  A  P  P  L  Y  1160 tgtccccagccagctattcttagtgaagaagatggtgatgatcttcttttaaaagctgaa 3540
 C  P  Q  P  A  I  L  S  E  E  D  G  D  D  L  L  L  K  A  E  1180 aaaaataatcgccagaaggtatctggaatccttcagcgtgttctcctgcttttccgggcg 3600
 K  N  N  R  Q  K  V  S  G  I  L  Q  R  V  L  L  F  R  A  1200 gctcagtgttcttttcctgtagcacagtggtatatattgcagttgaggtgggcaagaaaa 3660
 A  Q  C  S  F  P  V  A  Q  W  Y  I  L  Q  L  R  W  A  R  K  1220 gtcatgcagaagattcgaatgaaaggatcccttccttcactgagtccttttcctcagtca 3720
 V  M  Q  K  I  R  M  K  G  S  L  P  S  L  S  P  F  P  Q  S  1240 ttacttaattactgtaaaggaggtatcgcatttttagacctggagcagctggagaccac 3780
 L  L  N  Y  C  K  G  G  I  A  F  F  R  P  G  A  A  G  D  H  1260 aagcttgatgaagtttccattagagcaataggttgcttcagagaactttgtgctctgtgt 3840
 K  L  D  E  V  S  I  R  A  I  G  C  F  R  E  L  C  A  L  C  1280 tggatgctgcatgtccgtgataagttatcctatagttgcaggcaatatcagaaagcaaga 3900
 W  M  L  H  V  R  D  K  L  S  Y  S  C  R  Q  Y  Q  K  A  R  1300 gaaaatgtaaaaggagaaaaggaccttgaagtggagtttgattcttgtatgattgagcac 3960
 E  N  V  K  G  E  K  D  L  E  V  E  F  D  S  C  M  I  E  H  1320 tgtcttagtgcagtggaatgggcttatagaatgctgccttctctcggttttttaatatg 4020
 C  L  S  A  V  E  W  A  Y  R  M  L  P  F  S  R  F  F  N  M  1340 gaagaacttattcaggatataattttgagccttattggagaactgccaccaatcagaaag 4080
 E  E  L  I  Q  D  I  I  L  S  L  I  G  E  L  P  P  I  R  K  1360
```

FIG. 80E

```
gtagcagaaattttcgtgaaagcatttccctatcctgaggacgtgagggttcctttaaga 4140
  V   A   E   I   F   V   K   A   F   P   Y   P   E   D   V   R   V   P   L   R   1380 gacaaatatcactctcttcaccagagactcagacactgtgttgtgaaaggaccccagact 4200
  D   K   Y   H   S   L   H   Q   R   L   R   H   C   V   V   K   G   P   Q   T   1400 gaggaaatgatgtctgttgtcatgcattctatccagaaagtgagggtgaaagctctaaaa 4260
  E   E   M   M   S   V   V   M   H   S   I   Q   K   V   R   V   K   A   L   K   1420 cgtgtgcagagaaatataggctcttttgaagtgaatatatgggaaccaattgaagaagag 4320
  R   V   Q   R   N   I   G   S   F   E   V   N   I   W   E   P   I   E   E   E   1440 aaaccagatgaggctccaggtgttgacagatattccctggggactagtttgagcagaagt 4380
  K   P   D   E   A   P   G   V   D   R   Y   S   L   G   T   S   L   S   R   S   1460 acactcacagaactaggagattctgtggttcacagtgatgcagatacgttctctgaagct 4440
  T   L   T   E   L   G   D   S   V   V   H   S   D   A   D   T   F   S   E   A   1480 ttgtcggttgaagaaaaagtaggataaatatctatcaaagaaatgccccaaatcacatg 4500
  L   S   V   E   E   K   S   R   I   N   I   Y   Q   R   N   A   P   N   H   M   1500 gaattaacatcaattcataagccaactgataaaaggaaaatgtgtaatcagaaagaaaat 4560
  E   L   T   S   I   H   K   P   T   D   K   R   K   M   C   N   Q   K   E   N   1520 cctacaaagaaagaagatcatgaaaagttatcacaaaatacacttcctgtaataggtgtt 4620
  P   T   K   K   E   D   H   E   K   L   S   Q   N   T   L   P   V   I   G   V   1540 tgggaatttgaacgtgatgatgatgaatatattaaattccttgatctgttttttgagttac 4680
  W   E   F   E   R   D   D   D   E   Y   I   K   F   L   D   L   F   L   S   Y   1560 attcttgaaagagacctaccttattccagggatgctgacattccatttctaactagtttt 4740
  I   L   E   R   D   L   P   Y   S   R   D   A   D   I   P   F   L   T   S   F   1580 tctggaaagcttagagaacatgaacttaattctttacttttttgatgtacatacaacatta 4800
  S   G   K   L   R   E   H   E   L   N   S   L   L   F   D   V   H   T   T   L   1600 aaacgacatcagagcaaaactaaaagccagaatgtgtttagagctggttcttgctttgtt 4860
  K   R   H   Q   S   K   T   K   S   Q   N   V   F   R   A   G   S   C   F   V   1620 gttgctcctgagtcctatgaatcagaaaaatcatcctctttaaatgatgaatatggcatg 4920
  V   A   P   E   S   Y   E   S   E   K   S   S   S   L   N   D   E   Y   G   M   1640 catttagaaaaccagaaacttttcatcatcagtactggttaatcaagggatcaaaccttt 4980
  H   L   E   N   Q   K   L   S   S   S   V   L   V   N   Q   G   I   K   P   F   1660 ttacaatatccttcgaatgaagtcaataagaatgaaggaatgagtggattatttggttta 5040
  L   Q   Y   P   S   N   E   V   N   K   N   E   G   M   S   G   L   F   G   L   1680 aaacaaggtcaatttacaaaatacaagatgacactagagagaaatgtctaatccagaga 5100
  K   Q   R   S   I   Y   K   I   Q   D   D   T   R   E   K   C   L   I   Q   R   1700
```

FIG. 80F

```
tcatcaaaccacatttttggactcccaagtccattaaaactagaagatgtattttcaaa  5160
 S   S   N   H   I   F   W   T   P   K   S   I   K   T   R   R   C   I   F   K   1720 gctattcagtgcaatgatattaaccctcaagaagatcttcctttagcactaaacactttt  5220
 A   I   Q   C   N   D   I   N   P   Q   E   D   L   P   L   A   L   N   T   F   1740 ggcagtataggaagactgctggaatggatgataaggtggtctaatagaaggctactctgt  5280
 G   S   I   G   R   L   L   E   W   M   I   R   W   S   N   R   R   L   L   C   1760 gattctggtataactgagtcatcctctgagtacagtccagtaattcgtgtaaagacctct  5340
 D   S   G   I   T   E   S   S   S   E   Y   S   P   V   I   R   V   K   T   S   1780 acagctgccattcttacatcattatggcttttggaacaaccctattttgctacatataag  5400
 T   A   A   I   L   T   S   L   W   L   L   E   Q   P   Y   F   A   T   Y   K   1800 gcaaaaaatgccattattaagatggtagagaatcgtgacactgggtgtcagattggaccc  5460
 A   K   N   A   I   I   K   M   V   E   N   R   D   T   G   C   Q   I   G   P   1820 aatattgagagggagagcaaatcagatgctggcggttcagttgcagtagcaactccaggt  5520
 N   I   E   R   E   S   K   S   D   A   G   G   S   V   A   V   A   T   P   G   1840 ggaactgaggaaagaaatggtcagaataaatcttgtcaaaatatcttgaatagaatgcca  5580
 G   T   E   E   R   N   G   Q   N   K   S   C   Q   N   I   L   N   R   M   P   1860 actgaagcaaaaaatcctgatataaaagaaatcaatgatgatattatttccatcactcat  5640
 T   E   A   K   N   P   D   I   K   E   I   N   D   D   I   I   S   I   T   H   1880 aatactaaaaaagaatttatagatattgatgagaatcttttagaagtagaagcatttaca  5700
 N   T   K   K   E   F   I   D   I   D   E   N   L   L   E   V   E   A   F   T   1900 gaagaggaaatggatatgcacatatcagactatgaagaagacattgaagaatctgttgga  5760
 E   E   E   M   D   M   H   I   S   D   Y   E   E   D   I   E   E   S   V   G   1920 ggtttcagaagtcccagtcttgccatttgcatgatgactttaccacagcagttagaagaa  5820
 G   F   R   S   P   S   L   A   I   C   M   M   T   L   P   Q   Q   L   E   E   1940 gagttcacagaagaggttcagtgtcaaagggaagaaccactggagacaattatggaggaa  5880
 E   F   T   E   E   V   Q   C   Q   R   E   E   P   L   E   T   I   M   E   E   1960 aaatcgactgaacaaaaaggtatgatcgaagccttttcacatcctgggcataccactcct  5940
 K   S   T   E   Q   K   G   M   I   E   A   F   S   H   P   G   H   T   T   P   1980 caatcaatgcaagtagatacgagttcagaaatttctagtgcacagatttctacatataaa  6000
 Q   S   M   Q   V   D   T   S   S   E   I   S   S   A   Q   I   S   T   Y   K   2000 gaaaaatcttcctcagttccacttctgatatcaaatggagtcaatgttgcttcacaacca  6060
 E   K   S   S   S   V   P   L   L   I   S   N   G   V   N   V   A   S   Q   P   2020 cctgctccaacacctcagaagacccagagaaatgaattcacggctcagttaccagattgt  6120
 P   A   P   T   P   Q   K   T   Q   R   N   E   F   T   A   Q   L   P   D   C   2040
```

FIG. 80G

```
tcggagtccgttaggcagatgctgcaagatgaaatgtttaaattagttcagctgcaacag 6180
  S  E  S  V  R  Q  M  L  Q  D  E  M  F  K  L  V  Q  L  Q  Q   2060 atcaacttcatgagcctaatgcaaatagtaggatcatcctttgctaatctcccagataca 6240
  I  N  F  M  S  L  M  Q  I  V  G  S  S  F  A  N  L  P  D  T   2080 caacaacttgtacagcagtctcagtctgtgcatttaggggaaagccaagaatcaaaccta 6300
  Q  Q  L  V  Q  Q  S  Q  S  V  H  L  G  E  S  Q  E  S  N  L   2100 agaggatgtggtgatgttgaagacagcaacaaaaatcttaaggagagattttttattaaa 6360
  R  G  C  G  D  V  E  D  S  N  K  N  L  K  E  R  F  F  I  K   2120 ccacagtcaatgggagagaacgccagagagcctcgcaagaacagcccacactgccatgaa 6420
  P  Q  S  M  G  E  N  A  R  E  P  R  K  N  S  P  H  C  H  E   2140 ggaactatcccatctggtcaaaatagtactggaaacgtacagaatgttccacatgggagt 6480
  G  T  I  P  S  G  Q  N  S  T  G  N  V  Q  N  V  P  H  G  S   2160 attcctttatgtcaattaaatggccagccccggaaaaaaggaccaattccatcatctcaa 6540
  I  P  L  C  Q  L  N  G  Q  P  R  K  K  G  P  I  P  S  S  Q   2180 aacttaccatccacttcgtttatccagctcctgctggaaatactcacctctaccttttg 6600
  N  L  P  S  T  S  F  Y  P  A  P  A  G  N  T  H  L  Y  L  L   2200 tccacaccttctgttgttcagaaggcacctagacttatcccacatgcaaaaacatttagt 6660
  S  T  P  S  V  V  Q  K  A  P  R  L  I  P  H  A  K  T  F  S   2220 cctggtgatggcttttcctttgcttcaatttaagtctaaacaagaattccagccccttttc 6720
  P  G  D  G  F  P  L  L  Q  F  K  S  K  Q  E  F  Q  P  L  F   2240 ttacatacaggaagtattccacaagttcccttcaggccttttgccacaaccaagagaggct 6780
  L  H  T  G  S  I  P  Q  V  P  F  R  P  L  P  Q  P  R  E  A   2260 tggggattatctgactccttccaacctgctctgccacagagagcagcacaaactactcca 6840
  W  G  L  S  D  S  F  Q  P  A  L  P  Q  R  A  A  Q  T  T  P   2280 gcatcccatttgaatgtaagccagtataacactgaagccagaaaaaaagaagttgagcag 6900
  A  S  H  L  N  V  S  Q  Y  N  T  E  A  R  K  K  E  V  E  Q   2300 aagacgtgggcagaaactgtaattacagaaattcctaatcatgtgaacttggatcaatat 6960
  K  T  W  A  E  T  V  I  T  E  I  P  N  H  V  N  L  D  Q  Y   2320 gttggacaagaaaatttgacacctcaacaggactcttcagtgtttataaaaccagaaaaa 7020
  V  G  Q  E  N  L  T  P  Q  Q  D  S  S  V  F  I  K  P  E  K   2340 ctatttgatgttaagccagggacccttgagatatcctcaccattcctttggacttccg 7080
  L  F  D  V  K  P  G  T  L  E  I  S  P  H  H  S  F  G  L  P   2360 ttactatacctgccacttaaacctcctaatatgtttccatcaacctcaagagcatctatt 7140
  L  L  Y  L  P  L  K  P  P  N  M  F  P  S  T  S  R  A  S  I   2380
```

FIG. 80H

```
acagttccctcaacacctatccaacctatagcagaagaaagaaaatacccaagattgtca 7200
  T  V  P  S  T  P  I  Q  P  I  A  E  E  R  K  Y  P  R  L  S  2400 ttacttcattcacatttgtccccagaaaataggtgcaaaaaaacacaacttatcccactt 7260
  L  L  H  S  H  L  S  P  E  N  R  C  K  K  T  Q  L  I  P  L  2420 gaaaacctcattgcgtttaaacaaagccaacagaaactaacacataatttatttgaacaa 7320
  E  N  L  I  A  F  K  Q  S  Q  Q  K  L  T  H  N  L  F  E  Q  2440 ggtgatgctggacaccttcaacttctaaaggtcaaaatagaaccacctgaagtaagacaa 7380
  G  D  A  G  H  L  Q  L  L  K  V  K  I  E  P  P  E  V  R  Q  2460 ggaaaggacagtaaaaaaggcaaagaagaagagctgagaaagagctgcaagaaaaaga 7440
  G  K  D  S  K  K  R  Q  R  R  R  A  E  K  E  L  Q  E  K  R  2480 tgtgagaaactgaggagaaaaccaaatgtgacttttcgaccagagaattccataattaat 7500
  C  E  K  L  R  R  K  P  N  V  T  F  R  P  E  N  S  I  I  N  2500 aatgatgattcagaaatcattaagaaacccaaggaacaacaagaacattgtggttcccat 7560
  N  D  D  S  E  I  I  K  K  P  K  E  Q  Q  E  H  C  G  S  H  2520 cctttggatgacttcgacgttccttttgaaatgctacaagatgataatacttcagctgga 7620
  P  L  D  D  F  D  V  P  F  E  M  L  Q  D  D  N  T  S  A  G  2540 ttgcatttcatggcctctgtaaaaaagaaagctataggaagtcaagatgcaagtacaaat 7680
  L  H  F  M  A  S  V  K  K  K  A  I  G  S  Q  D  A  S  T  N  2560 acagacccagaacatgagcctttgactgctcctcagctcttggtcccagatgtctatcta 7740
  T  D  P  E  H  E  P  L  T  A  P  Q  L  L  V  P  D  V  Y  L  2580 aatctgaagcttttccagtgaaatgtcagagaaaccttggtcaccctcaatacctcataca 7800
  N  L  K  L  S  S  E  M  S  E  K  P  W  S  P  I  P  H  T  2600 gtaacaaacttggaattacctgtgagagaagagccttcaaatgataatgttatcaaacag 7860
  V  T  N  L  E  L  P  V  R  E  E  P  S  N  D  N  V  I  K  Q  2620 caaagcgatcatctagcagttccatcgtctgcagagttacattatatggcagcttcagtt 7920
  Q  S  D  H  L  A  V  P  S  S  A  E  L  H  Y  M  A  A  S  V  2640 actaatgctgttcccccacataatttttaagagtcaaggtttcctgaacatacagtcatgg 7980
  T  N  A  V  P  P  H  N  F  K  S  Q  G  F  L  N  I  Q  S  W  2660 ccaccaaacatgactgacttcagtgttttttctaacctggtgaccattggtggaagagta 8040
  P  P  N  M  T  D  F  S  V  F  S  N  L  V  T  I  G  G  R  V  2680 ctctatagtggcctgtccttgcttatcctcaagcaacagggcatcacctctctacagttc 8100
  L  Y  S  G  L  S  L  L  I  L  K  Q  Q  G  I  T  S  L  Q  F  2700 cagtccctgaaggaaatcagcgcaggaaacatctatattactgacaacagcaacctgtgt 8160
  Q  S  L  K  E  I  S  A  G  N  I  Y  I  T  D  N  S  N  L  C  2720
```

FIG. 80I

```
tattatcataccattaactggacaacactcttcagcacaatcaaccagagaatagtaatc 8220
 Y  Y  H  T  I  N  W  T  T  L  F  S  T  I  N  Q  R  I  V  I  2740 cgggacaacagaaaagctgaaaattgtactgctgaaggaatggtgtgcaaccatctgtgt 8280
 R  D  N  R  K  A  E  N  C  T  A  E  G  M  V  C  N  H  L  C  2760 tccagtgatggctgttggggacctgggccagaccaatgtctgtcgtgtcgccgcttcagt 8340
 S  S  D  G  C  W  G  P  G  P  D  Q  C  L  S  C  R  R  F  S  2780 agaggaaggatctgcatagagtcttgtaacctctatgatggtgaatttcgggagtttgag 8400
 R  G  R  I  C  I  E  S  C  N  L  Y  D  G  E  F  R  E  F  E  2800 aatggctccatctgtgtggagtgtgaccccagtgtgagaagatggaagatggcctcctc 8460
 N  G  S  I  C  V  E  C  D  P  Q  C  E  K  M  E  D  G  L  L  2820 acatgccatggaccgggtcctgacaactgtacaaagtgctctcattttaaagatggccca 8520
 T  C  H  G  P  G  P  D  N  C  T  K  C  S  H  F  K  D  G  P  2840 aactgtgtggaaaaatgtccagatggcttacaggggggcaaacagtttcattttcaagtat 8580
 N  C  V  E  K  C  P  D  G  L  Q  G  A  N  S  F  I  F  K  Y  2860 gctgatccagatcgggagtgccacccatgccatccaaactgcacccaagggtgtaacggt 8640
 A  D  P  D  R  E  C  H  P  C  H  P  N  C  T  Q  G  C  N  G  2880 cccactagtcatgactgcatttactacccatggacgggccattccactttaccacaacat 8700
 P  T  S  H  D  C  I  Y  Y  P  W  T  G  H  S  T  L  P  Q  H  2900 gctagaactcccctgattgcagctggagtaattggtgggctcttcattctggtcattgtg 8760
 A  R  T  P  L  I  A  A  G  V  I  G  G  L  F  I  L  V  I  V  2920 ggtctgacatttgctgtttatgttagaaggaagagcatcaaaaagaaaagagccttgaga 8820
 G  L  T  F  A  V  Y  V  R  R  K  S  I  K  K  K  R  A  L  R  2940 agattcttggaaacagagttggtggaaccattaactcccagtggcacagcacccaatcaa 8880
 R  F  L  E  T  E  L  V  E  P  L  T  P  S  G  T  A  P  N  Q  2960 gctcaacttcgtattttgaaagaaactgagctgaagagggtaaaagtccttggctcaggt 8940
 A  Q  L  R  I  L  K  E  T  E  L  K  R  V  K  V  L  G  S  G  2980 gcttttggaacggtttataaaggtatttgggtacctgaaggagaaactgtgaagattcct 9000
 A  F  G  T  V  Y  K  G  I  W  V  P  E  G  E  T  V  K  I  P  3000 gtggctattaagattcttaatgagacaactggtcccaaggcaaatgtggagttcatggat 9060
 V  A  I  K  I  L  N  E  T  T  G  P  K  A  N  V  E  F  M  D  3020 gaagctctgatcatggcaagtatggatcatccacacctagtccggttgctgggtgtgtgt 9120
 E  A  L  I  M  A  S  M  D  H  P  H  L  V  R  L  L  G  V  C  3040 ctgagcccaaccatccagctggttactcaacttatgccccatggctgcctgttggagtat 9180
 L  S  P  T  I  Q  L  V  T  Q  L  M  P  H  G  C  L  L  E  Y  3060
```

FIG. 80J

```
gtccacgagcacaaggataacattggatcacaactgctgcttaactggtgtgtccagata 9240
 V  H  E  H  K  D  N  I  G  S  Q  L  L  L  N  W  C  V  Q  I  3080 gctaagggaatgatgtacctggaagaaagacgactcgttcatcgggatttggcagcccgt 9300
 A  K  G  M  M  Y  L  E  E  R  R  L  V  H  R  D  L  A  A  R  3100 aatgtcttagtgaaatctccaaaccatgtgaaaatcacagattttgggctagccagactc 9360
 N  V  L  V  K  S  P  N  H  V  K  I  T  D  F  G  L  A  R  L  3120 ttggaaggagatgaaaaagagtacaatgctgatggaggaaagatgccaattaaatggatg 9420
 L  E  G  D  E  K  E  Y  N  A  D  G  G  K  M  P  I  K  W  M  3140 gctctggagtgtatacattacaggaaattcacccatcagagtgacgtttggagctatgga 9480
 A  L  E  C  I  H  Y  R  K  F  T  H  Q  S  D  V  W  S  Y  G  3160 gttactatatgggaactgatgacctttggaggaaaaccctatgatggaattccaacgcga 9540
 V  T  I  W  E  L  M  T  F  G  G  K  P  Y  D  G  I  P  T  R  3180 gaaatccctgatttattagagaaaggagaacgtttgcctcagcctcccatctgcactatt 9600
 E  I  P  D  L  L  E  K  G  E  R  L  P  Q  P  P  I  C  T  I  3200 gacgtttacatggtcatggtcaaatgttggatgattgatgctgacagtagacctaaattt 9660
 D  V  Y  M  V  M  V  K  C  W  M  I  D  A  D  S  R  P  K  F  3220 aaggaactggctgctgagttttcaaggatggctcgagaccctcaaagatacctagttatt 9720
 K  E  L  A  A  E  F  S  R  M  A  R  D  P  Q  R  Y  L  V  I  3240 cagggtgatgatcgtatgaagcttcccagtccaaatgacagcaagttctttcagaatctc 9780
 Q  G  D  D  R  M  K  L  P  S  P  N  D  S  K  F  F  Q  N  L  3260 ttggatgaagaggatttggaagatatgatggatgctgaggagtacttggtccctcaggct 9840
 L  D  E  E  D  L  E  D  M  M  D  A  E  E  Y  L  V  P  Q  A  3280 ttcaacatcccacctcccatctatacttccagagcaagaattgactcgaataggagtgaa 9900
 F  N  I  P  P  P  I  Y  T  S  R  A  R  I  D  S  N  R  S  E  3300 attggacacagccctcctcctgcctacacccccatgtcaggaaaccagtttgtataccga 9960
 I  G  H  S  P  P  P  A  Y  T  P  M  S  G  N  Q  F  V  Y  R  3320 gatggaggttttgctgctgaacaaggagtgtctgtgccctacagagccccaactagcaca 10020
 D  G  G  F  A  A  E  Q  G  V  S  V  P  Y  R  A  P  T  S  T  3340 attccagaagctcctgtggcacagggtgctactgctgagattttttgatgactcctgctgt 10080
 I  P  E  A  P  V  A  Q  G  A  T  A  E  I  F  D  D  S  C  C  3360 aatggcaccctacgcaagccagtggcacccccatgtccaagaggacagtagcacccagagg 10140
 N  G  T  L  R  K  P  V  A  P  H  V  Q  E  D  S  S  T  Q  R  3380 tacagtgctgaccccaccgtgtttgccccagaacggagcccacgaggagagctggatgag 10200
 Y  S  A  D  P  T  V  F  A  P  E  R  S  P  R  G  E  L  D  E  3400
```

FIG. 80K

```
gaaggttacatgactcctatgcgagacaaacccaaacaagaatacctgaatccagtggag 10260
 E  G  Y  M  T  P  M  R  D  K  P  K  Q  E  Y  L  N  P  V  E   3420 gagaaccccttttgtttctcggagaaaaaatggagaccttcaagcattggataatcccgaa 10320
 E  N  P  F  V  S  R  R  K  N  G  D  L  Q  A  L  D  N  P  E   3440 tatcacaatgcatccaatggtccacccaaggccgaggatgagtatgtgaatgagccactg 10380
 Y  H  N  A  S  N  G  P  P  K  A  E  D  E  Y  V  N  E  P  L   3460 tacctcaacacctttgccaacaccttgggaaaagctgagtacctgaagaacaacatactg 10440
 Y  L  N  T  F  A  N  T  L  G  K  A  E  Y  L  K  N  N  I  L   3480 tcaatgccagagaaggccaagaaagcgtttgacaaccctgactactggaaccacagcctg 10500
 S  M  P  E  K  A  K  K  A  F  D  N  P  D  Y  W  N  H  S  L   3500 ccacctcggagcacccttcagcacccagactacctgcaggagtacagcacaaaatatttt 11560
 P  P  R  S  T  L  Q  H  P  D  Y  L  Q  E  Y  S  T  K  Y  F   3520 tataaacagaatgggcggatccggcctattgtggcagagaatcctgaatacctctctgag 11580
 Y  K  Q  N  G  R  I  R  P  I  V  A  E  N  P  E  Y  L  S  E   3540 ttctcccctgaagccaggcactgtgctgccgcctccaccttacagacaccggaatactgtg 11640
 F  S  L  K  P  G  T  V  L  P  P  P  P  Y  R  H  R  N  T  V   3560

Gtgtaa  (SEQ ID NO: 83)
 V  -   (SEQ ID NO: 84)
```

FIG. 81A

```
GGTTCTGAGC AGGCGCCGTG GCAGCGCCCG CGCCCCCTGC CCGCCCTCCG  50
CCGTCGCCAG GACGCAGGCT CGCGTCAGGG CTGGCGGTAG GGCCCGCAGC  100
TGTCGGCCTG GCGTCTTCAC CCCGCGCAGT CGGCCTCGCC TAGCCTTCTC  150
GCGCCTGACT GGCCGGACCC TGCCCCTGGC GGAGAATCTT GGGACTGTTT  200
TACTTAATTG GTCATTGATA GCTTAACAAA CATGGAGATA AGATTAGAAA  250
TCTTGACATC AACAGGTATT AAGCAGAAAA AACCATGGCC ACGTGTCTCC  300
TGGTTGGGAA AGGAAAAAGA AGCCGTTTTT CTTTTGGATG ATAAATTCAT  350
AAATGAAATT AATTTGCTAT CAGGAAAGAT AAAGAAGAAA ATTCCTAGTC  400
TGCAGCCTTT CTTGAAGGAT GTTATTGTCC TAACAACATC CAGTAATGAT  450
GCCTGGCTGG CTGGGGTACT AACTACAGGA GAGCTTTTCC TTTGGAACAA  500
AGATCAAGAT TGTTTGAAAA CTATACCAAT AACTGAAAAG CCTAAGGAAA  550
TGATCAAAGC TACAGTCGCA AGCTCTTTGA GACTGTACTT GTATGTATCT  600
GGAAATGGGA AAAGAATTGT GCTCATAACA CCTTCTGGAT GCATATTTCT  650
TTGGGAATAT TTGGAATTAA AGAATATCTT ATCTTCTAAA AGCCTTTCAT  700
TGGCGGGTCG GTGGTCCCAG GTCATACCTG AAGAAGCAGT TCTCTTGCCT  750
TCCACCGAAG ATAAAGAAGC TGTAGTGAAT GCTGTTTTA TAAAAAATGA  800
GTTATTTGGA GACTGCTGCC TGTGTTCATT TACTTTTAT TCTGGGGAAT  850
GCCTGAAGTT AACATTCTA GCAATTCGGT GGCATGAGAA TGTATTTACA  900
TCTGTAAGAT CATTGCCATA CCATGTTCAT TGGGCTCAAC AAGACTGTCA  950
TCTCTGTAGT TTAATTCCTA AATGTGAATC AGTAAAGTCA AGAGGAGCTC  1000
TAATTTCTGC CTTTTCAAGA GATGGCCTTA CCCTGGCAGT AACTCTTAAT  1050
CAGAAAGACC CCAAGGCAAC TCAGGTATTA TTTATAAACA CACTGAATTT  1100
TGTTACTCTC TGTGGTAGCC TTAAAGGATG TAGTAACAAG AGTCCCGTGG  1150
TTCCAGCTAC ACTTATTAGG TCCTACTGGG TAGGTGATAT CAGCTGGACG  1200
CATGATAGTC TTTTTCTGGC TTGTATGTTA AAACGTGGCT CTCTGGTTTT  1250
ATTGACCTGC CAAGGTGAAT TGCTAACATT AATTACATTT GGTTGCTCTA  1300
TAGAATTTGG CCCAGCAGAA TTTATTCCTC TTCATCCACT AATAACGTAT  1350
AGACCACAGC AGTTTACGTT TCAAGATTCA AATAATTCTG TTGATTCATC  1400
AGCTTCTGAT AGTGACCCTA TGAGACAGAG ATTTTCTATA AAAGCACACT  1450
CACGGTTACC CTACCTCGTT ATATCTGATG GATATATGGT CACAACCCTT  1500
CGATTTCTTG ATAGCCTATC TCCATCAGTA CACATGAGAT CACTTCTACT  1550
TGATTCAACC CAGAGGCTTG AGAAAATATA TCAAAGTGTG ATATTGTCTA  1600
AGCCAAAAGG CAAAGGACTG AACTTGCGAT CACTGAATTC CCTAAGGTCT  1650
AGCCTGTTAG AACACCAAGG AAATGAAAGT TCAGCCGATT TCACTGTCCC  1700
CAAATTCTTG CAGGCAGAAG AAACAATAAA TGAAAATGCA GCAGATTTTC  1750
AGGATTTTGA AGCAGAAGAA ACTAACGAAG GCAGACACTT TCCAGACAAC  1800
TTATGTCCTT TTTGGAACAA AAGAGATGAT GTGCTGTGTA GTAGTATGAA  1850
GGAAGGAAGA TTGGAATTTG CATCTATGTT TGATACGATA CATGCAAAGG  1900
ATGATAGTGA GGAGACAGAT AGAACCATTA CAGAACTGCA TTCTATCCAG  1950
AAAAGTCTAC TTGCAGCGTG GACTATAGGA ATTTCAAAAA CTGTGACAGA  2000
AAAAAATTTA ATGTTAAATT ACATAGTAGT TTGTATCACT CATTTTTTT  2050
ACATCTTCA ATTTATAAAA TGTCCTTTTC CTAAACTTGA TCTTGTTTTA  2100
AGCAAAAGCT CAAGACATAA TGCATGGATA CTTGTATCT TTCAACTTTT  2150
TCATCAGTGT TTATCAATCC ATTATTGGGA TATAAGATAC AAACAAGATG  2200
TGGGGCATTT GATAAAGCTG ACCTCAAATA CTGTAAAACT TTTGCTGACT  2250
CAGCAACAAA AGGGTCAGTT ATTCTCAGAG AAACTTTTAG CTTGTTTTTA  2300
TTTACTCAAA ATGGTAGCTG ACAATTTAAA TGGTGTATAC ATTCTTCAAC  2350
CTGAAGTTAT TTCAGCATCA GCTGATGGAA GTAAAATAAC AGCTCAAGAC  2400
TCATTGGTGG TACCTATTTT TCAGATGTTT CAAGATAGTG GTTTTCAGAA  2450
AAACTGGTCT TGGAACTCAT TTTTCAAGAT TCATCCTCAA GTAGTAAATC  2500
```

FIG. 81B

```
CTGTGCAACA GCCAGGACAC AGATTGCTTA TTCTCTGGAG AATACTGTAC  2550
AAAAAAACTT TATGGTATCA AGCACAATTA AATCGAAGAG TTCCTGAAGC  2600
TGATAGTCAG TTAACTGAAA AGATGACACA TGAAGCATCT ACTGTCAAGT  2650
CCCTGTTATG TCATTTGCAG GCTAACCTAC AGAGTACTGG AGATTGCTTG  2700
AATCAAACCT TAGAACTTAA ATCTATCAAT GGGGAAGAAT GTTTTTATT   2750
AGGATCATAT GAAAAGTCTG TTCAGCTGTG GAAAAAAGCT CTACAAGAAA  2800
TCGAAGAGAA AGGAGGAAGA AGGACGTATT TCTTCAGAT ACGCTATTAT   2850
CTTTCTCTCT TATACTGCCA CCTCTATAGC TATAATTTAA ATGATGCTCA  2900
AGGATTGTGT GATCAGCTAG CAAGAGAAAT CCTGAGATGG TCCCAACTAC  2950
CTGTAAAAGA AAATAAAGAT TTTTCAGGTG CTGCAAAGTC TCATTTTGAG  3000
TGTGGAATGG TGGGCGGTGT TCATCCTGAG GCAGCAGTGA GAGTCGTCCA  3050
GTCCATGGCT CGTTTCATGG CTGCCTATTT CACCAATCAG CAGCTTTGCA  3100
TTTTGCCCCC TCATCATGTG AATGTTCTTC CCCCACTTCA TATTAAAACA  3150
GAGCAGTCCT TTCGACTTAT TCCTCTGCAA CACTCTAAGG TGGCCAGTGT  3200
TGTTAGAGAT CAGAATCTCT CTAATGTGTG GACAGTTGAA TATGCACTTG  3250
AATTACTATT TATTGGTGGC CTGGTTCCAG AGGCTGTGTG GTTGGCATAT  3300
AAACTTGGAG ACTGGAAGAC GTCTGTTTCA ATTGGTGTGG CTTTCCAGCT  3350
GTTCTGTAAA CGTGATAGCA ATTTCATGAG GTCCAAGAAA AAGAGTCTGA  3400
ATCTACCACT CCGTATGACT CCAGCACAGA TTTTTCAGGA AAAACTGCAG  3450
TGTGTTTTAG GTCAACCAGC CTCTTTGGAA GCAAAAAATG AAATGGGCTC  3500
AAAATATAAA CAGTTTACAG ATCCCATTGA AGAGGAAGAT GCAAATCTGC  3550
TATTTGGTTC AGTACAAGAA GTACTGAAAG CATCAGTTAT GGCCGATGCA  3600
GATATTCTTT CGGAGACATT TCAACTTCTG ATAGACTCTG CCAAGGACTT  3650
CAGTAAAAGA CTGTGGGGCT TAGTGCCATT CGGCTTGTAT CTTCCAGCTC  3700
CTCCATTGTA CTGTCCCCAG CCAGCTATTC TTAGTGAAGA AGATGGTGAT  3750
GATCTTCTTT TAAAAGCTGA AAAAAATAAT CGCCAGAAGG TATCTGGAAT  3800
CCTTCAGCGT GTTCTCCTGC TTTTCCGGGC GGCTCAGTGT TCTTTTCCTG  3850
TAGCACAGTG GTATATATTG CAGTTGAGGT GGGCAAGAAA AGTCATGCAG  3900
AAGATTCGAA TGAAAGGATC CCTTCCTTCA CTGAGTCCTT TTCCTCAGTC  3950
ATTACTTAAT TACTGTAAAG GAGGTATCGC ATTTTTAGA CCTGGAGCAG   4000
CTGGAGACCA CAAGCTTGAT GAAGTTTCCA TTAGAGCAAT AGGTTGCTTC  4050
AGAGAACTTT GTGCTCTGTG TTGGATGCTG CATGTCCGTG ATAAGTTATC  4100
CTATAGTTGC AGGCAATATC AGAAAGCAAG AGAAAATGTA AAAGGAGAAA  4150
AGGACCTTGA AGTGGAGTTT GATTCTTGTA TGATTGAGCA CTGTCTTAGT  4200
GCAGTGGAAT GGGCTTATAG AATGCTGCCT TTCTCTCGGT TTTTTAATAT  4250
GGAAGAACTT ATTCAGGATA TAATTTTGAG CCTTATTGGA GAACTGCCAC  4300
CAATCAGAAA GGTAGCAGAA ATTTTCGTGA AAGCATTTCC CTATCCTGAG  4350
GACGTGAGGG TTCCTTTAAG AGACAAATAT CACTCTCTTC ACCAGAGACT  4400
CAGACACTGT GTTGTGAAAG GACCCCAGAC TGAGGAAATG ATGTCTGTTG  4450
TCATGCATTC TATCCAGAAA GTGAGGGTGA AAGCTCTAAA ACGTGTGCAG  4500
AGAAATATAG GCTCTTTTGA AGTGAATATA TGGGAACCAA TTGAAGAAGA  4550
GAAACCAGAT GAGGCTCCAG GTGTTGACAG ATATTCCCTG GGGACTAGTT  4600
TGAGCAGAAG TACACTCACA GAACTAGGAG ATTCTGTGGT TCACAGTGAT  4650
GCAGATACGT TCTCTGAAGC TTTGTCGGTT GAAGAAAAAA GTAGGATAAA  4700
TATCTATCAA AGAAATGCCC CAAATCACAT GGAATTAACA TCAATTCATA  4750
AGCCAACTGA TAAAAGGAAA ATGTGTAATC AGAAAGAAAA TCCTACAAAG  4800
AAAGAAGATC ATGAAAAGTT ATCACAAAAT ACACTTCCTG TAATAGGTGT  4850
TTGGGAATTT GAACGTGATG ATGATGAATA TATTAAATTC TTGATCTGT   4900
TTTTGAGTTA CATTCTTGAA AGAGACCTAC CTTATTCCAG GGATGCTGAC  4950
ATTCCATTTC TAACTAGTTT TTCTGGAAAG CTTAGAGAAC ATGAACTTAA  5000
```

FIG. 81C

```
TTCTTTACTT TTTGATGTAC ATACAACATT AAAACGACAT CAGAGCAAAA  5050
CTAAAAGCCA GAATGTGTTT AGAGCTGGTT CTTGCTTTGT TGTTGCTCCT  5100
GAGTCCTATG AATCAGAAAA ATCATCCTCT TTAAATGATG AATATGGCAT  5150
GCATTTAGAA AACCAGAAAC TTTCATCATC AGTACTGGTT AATCAAGGGA  5200
TCAAACCTTT TTTACAATAT CCTTCGAATG AAGTCAATAA GAATGAAGGA  5250
ATGAGTGGAT TATTTGGTTT AAAACAAAGG TCAATTTACA AAATACAAGA  5300
TGACACTAGA GAGAAATGTC TAATCCAGAG ATCATCAAAC CACATTTTTT  5350
GGACTCCCAA GTCCATTAAA ACTAGAAGAT GTATTTTCAA AGCTATTCAG  5400
TGCAATGATA TTAACCCTCA AGAAGATCTT CCTTTAGCAC TAAACACTTT  5450
TGGCAGTATA GGAAGACTGC TGGAATGGAT GATAAGGTGG TCTAATAGAA  5500
GGCTACTCTG TGATTCTGGT ATAACTGAGT CATCCTCTGA GTACAGTCCA  5550
GTAATTCGTG TAAAGACCTC TACAGCTGCC ATTCTTACAT CATTATGGCT  5600
TTTGGAACAA CCCTATTTTG CTACATATAA GGCAAAAAAT GCCATTATTA  5650
AGATGGTAGA GAATCGTGAC ACTGGGTGTC AGATTGGACC CAATATTGAG  5700
AGGGAGAGCA AATCAGATGC TGGCGGTTCA GTTGCAGTAG CAACTCCAGG  5750
TGGAACTGAG GAAAGAAATG GTCAGAATAA ATCTTGTCAA AATATCTTGA  5800
ATAGAATGCC AACTGAAGCA AAAAATCCTG ATATAAAAGA AATCAATGAT  5850
GATATTATTT CCATCACTCA TAATACTAAA AAAGAATTTA TAGATATTGA  5900
TGAGAATCTT TTAGAAGTAG AAGCATTTAC AGAAGAGGAA ATGGATATGC  5950
ACATATCAGA CTATGAAGAA GACATTGAAG AATCTGTTGG AGGTTTCAGA  6000
AGTCCCAGTC TTGCCATTTG CATGATGACT TTACCACAGC AGTTAGAAGA  6050
AGAGTTCACA GAAGAGGTTC AGTGTCAAAG GGAAGAACCA CTGGAGACAA  6100
TTATGGAGGA AAAATCGACT GAACAAAAAG GTATGATCGA AGCCTTTTCA  6150
CATCCTGGGC ATACCACTCC TCAATCAATG CAAGTAGATA CGAGTTCAGA  6200
AATTTCTAGT GCACAGATTT CTACATATAA AGAAAAATCT TCCTCAGTTC  6250
CACTTCTGAT ATCAAATGGA GTCAATGTTG CTTCACAACC ACCTGCTCCA  6300
ACACCTCAGA AGACCCAGAG AAATGAATTC ACGGCTCAGT TACCAGATTG  6350
TTCGGAGTCC GTTAGGCAGA TGCTGCAAGA TGAAATGTTT AAATTAGTTC  6400
AGCTGCAACA GATCAACTTC ATGAGCCTAA TGCAAATAGT AGGATCATCC  6450
TTTGCTAATC TCCCAGATAC ACAACAACTT GTACAGCAGT CTCAGTCTGT  6500
GCATTTAGGG GAAAGCCAAG AATCAAACCT AAGAGGATGT GGTGATGTTG  6550
AAGACAGCAA CAAAAATCTT AAGGAGAGAT TTTTTATTAA ACCACAGTCA  6600
ATGGGAGAGA ACGCCAGAGA GCCTCGCAAG AACAGCCCAC ACTGCCATGA  6650
AGGAACTATC CCATCTGGTC AAAATAGTAC TGGAAACGTA CAGAATGTTC  6700
CACATGGGAG TATTCCTTTA TGTCAATTAA ATGGCCAGCC CCGGAAAAAA  6750
GGACCAATTC CATCATCTCA AAACTTACCA TCCACTTCGT TTTATCCAGC  6800
TCCTGCTGGA AATACTCACC TCTACCTTTT GTCCACACCT TCTGTTGTTC  6850
AGAAGGCACC TAGACTTATC CCACATGCAA AAACATTTAG TCCTGGTGAT  6900
GGCTTTCCTT TGCTTCAATT TAAGTCTAAA CAAGAATTCC AGCCCCTTTT  6950
CTTACATACA GGAAGTATTC CACAAGTTCC CTTCAGGCCT TGCCACAAC   7000
CAAGAGAGGC TTGGGGATTA TCTGACTCCT TCCAACCTGC TCTGCCACAG  7050
AGAGCAGCAC AAACTACTCC AGCATCCCAT TTGAATGTAA GCCAGTATAA  7100
CACTGAAGCC AGAAAAAAAG AAGTTGAGCA GAAGACGTGG GCAGAAACTG  7150
TAATTACAGA AATTCCTAAT CATGTGAACT TGGATCAATA TGTTGGACAA  7200
GAAAATTTGA CACCTCAACA GGACTCTTCA GTGTTTATAA AACCAGAAAA  7250
ACTATTTGAT GTTAAGCCAG GGACCCTTGA GATATCTCCT CACCATTCCT  7300
TTGGACTTCC GTTACTATAC CTGCCACTTA AACCTCCTAA TATGTTTCCA  7350
TCAACCTCAA GAGCATCTAT TACAGTTCCC TCAACACCTA TCCAACCTAT  7400
AGCAGAAGAA AGAAAATACC CAAGATTGTC ATTACTTCAT TCACATTTGT  7450
CCCCAGAAAA TAGGTGCAAA AAAACACAAC TTATCCCACT TGAAAACCTC  7500
```

FIG. 81D

```
ATTGCGTTTA AACAAAGCCA ACAGAAACTA ACACATAATT TATTTGAACA  7550
AGGTGATGCT GGACACCTTC AACTTCTAAA GGTCAAAATA GAACCACCTG  7600
AAGTAAGACA AGGAAAGGAC AGTAAAAAAA GGCAAAGAAG AAGAGCTGAG  7650
AAAGAGCTGC AAGAAAAAAG ATGTGAGAAA CTGAGGAGAA AACCAAATGT  7700
GACTTTTCGA CCAGAGAATT CCATAATTAA TAATGATGAT TCAGAAATCA  7750
TTAAGAAACC CAAGGAACAA CAAGAACATT GTGGTTCCCA TCCTTTGGAT  7800
GACTTCGACG TTCCTTTTGA AATGCTACAA GATGATAATA CTTCAGCTGG  7850
ATTGCATTTC ATGGCCTCTG TAAAAAAGAA AGCTATAGGA AGTCAAGATG  7900
CAAGTACAAA TACAGACCCA GAACATGAGC CTTTGACTGC TCCTCAGCTC  7950
TTGGTCCCAG ATGTCTATCT AAATCTGAAG CTTTCCAGTG AAATGTCAGA  8000
GAAACCTTGG TCACCCTCAA TACCTCATAC AGTAACAAAC TTGGAATTAC  8050
CTGTGAGAGA AGAGCCTTCA AATGATAATG TTATCAAACA GCAAAGCGAT  8100
CATCTAGCAG TTCCATCGTC TGCAGAGTTA CATTATATGG CAGCTTCAGT  8150
TACTAATGCT GTTCCCCCAC ATAATTTAA GAGTCAAGGT CTGCCAAAAC  8200
CAGAGTTCCG ATTCAAAGGA CAGAGCACAA AGTCAGACTC TGCAGAAGAT  8250
TATCTATTGT GGAAACGGCT GCAAGGTGTC TCTGCAGCTT GCCCTGCACC  8300
AAGCTCTGCA GCTCACCAAC TAGAGCATCT CAGTGCTAAG CTTCAGAAAA  8350
TTGACGAGCA GTTGCTAGCA ATACAGAACA TTGCTGAAAA CATAGAACAG  8400
GATTTCCCCA AGCCTGAAAT GCTAGATCTA CATTGTGATA AGATTGGACC  8450
AGTGGATCAC ATTGAATTCT CTTCTGGCCC TGAATTCAAA AAAACATTAG  8500
CTTCAAAAAC CATTAGCATT TCTGAAGAAG TGCGTTTTTT GACCCATATG  8550
GATGAAGAAG ATCAAAGTGA CAAAAAGGAG ACTTCAGAAC CTGAATTTTC  8600
AATAACAGAA AATTATTCTG GTCAGAAAAC CTGTGTGTTT CCTACTGCCG  8650
ATTCAGCTGT CAGCCTTTCC AGTTCCAGTG ATCAGAATAC TACTTCTCCT  8700
GGTATGAATA GCAGTGATGA ATTGTGTGAG AGTGTTTCAG TACATCCGCT  8750
CCAGATGACT GGATTGACTG ATATTGCAGA CATTATTGAT GACCTTATAA  8800
TTAAAGACGG AGTTTCCAGT GAAGAACTTG GCTTAACAGA ACAAGCTATG  8850
GGCACCTCCA GAATTCAGCA TTATTCTGGC AGACATTCAC AAAGAACTGA  8900
CAAGGAAAGA AGAGAGATTC AAGCCTGGAT GAAAAGAAAA CGAAAAGAAA  8950
GAATGGCAAA GTACTTAAAT GAGCTGGCAG AAAAGAGAGG GCAAGAACAT  9000
GATCCTTTCT GTCCCAGAAG CAATCCACTT TACATGACTT CAAGGGAAAT  9050
AAGGCTGAGA CAAAAGATGA AGCATGAAAA AGACAGATTG CTGCTCTCTG  9100
AACACTATAG TCGTCGAATC TCACAAGCGT ACGGTCTGAT GAATGAACTG  9150
TTATCTGAGT CAGTACAGCT ACCAACTCTA CCACAGAAAC CATTGCCTAA  9200
CAAACCCAGC CCTACTCAGT CTTCCAGTTG TCAACACTGC CCTTCTCCAA  9250
GAGGAGAGAA TCAACATGGT CACAGTTTTC TAATAAATCG ACCTGGAAAA  9300
GTCAAATATA TGTCCAAACC GAGTTATATC CATAAGAGGA AGTCTTTTGG  9350
GCAACCTCAA GGCTCACCTT GGCCACATGG AACTGCCACT TTCACCATAC  9400
AGAAAAAAGC TGGTGGAGCC AAAGCAGCAG TAAGAAAGGC TACGCAGTCT  9450
CCAGTTACCT TCCAAAAAGG CTCTAATGCT CCGTGTCATA GTCTGCAGCA  9500
TACAAAAAAA CATGGAAGTG CTGGGCTTGC ACCTCAAACC AAGCAGGTGT  9550
GTGTAGAGTA TGAAAGAGAG GAGACTGTGG TGAGTCCCTG GACGATACCT  9600
TCAGAAATCC ATAAGATTCT TCATGAGAGT CACAATTCCC TTCTACAAGA  9650
CTTGTCTCCA ACTGAAGAGG AAGAGCCAGA GCATCCTTTT GGGGTGGGCG  9700
GTGTGGACAG CGTGTCTGAG AGCACTGGCA GCATCCTCAG CAAGCTGGAC  9750
TGGAATGCCA TCGAAGACAT GGTGGCCAGC GTGGAGGACC AGGGCCTGTC  9800
TGTCCACTGG GCCCTGGACC TGTAAGACCT GGATATCATT GGGTTTCCAT  9850
GCACAGGCCA GCACCTCAGT AATGTGGTTC TGAAAGATTA ACAGGTTTAA  9900
GGGACAGAAG CAATGAAAGA AGCAATGTGA ATTTTCCATT TGCTTTCATA  9950
TTATTACCTG GATTAGCCAT TACCAGAGGA AAAATAAACA TTTCTCAGTA  10000
```

FIG. 81E

```
ACTTTGCCTT TATGGGGAAA GGGTTGACTA TTGATGTATT ATATGTTTTT  10050
GTATTTGATG CATCATTAGG CATAATTTTT AAAATGATAA GTACCTTTCA  10100
AGCCAAGTTT GCATAACCTA CTTTCAATAA AAACCCTCTA TCTTGCCTCC  10150
TCCTTTATTA CCCTCTGAGT TTTGAGAAAC AACCATATAC AGATGAATCT  10200
AATAGGAAAA AAAAAAATCT TTTCATTGAG AAGAAAATCA GTCTCACCTG  10250
AGAACTCAAT TATGAACCCT ATTTAAAAC ACCTATGCAG GGTTTAGCCT   10300
AGGAGTGAAA AGAAAAACCA ACTACCTTTT ACCAACCCTG AATCTCTAAA  10350
TAAGCAAAGT TCATGGAGG CCAGGAGATC TTCTGTCTTC TGCCCTGTAG   10400
CCTGAAGCCT TGGAGGAAGA AACAGGAATG GATGCTTTGG GCAGGAAAGT  10450
AAGGGAATAT GACTCCGGCC TCTAGAAGGC TCATCTTAAA TTTGTAAGAA  10500
CCATGGTACA GAGACCTGAT TAGTTTTGG TATTGTGCTC AATAATGTC    10550
ATAGTTTTAA GAGATAATTT TTATGAGAAT TGACTAAGAA CCAGTATCCT  10600
TCAACTACTT CATCAATGTT TGGTATAATA TAAAAGCACA CTATCATCTG  10650
AAAAAGCTAT TAAATACCCC TCTTTTTCCA AATATCTACC TGTGTGAAGC  10700
CAGGTTTTAC AACATGTATT GCAGCAAGTT GAATGCAGAA GCAGGTATGG  10750
TAATTCAGCT GCCTTCTATC AAGCTAAACA TTAAAGAGAT TTGTAGAACT  10800
ATAAAACAAT GCTACTCTCC TTACCAAATT GTTTAGAAA ATAGCTTTAT   10850
AGGCTAACAT TATTGTTAAT TGTCATTTAA TTGTTTTGTC ATTTAAAATA  10900
TTTTAAATTG TTTTCTGTTA GTTTCTTTTT TGTATATTCT ATGGGTATTT  10950
TATTGATACA TGATAGTTGT ACATTTTAT GGGGTGCATG TGATATTTTG   11000
ATATGTGCAT ACAATGTGTA GCAATCAAAT CAGGGTAATT GGGATATTCA  11050
TCACCTCAAA CATTTATCAT TTATTTGTGT TGGAAACATT CAAACCTTTT  11100
CTTCTAGCTA TTTATCCATT GTTGGATACT TATATCAATT CTATATCTTA  11150
GCTGTTGTGA ATAGAGCTGC AATAAATGTA GGAGTGCAGA TATCTCTTTa  11200
aaaaaaaaaa aaaaaaa (SEQ ID NO: 85)
```

FIG. 82A

```
MEIRLEILTSTGIKQKKPWPRVSWLGKEKEAVFLLDDKFINEINLLSGKIKKKIPSLQPF
LKDVIVLTTSSNDAWLAGVLTTGELFLWNKDQDCLKTIPITEKPKEMIKATVASSLRLYL
YVSGNGKRIVLITPSGCIFLWEYLELKNILSSKSLSLAGRWSQVIPEEAVLLPSTEDKEA
VVNAVFIKNELFGDCCLCSFTFYSGECLKLTFLAIRWHENVFTSVRSLPYHVHWAQQDCH
LCSLIPKCESVKSRGALISAFSRDGLTLAVTLNQKDPKATQVLFINTLNFVTLCGSLKGC
SNKSPVVPATLIRSYWVGDISWTHDSLFLACMLKRGSLVLLTCQGELLTLITFGCSIEFG
PAEFIPLHPLITYRPQQFTFQDSNNSVDSSASDSDPMRQRFSIKAHSRLPYLVISDGYMV
TTLRFLDSLSPSVHMRSLLLDSTQRLEKIYQSVILSKPKGKGLNLRSLNSLRSSLLEHQG
NESSADFTVPKFLQAEETINENAADFQDFEAEETNEGRHFPDNLCPFWNKRDDVLCSSMK
EGRLEFASMFDTIHAKDDSEETDRTITELHSIQKSLLAAWTIGISKTVTEKNLMLNYIVV
CITHFFYILQFIKCPFPKLDLVLSKSSRHNAWILCIFQLFHQCLSIHYWDIRYKQDVGHL
IKLTSNTVKLLLTQQQKGQLFSEKLLACFYLLKMVADNLNGVYILQPEVISASADGSKIT
AQDSLVVPIFQMFQDSGFQKNWSWNSFFKIHPQVVNPVQQPGHRLLILWRILYKKTLWYQ
AQLNRRVPEADSQLTEKMTHEASTVKSLLCHLQANLQSTGDCLNQTLELKSINGEECFLL
GSYEKSVQLWKKALQEIEEKGGRRTYFLQIRYYLSLLYCHLYSYNLNDAQGLCDQLAREI
LRWSQLPVKENKDFSGAAKSHFECGMVGGVHPEAAVRVVQSMARFMAAYFTNQQLCILPP
HHVNVLPPLHIKTEQSFRLIPLQHSKVASVVRDQNLSNVWTVEYALELLFIGGLVPEAVW
LAYKLGDWKTSVSIGVAFQLFCKRDSNFMRSKKKSLNLPLRMTPAQIFQEKLQCVLGQPA
SLEAKNEMGSKYKQFTDPIEEEDANLLFGSVQEVLKASVMADADILSETFQLLIDSAKDF
SKRLWGLVPFGLYLPAPPLYCPQPAILSEEDGDDLLLKAEKNNRQKVSGILQRVLLLFRA
AQCSFPVAQWYILQLRWARKVMQKIRMKGSLPSLSPFPQSLLNYCKGGIAFFRPGAAGDH
KLDEVSIRAIGCFRELCALCWMLHVRDKLSYSCRQYQKARENVKGEKDLEVEFDSCMIEH
CLSAVEWAYRMLPFSRFFNMEELIQDIILSLIGELPPIRKVAEIFVKAFPYPEDVRVPLR
DKYHSLHQRLRHCVVKGPQTEEMMSVVMHSIQKVRVKALKRVQRNIGSFEVNIWEPIEEE
KPDEAPGVDRYSLGTSLSRSTLTELGDSVVHSDADTFSEALSVEEKSRINIYQRNAPNHM
ELTSIHKPTDKRKMCNQKENPTKKEDHEKLSQNTLPVIGVWEFERDDDEYIKFLDLFLSY
ILERDLPYSRDADIPFLTSFSGKLREHELNSLLFDVHTTLKRHQSKTKSQNVFRAGSCFV
VAPESYESEKSSSLNDEYGMHLENQKLSSSVLVNQGIKPFLQYPSNEVNKNEGMSGLFGL
KQRSIYKIQDDTREKCLIQRSSNHIFWTPKSIKTRRCIFKAIQCNDINPQEDLPLALNTF
GSIGRLLEWMIRWSNRRLLCDSGITESSSEYSPVIRVKTSTAAILTSLWLLEQPYFATYK
AKNAIIKMVENRDTGCQIGPNIERESKSDAGGSVAVATPGGTEERNGQNKSCQNILNRMP
TEAKNPDIKEINDDIISITHNTKKEFIDIDENLLEVEAFTEEEMDMHISDYEEDIEESVG
GFRSPSLAICMMTLPQQLEEEFTEEVQCQREEPLETIMEEKSTEQKGMIEAFSHPGHTTP
QSMQVDTSSEISSAQISTYKEKSSSVPLLISNGVNVASQPPAPTPQKTQRNEFTAQLPDC
SESVRQMLQDEMFKLVQLQQINFMSLMQIVGSSFANLPDTQQLVQQSQSVHLGESQESNL
RGCGDVEDSNKNLKERFFIKPQSMGENAREPRKNSPHCHEGTIPSGQNSTGNVQNVPHGS
IPLCQLNGQPRKKGPIPSSQNLPSTSFYPAPAGNTHLYLLSTPSVVQKAPRLIPHAKTFS
PGDGFPLLQFKSKQEFQPLFLHTGSIPQVPFRPLPQPREAWGLSDSFQPALPQRAAQTTP
ASHLNVSQYNTEARKKEVEQKTWAETVITEIPNHVNLDQYVGQENLTPQQDSSVFIKPEK
LFDVKPGTLEISPHHSFGLPLLYLPLKPPNMFPSTSRASITVPSTPIQPIAEERKYPRLS
LLHSHLSPENRCKKTQLIPLENLIAFKQSQQKLTHNLFEQGDAGHLQLLKVKIEPPEVRQ
GKDSKKRQRRRAEKELQEKRCEKLRRKPNVTFRPENSIINNDDSEIIKKPKEQQEHCGSH
PLDDFDVPFEMLQDDNTSAGLHFMASVKKKAIGSQDASTNTDPEHEPLTAPQLLVPDVYL
NLKLSSEMSEKPWSPSIPHTVTNLELPVREEPSNDNVIKQQSDHLAVPSSAELHYMAASV
TNAVPPHNFKSQGLPKPEFRFKGQSTKSDSAEDYLLWKRLQGVSAACPAPSSAAHQLEHL
SAKLQKIDEQLLAIQNIAENIEQDFPKPEMLDLHCDKIGPVDHIEFSSGPEFKKTLASKT
ISISEEVRFLTHMDEEDQSDKKETSEPEFSITENYSGQKTCVFPTADSAVSLSSSSDQNT
TSPGMNSSDELCESVSVHPLQMTGLTDIADIIDDLIIKDGVSSEELGLTEQAMGTSRIQH
YSGRHSQRTDKERREIQAWMKRKRKERMAKYLNELAEKRGQEHDPFCPRSNPLYMTSREI
RLRQKMKHEKDRLLLSEHYSRRISQAYGLMNELLSESVQLPTLPQKPLPNKPSPTQSSSC
```

FIG. 82B

```
QHCPSPRGENQHGHSFLINRPGKVKYMSKPSYIHKRKSFGQPQGSPWPHGTATFTIQKKA
GGAKAAVRKATQSPVTFQKGSNAPCHSLQHTKKHGSAGLAPQTKQVCVEYEREETVVSPW
TIPSEIHKILHESHNSLLQDLSPTEEEEPEHPFGVGGVDSVSESTGSILSKLDWNAIEDM
VASVEDQGLSVHWALDL- (SEQ ID NO: 86)
```

FIG. 83A

```
atgtcccagctctcctccaccctgaagcgctacacagaatcggcccgctacacagatgcc    60
 M  S  Q  L  S  S  T  L  K  R  Y  T  E  S  A  R  Y  T  D  A    20 cactatgccaagtcgggctatggtgcctacaccccgtcctcctatggggccaatctggct   120
 H  Y  A  K  S  G  Y  G  A  Y  T  P  S  S  Y  G  A  N  L  A    40 gcctccttactggagaaggagaaacttggtttcaagccggtccccaccagcagcttcctc   180
 A  S  L  L  E  K  E  K  L  G  F  K  P  V  P  T  S  S  F  L    60 acccgtccccgtacctatggccccctcctccctcctggactatgaccggggccgcccctg   240
 T  R  P  R  T  Y  G  P  S  S  L  L  D  Y  D  R  G  R  P  L    80 ctgagacccgacatcactgggggtggtaagcgggcagagagccagacccggggtactgag   300
 L  R  P  D  I  T  G  G  G  K  R  A  E  S  Q  T  R  G  T  E   100 cggcctttaggcagtggcctcagcgggggcagcggattcccttatggagtgaccaacaac   360
 R  P  L  G  S  G  L  S  G  G  S  G  F  P  Y  G  V  T  N  N   120 tgcctcagctacctgcccatcaatgcctatgaccaggggtgacccta acccagaagctg    420
 C  L  S  Y  L  P  I  N  A  Y  D  Q  G  V  T  L  T  Q  K  L   140 gacagccaatcagacctggcccgggatttctccagcctccggacctcagatagctaccgg   480
 D  S  Q  S  D  L  A  R  D  F  S  S  L  R  T  S  D  S  Y  R   160 atagaccccaggaacctgggccgcagccccatgctggcccggacgcgcaaggagctctgc   540
 I  D  P  R  N  L  G  R  S  P  M  L  A  R  T  R  K  E  L  C   180 accctgcaggggctctaccagacagccagctgccctgaatacctggtcgactacctggag   600
 T  L  Q  G  L  Y  Q  T  A  S  C  P  E  Y  L  V  D  Y  L  E   200 aactatggtcgcaagggcagtgcatctcaggtgccctcccaggcccctccctcacgagtc   660
 N  Y  G  R  K  G  S  A  S  Q  V  P  S  Q  A  P  P  S  R  V   220 cctgaaatcatcagcccaacctaccgacccattggccgctacacgctgtgggagacggga   720
 P  E  I  I  S  P  T  Y  R  P  I  G  R  Y  T  L  W  E  T  G   240 aagggtcaggcccctgggcccagccgctccagctccccgggaagagacggcatggaacaa   780
 K  G  Q  A  P  G  P  S  R  S  S  S  P  G  R  D  G  M  E  Q   260 tatgaattatactgtgagatgggctccacattccaactatgtaaaatatgtgctgaaaat   840
 Y  E  L  Y  C  E  M  G  S  T  F  Q  L  C  K  I  C  A  E  N   280 gataaggatgtaaagattgagccctgtggacacctcatgtgcacatcctgtcttacatcc   900
 D  K  D  V  K  I  E  P  C  G  H  L  M  C  T  S  C  L  T  S   300 tggcaggaatcagaaggtcagggctgtccttt ctgccgatgtgaaattaaaggtactgaa   960
 W  Q  E  S  E  G  Q  G  C  P  F  C  R  C  E  I  K  G  T  E   320 cccatcgtggtagatccgtttgatcctagagggagtggcagcctgttgaggcaaggagca  1020
 P  I  V  V  D  P  F  D  P  R  G  S  G  S  L  L  R  Q  G  A   340 gagggagctcccctccccaaattatgatgatgatgatgatgaacgagctgatgatactctc  1080
 E  G  A  P  S  P  N  Y  D  D  D  D  D  E  R  A  D  D  T  L   360
```

FIG. 83B

```
ttcatgatgaaggaattggctggtgccaaggtggaacggccgccttctccattctccatg 1140
 F   M   M   K   E   L   A   G   A   K   V   E   R   P   P   S   P   F   S   M     380 gccccacaagcttcccttcccccggtgccaccacgacttgaccttctgccgcagcgagta 1200
 A   P   Q   A   S   L   P   P   V   P   P   R   L   D   L   L   P   Q   R   V     400 tgtgttccctcaagtgcttctgctcttggaactgcttctaaggctgcttctggctccctt 1260
 C   V   P   S   S   A   S   A   L   G   T   A   S   K   A   A   S   G   S   L     420 cataaagacaaaccattgccagtacctcccacacttcgagatcttccaccaccaccgcct 1320
 H   K   D   K   P   L   P   V   P   P   T   L   R   D   L   P   P   P   P   P     440 ccagaccggccatattctgttggagcagaatcccgacctcaaagacgccccttgccttgt 1380
 P   D   R   P   Y   S   V   G   A   E   S   R   P   Q   R   R   P   L   P   C     460 acaccaggcgactgtcctccagagacaaactgccccctgtccctctagccgccttgga 1440
 T   P   G   D   C   P   S   R   D   K   L   P   P   V   P   S   S   R   L   G     480 gactcatggctgccccggccaatccccaaagtaccagtatctgccccaagttccagtgat 1500
 D   S   W   L   P   R   P   I   P   K   V   P   V   S   A   P   S   S   S   D     500 ccctggacaggaagagaattaaccaaccggcactcacttccatttcattgccctcacaa 1560
 P   W   T   G   R   E   L   T   N   R   H   S   L   P   F   S   L   P   S   Q     520 atggagcccagaccagatgtgcctaggctcggaagcacgttcagtctggatacctccatg 1620
 M   E   P   R   P   D   V   P   R   L   G   S   T   F   S   L   D   T   S   M     540 agtatgaatagcagcccattagtaggtccagagtgtgaccaccccaaaatcaaaccttcc 1680
 S   M   N   S   S   P   L   V   G   P   E   C   D   H   P   K   I   K   P   S     560 tcatctgccaatgccatttattctctggctgccagacctcttcctgtgccaaaactgcca 1740
 S   S   A   N   A   I   Y   S   L   A   A   R   P   L   P   V   P   K   L   P     580 cctggggagcaatgtgagggtgaagaggacacagagtacatgactccctcttccaggcct 1800
 P   G   E   Q   C   E   G   E   E   D   T   E   Y   M   T   P   S   S   R   P     600 ctacggcctttggatacatcccagagttcacgagcatgtgattgcgaccagcagattgat 1860
 L   R   P   L   D   T   S   Q   S   S   R   A   C   D   C   D   Q   Q   I   D     620 agctgtacgtatgaagcaatgtataatattcagtcccaggcgccatctatcaccgagagc 1920
 S   C   T   Y   E   A   M   Y   N   I   Q   S   Q   A   P   S   I   T   E   S     640 agcacctttggtgaagggaatttggccgcagcccatgccaacactggtcccgaggagtca 1980
 S   T   F   G   E   G   N   L   A   A   A   H   A   N   T   G   P   E   E   S     660 gaaaatgaggatgatgggtatgatgtcccaaagccacctgtgccggccgtgctggcccgc 2040
 E   N   E   D   D   G   Y   D   V   P   K   P   P   V   P   A   V   L   A   R     680 cgaactctctcagatatctctaatgccagctcctcctttggctggttgtctctggatggt 2100
 R   T   L   S   D   I   S   N   A   S   S   S   F   G   W   L   S   L   D   G     700 gatcctacaacaaatgtcactgaaggttcccaagttcccgagaggcctccaaaaccattc 2160
 D   P   T   T   N   V   T   E   G   S   Q   V   P   E   R   P   P   K   P   F     720
```

FIG. 83C

```
ccgcggagaatcaactctgaacggaaagctggcagctgtcagcaaggtagtggtcctgcc  2220
  P  R  R  I  N  S  E  R  K  A  G  S  C  Q  Q  G  S  G  P  A   740 gcctctgctgccaccgcctcacctcagctctccagtgagatcgagaacctcatgagtcag  2280
  A  S  A  A  T  A  S  P  Q  L  S  S  E  I  E  N  L  M  S  Q   760 gggtactcctaccaggacatccagaaagctttggtcattgcccagaacaacatcgagatg  2340
  G  Y  S  Y  Q  D  I  Q  K  A  L  V  I  A  Q  N  N  I  E  M   780

Gccaaaaacatcctccgggaatttgtttccatttcttctcctgcccatgtagctacctag  2400
  A  K  N  I  L  R  E  F  V  S  I  S  S  P  A  H  V  A  T  -   800
```

(SEQ ID NO: 87)
(SEQ ID NO: 88)

FIG. 84A

```
AGTGACGCGA GACGCGGGGT GTGGCTCTGC CGGCCCAGGC GCGATGAGGC   50
GGCTGCCCGC TGGGTGGCGC CGATTTCCCG GGGAGGTCCC TTCTGGGCCC  100
CCGGCGGAGG TGGGAGAGAG TCAGGCAGGA GCCGAGGCCG GGGAGCCCTC  150
TTCGTCAGCT GGTGCTCACT GCGCCGCGCC AGCGCCAGCC GGGACTCACC  200
CGCAGCTCCA TGCTTGTGCC CGGTTCGACT CGTCCATACT CCAAGAAGAG  250
GCAGCCCATG AGGCTCCCAG TCCCCACTGA GTGCCACCCT GAAGGATGTC  300
CCAGCTCTCC TCCACCCTGA AGCGCTACAC AGAATCGGCC CGCTACACAG  350
ATGCCCACTA TGCCAAGTCG GGCTATGGTG CCTACACCCC GTCCTCCTAT  400
GGGGCCAATC TGGCTGCCTC CTTACTGGAG AAGGAGAAAC TTGGTTTCAA  450
GCCGGTCCCC ACCAGCAGCT TCCTCACCCG TCCCCGTACC TATGGCCCCT  500
CCTCCCTCCT GGACTATGAC CGGGGCCGCC CCCTGCTGAG ACCCGACATC  550
ACTGGGGGTG GTAAGCGGGC AGAGAGCCAG ACCCGGGGTA CTGAGCGGCC  600
TTTAGGCAGT GGCCTCAGCG GGGCAGCGG  ATTCCCTTAT GGAGTGACCA  650
ACAACTGCCT CAGCTACCTG CCCATCAATG CCTATGACCA GGGGGTGACC  700
CTAACCCAGA AGCTGGACAG CCAATCAGAC CTGGCCCGGG ATTTCTCCAG  750
CCTCCGGACC TCAGATAGCT ACCGGATAGA CCCCAGGAAC CTGGGCCGCA  800
GCCCCATGCT GGCCCGGACG CGCAAGGAGC TCTGCACCCT GCAGGGCTC   850
TACCAGACAG CCAGCTGCCC TGAATACCTG GTCGACTACC TGGAGAACTA  900
TGGTCGCAAG GGCAGTGCAT CTCAGGTGCC CTCCCAGGCC CCTCCCTCAC  950
GAGTCCCTGA AATCATCAGC CCAACCTACC GACCCATTGG CCGCTACACG 1000
CTGTGGGAGA CGGGAAAGGG TCAGGCCCCT GGGCCCAGCC GCTCCAGCTC 1050
CCCGGGAAGA GACGGCATGA ATTCTAAGAG TGCCCAGGGT CTGGCTGGTC 1100
TTCGAAACCT TGGGAACACG TGCTTCATGA ACTCAATTCT GCAGTGCCTG 1150
AGCAACACTC GGGAGTTGAG AGATTACTGC CTCCAGAGGC TCTACATGCG 1200
GGACCTGCAC CACGGCAGCA ATGCACACAC AGCCCTCGTG GAAGAGTTTG 1250
CAAAACTAAT TCAGACCATA TGGACTTCAT CCCCCAATGA TGTGGTGAGC 1300
CCATCTGAGT TCAAGACCCA GATCCAGAGA TACGCACCGC GCTTTGTTGG 1350
CTATAATCAG CAGGATGCTC AGGAGTTCCT TCGCTTTCTT CTGGATGGGC 1400
TCCATAACGA GGTGAACCGA GTGACACTGA GACCTAAGTC CAACCCTGAG 1450
AACCTCGATC ATCTTCTGA  TGACGAGAAA GGCCGACAGA TGTGGAGAAA 1500
ATATCTAGAA CGGGAAGACA GTAGGATCGG GGATCTCTTT GTTGGGCAGC 1550
TAAAGAGCTC GCTGACGTGT ACAGATTGTG GTTACTGTTC TACGGTCTTC 1600
GACCCCTTCT GGGACCTCTC ACTGCCCATT GCTAAGCGAG GTTATCCTGA 1650
GGTGACATTA ATGGACTGCA TGAGGCTCTT CACCAAAGAG GATGTGCTTG 1700
ATGGAGATGA AAAGCCAACA TGCTGTCGCT GCCGAGGCAG AAAACGGTGT 1750
ATAAAGAAGT TCTCCATCCA GAGGTTCCCA AAGATCTTGG TGCTCCATCT 1800
GAAGCGGTTC TCAGAATCCA GGATCCGAAC CAGCAAGCTC ACAACATTTG 1850
TGAACTTCCC CCTAAGAGAC CTGGACTTAA GAGAATTTGC CTCAGAAAAC 1900
ACCAACCATG CTGTTTACAA CCTGTACGCT GTGTCCAATC ACTCCGGAAC 1950
CACCATGGGT GGCCACTATA CAGCCTACTG TCGCAGTCCA GGGACAGGAG 2000
AATGGCACAC TTTCAACGAC TCCAGCGTCA CTCCCATGTC CTCCAGCCAA 2050
GTGCGCACCA GCGACGCCTA CCTGCTCTTC TACGAACTGG CCAGCCCGCC 2100
CTCCCGAATG TAGCGCCAGG AGCCACGTCC CTTCTCCCTT CCCCGTGGTG 2150
GCCCCGCTCC CTAAATTTTT TAAAAAGACA AAAACAAAAC AACAACAACA 2200
ACACACAAAC CTGACAAGAG AAAAACAAAC CTGAAGCTGC CGAGCAGGAG 2250
TGGATGCAGC CTGATCAGGG TCTGGAGCAA GGAGCCGGGC TTTCCTGAGC 2300
TGTGGCCCGG CAGGGAAGAT CGCCTGGACG TGGAGCCAGC ATCGCCCGT  2350
GCCCTCGGCG TTTGCATTTG TAAACTTGTG GTCTTCCTAT GTGTCAGAAA 2400
CAACTGTGTC TTGGGGGGA  AGACCCTCGC TGCGCCGCTT CCCGCCGCAG 2450
CGCCCGCGCC TCCGAGGGGA CAGCGCCCTC TGGAGCTCGC TGGGAGCATC 2500
ACCGCCTGGA CGCCCGCGCC GCGGAGGAGC CGGCGCCCAT CTCCACCCGC 2550
ACGGCTGCCC GGTCCAGAGC CATGAGCCAA GAGCCCTCTT CACGCTGCTA 2600
ACTCCAGGGG ACAGACGAAG GGACATCTTT GGAAAACGCT GGTTTTGGTT 2650
TTTAAAAAGC CCAACTTTTT TTTTTAATT  TCCATAACTA AAGTGTTCAG 2700
```

FIG. 84B

```
ACTGGAGTGC TCTCCTTCAG GCCTCTTCAT AGCTGGGACG TTGCACTGGT  2750
CCTTTTATTG CTTTTCCAAG TACAACTTTC TAATGCTAGC CCTCCGTGGT  2800
GCTAGGTGGG CGTTGGCCAG GCCCCAAGCA CAGCCACAGT AGACCTGGGA  2850
TCTAAAACAA GTTTCTGTTT TGGGGGTTTG GGTTTTTTTT TTTTTTTTT   2900
AATGTTTTGA ATGGAATTTA GTTGCCTCCA AGAATTGTGC CTTATAGCAT  2950
TTGGGGACCA GGGGGTAACT GCCCCTCCTG AAATATCCCT CAGCCTCTTC  3000
CCTTTTCCCC AGTGCTCTGT TCAAACCCGC CTGGGAAAGG GATCCTGCCC  3050
TTAGCCCTGG CTCGTTGTGC ATTGCAGTGA GGCAAAGAAG AAAGCAGGTA  3100
GATTCCTTCC GACAGGGCAT CAAGTTCTTC CCGCCCACGT CCTCTAGCCC  3150
ACCCCTGGTC TGCTCCCCAG CTGTTTGAAG GATAGCACAA GCCCCTCGTC  3200
CCTAGAGCTT CTCTCCCTTT TATTTATTCT CTTAACATCC CTTTCCCCCT  3250
GGCCTTCCTG CCCCCGCCCC CTTCTCAGAG CCTCCTAGAC AATAGGCCCT  3300
TTGGACCGAG TTTCTCAGGG ATGCCCAGGC CACCCCTCAG CTCTTCTTAG  3350
CGCTGGTCTC CAGTCCTGCC CTGGGAGCTG GAGCCTGGGT ATTTGGGGAC  3400
ATCTTGCCTC AGTTGTATGG TTCTTTCCTG TGGGCTCAAT TTTGCCCTAC  3450
ATAGTTGGAT AAAACTCTGT GCTGTCCTGG AGAGTAAAGC TGTTCACCCA  3500
CACAGCTGGG CCCGGCTTGT GCCCCGTGGA GCCTGGCACA TTCCAGGCTC  3550
CTAGGAGGAG GCATCAGAGA AAGACACCCT GAGTTTTACT GGCCTGACAC  3600
CCTTCTCCAG AGAAGACCTG TGAACCTGAG CCCAAGGGCA AGTGTACACT  3650
TGTTTACTGT GTAAGCAAGA GTAGAAGAAT GTCTAATGTA CAGTGGAACC  3700
TTGTACAGAA TAAATAATAG CTTTGAGAAA TCAaaaaaaa aaaaaaaa
(SEQ ID NO: 89)
```

FIG. 85

```
MSQLSSTLKRYTESARYTDAHYAKSGYGAYTPSSYGANLAASLLEKEKLGFKPVPTSSFL
TRPRTYGPSSLLDYDRGRPLLRPDITGGGKRAESQTRGTERPLGSGLSGGSGFPYGVTNN
CLSYLPINAYDQGVTLTQKLDSQSDLARDFSSLRTSDSYRIDPRNLGRSPMLARTRKELC
TLQGLYQTASCPEYLVDYLENYGRKGSASQVPSQAPPSRVPEIISPTYRPIGRYTLWETG
KGQAPGPSRSSSPGRDGMNSKSAQGLAGLRNLGNTCFMNSILQCLSNTRELRDYCLQRLY
MRDLHHGSNAHTALVEEFAKLIQTIWTSSPNDVVSPSEFKTQIQRYAPRFVGYNQQDAQE
FLRFLLDGLHNEVNRVTLRPKSNPENLDHLPDDEKGRQMWRKYLEREDSRIGDLFVGQLK
SSLTCTDCGYCSTVFDPFWDLSLPIAKRGYPEVTLMDCMRLFTKEDVLDGDEKPTCCRCR
GRKRCIKKFSIQRFPKILVLHLKRFSESRIRTSKLTTFVNFPLRDLDLREFASENTNHAV
YNLYAVSNHSGTTMGGHYTAYCRSPGTGEWHTFNDSSVTPMSSSQVRTSDAYLLFYELAS
PPSRM- (SEQ ID NO: 90)
```

FIG. 86A

```
TCCGCCCGGA TAGCCGGCGG CGGCGGCGGC GGCGGCGGCG GCGGCGGCCG  50
GGAGAGGCCC CTCCTTCACG CCCTGCTTCT CTCCCTCGCT CGCAGTCGAG  100
CCGAGCCGGC GGACCCGCCT GGGCTCCGAC CCTGCCCAGG CC*ATG*GCCGG  150
CAACGTGAAG AAGAGCTCTG GGGCCGGGGG CGGCAGCGGC TCCGGGGGCT  200
CGGGTTCGGG TGGCCTGATT GGGCTCATGA AGGACGCCTT CCAGCCGCAC  250
CACCACCACC ACCACCACCT CAGCCCCCAC CCGCCGGGGA CGGTGGACAA  300
GAAGATGGTG GAGAAGTGCT GGAAGCTCAT GGACAAGGTG GTGCGGTTGT  350
GTCAGAACCC AAAGCTGGCG CTAAAGAATA GCCCACCTTA TATCTTAGAC  400
CTGCTACCAG ATACCTACCA GCATCTCCGT ACTATCTTGT CAAGATATGA  450
GGGGAAGATG GAGACACTTG GAGAAATGA GTATTTAGG GTGTTTATGG  500
AGAATTTGAT GAAGAAAACT AAGCAAACCA TAAGCCTCTT CAAGGAGGGA  550
AAAGAAAGAA TGTATGAGGA GAATTCTCAG CCTAGGCGAA ACCTAACCAA  600
ACTGTCCCTC ATCTTCAGCC ACATGCTGGC AGAACTAAAA GGAATCTTTC  650
CAAGTGGACT CTTTCAGGGA GACACATTTC GGATTACTAA AGCAGATGCT  700
GCGGAATTTT GGAGAAAAGC TTTTGGGGAA AAGACAATAG TCCCTTGGAA  750
GAGCTTTCGA CAGGCTCTAC ATGAAGTGCA TCCCATCAGT TCTGGGCTGG  800
AGGCCATGGC TCTGAAATCC ACTATTGATC TGACCTGCAA TGATTATATT  850
TCGGTTTTTG AATTTGACAT CTTTACCCGA CTCTTTCAGC CCTGGTCCTC  900
TTTGCTCAGG AATTGGAACA GCCTTGCTGT AACTCATCCT GGCTACATGG  950
CTTTTTTGAC GTATGACGAA GTGAAAGCTC GGCTCCAGAA ATTCATTCAC  1000
AAACCTGGCA GTTATATCTT CCGGCTGAGC TGTACTCGTC TGGGTCAGTG  1050
GGCTATTGGG TATGTTACTG CTGATGGGAA CATTCTCCAG ACAATCCCTC  1100
ACAATAAACC TCTCTTCCAA GCACTGATTG ATGGCTTCAG GGAAGGCTTC  1150
TATTTGTTTC CTGATGGACG AAATCAGAAT CCTGATCTGA CTGGCTTATG  1200
TGAACCAACT CCCCAAGACC ATATCAAAGT GACCCAGGAA CAATATGAAT  1250
TATACTGTGA GATGGGCTCC ACATTCCAAC TATGTAAAAT ATGTGCTGAA  1300
AATGATAAGG ATGTAAAGAT TGAGCCCTGT GGACACCTCA TGTGCACATC  1350
CTGTCTTACA TCCTGGCAGG AATCAGAAGG TCAGGGCTGT CCTTTCTGCC  1400
GATGTGAAAT TAAAGGTACT GAACCCATCG TGGTAGATCC GTTTGATCCT  1450
AGAGGGAGTG GCAGCCTGTT GAGGCAAGGA GCAGAGGGAG CTCCCTCCCC  1500
AAATTATGAT GATGATGATG ATGAACGAGC TGATGATACT CTCTTCATGA  1550
TGAAGGAATT GGCTGGTGCC AAGGTGGAAC GGCCGCCTTC TCCATTCTCC  1600
ATGGCCCCAC AAGCTTCCCT TCCCCGGTG CCACCACGAC TTGACCTTCT  1650
GCCGCAGCGA GTATGTGTTC CCTCAAGTGC TTCTGCTCTT GGAACTGCTT  1700
CTAAGGCTGC TTCTGGCTCC CTTCATAAAG ACAAACCATT GCCAGTACCT  1750
CCCACACTTC GAGATCTTCC ACCACCACCG CCTCCAGACC GGCCATATTC  1800
TGTTGGAGCA GAATCCCGAC CTCAAAGACG CCCCTTGCCT TGTACACCAG  1850
GCGACTGTCC CTCCAGAGAC AAACTGCCCC CTGTCCCCTC TAGCCGCCTT  1900
GGAGACTCAT GGCTGCCCCG GCCAATCCCC AAAGTACCAG TATCTGCCCC  1950
AAGTTCCAGT GATCCCTGGA CAGGAAGAGA ATTAACCAAC CGGCACTCAC  2000
TTCCATTTTC ATTGCCCTCA CAAATGGAGC CCAGACCAGA TGTGCCTAGG  2050
CTCGGAAGCA CGTTCAGTCT GGATACCTCC ATGAGTATGA ATAGCAGCCC  2100
ATTAGTAGGT CCAGAGTGTG ACCACCCCAA AATCAAACCT TCCTCATCTG  2150
CCAATGCCAT TTATTCTCTG GCTGCCAGAC CTCTTCCTGT GCCAAAACTG  2200
CCACCTGGGG AGCAATGTGA GGGTGAAGAG GACACAGAGT ACATGACTCC  2250
CTCTTCCAGG CCTCTACGGC CTTTGGATAC ATCCCAGAGT TCACGAGCAT  2300
GTGATTGCGA CCAGCAGATT GATAGCTGTA CGTATGAAGC AATGTATAAT  2350
ATTCAGTCCC AGGCGCCATC TATCACCGAG AGCAGCACCT TTGGTGAAGG  2400
GAATTTGGCC GCAGCCCATG CCAACACTGG TCCCGAGGAG TCAGAAAATG  2450
AGGATGATGG GTATGATGTC CCAAAGCCAC CTGTGCCGGC CGTGCTGGCC  2500
CGCCGAACTC TCTCAGATAT CTCTAATGCC AGCTCCTCCT TTGGCTGGTT  2550
GTCTCTGGAT GGTGATCCTA CAACAAATGT CACTGAAGGT TCCCAAGTTC  2600
CCGAGAGGCC TCCAAAACCA TTCCCGCGGA GAATCAACTC TGAACGGAAA  2650
GCTGGCAGCT GTCAGCAAGG TAGTGGTCCT GCCGCCTCTG CTGCCACCGC  2700
```

FIG. 86B

```
CTCACCTCAG CTCTCCAGTG AGATCGAGAA CCTCATGAGT CAGGGGTACT 2750
CCTACCAGGA CATCCAGAAA GCTTTGGTCA TTGCCCAGAA CAACATCGAG 2800
ATGGCCAAAA ACATCCTCCG GGAATTTGTT TCCATTTCTT CTCCTGCCCA 2850
TGTAGCTACC TAGCACACCA TCTCCCTGCT GCAGGTTTAG AGGACCAGTG 2900
AGTTGGGAGT TATTACTCAA GTGGCACCTA GAAGGGCAGG AGTTCCTTTG 2950
GTGACTTCAC AGTGAAGTCT TGCCCTCTCT GTGGGATATC ACATCAGTGG 3000
TTCCAAGATT TCAAAGTGGT GAAATGAAAA TGGAGCAGCT AGTATGTTTT 3050
ATTATTTTAT GGGTCTTGAG TGCATTTGAA GGTGTCCTTC AGTTCCCACG 3100
TAGAGAGAGT GTGGATTATA TTACATGATA ACCTACCTGG GGAACAGTCC 3150
AGAAAGCTAT AGAACAAGTA TTTTGCTGGA AATCCTAATT GAGGACTTAA 3200
GACTTCCTGG GTTAAGGATG TGGCCGTGTG TGTGTGTGTC TGCCTGTGGT 3250
TGTATGTGTC CTTGTGATTA TAAGATTAAC CTGCTGTGTG TGTTAATTCC 3300
AGGCAGGGAA TTAGCACAAA AGGTTTAGGA AGGAATCTTT TTTTAAAGAC 3350
TTCCATCTAC TGTGGTATTA TACCCAAGCC TAGTGTGTAT TACAACTTCA 3400
ACACTCCCCT TTGGCTTATA TTACCATGTG CATAGCTAAA GTCTTCTATT 3450
TTTAGAACAC CTTCTGTCTG TTCTTTCCCC ATCAACTCCT TCCTCATCCT 3500
TCTTGGTGTT CTGTCATGGG CCATGGGCTT GCTATGGCCA GCCTTACTGA 3550
GGCCAAGCAG CTTATGGGAT GTTCTTTATT GTGTGTGATG GTATTGGTTT 3600
GTTTGGTAGA TAAGTGGGAG GAAAAGTACT GTTGCTACAC TATTATAGGC 3650
ATGTTTGATA CTAGCAGCTA ACACTGGTCA CTCCAAAGCA CTGTTTCTAT 3700
AGGAACATTG AAGCTATTAA GATGTTTTGA TTATCCTAAT TACATAATGA 3750
CCGATTTGAG ATAGAGGCCT TTAAATACAT TCCATGCCCT CCCCAGAAAA 3800
TAGTCTGTGG GAGTCAGTTG CCTTGGTGCC AGGTATGTGT TCTGATGTAG 3850
GTCATGAGTC TTTCTACTTA ATGGGAAGGG AAGAACATTT GTTTCCAGGA 3900
TGACTTTCTG GCCAGAATAC CGGAAAGCTT TTAGGAAGCT TCGTTCACAT 3950
GCTATTTAAA TGCACAAAAT AGACAGTAAG GATTATCTG TTCAGTTTTT 4000
CTTCCCAGTG AATTAATTTC AGCTTATATG GGTGTCTTCA TTTGAACATG 4050
AGGAATATTA GGTTATATTT TCAGCAGTGG TTTTTTCCTT TGCCCTTTAA 4100
GGAGTGGGGA TAATGTCCAC GGTGGCCCAG CCTCTTGCTG ATGGCACCTT 4150
CCCTGCATTG CTGCCTCCCG ATGATGTGGT TCTTTTCTTG TGCCTGTGGC 4200
TTTGGGAATG TAACATCTCT TTCCTCCTTT CCTTCCCTTT TCCTCTTCAC 4250
CTGAGGTCCT AAATACTCTC TGTAATTACT GTGTTCTTCA CGGTAATTAG 4300
ACATCATTCA GTGAATAAAT TACTGTAGTC AAAGACAGTA TGGGCTGGCA 4350
GTTTGTGTAA TTGCAAGTTC ATAAAGAGAA TTGAGGGTCC AGTTGGGAGA 4400
ACTATTAGTC AGTTCTTTTA TATGCTGATA AATGATCCCT CGAGTTCAGT 4450
TAGTATTCTG TCCAGAGTGT TTAGCTCACT TTCTTAGCAG TGTGTAAGCT 4500
TTCTCCATGT CAGAAGCAAG CCTGCTCTTT GATAAATCTG TCTTCCTGAA 4550
AATCTAAATC ATGCTTTTGT CTTTAGATCT ACACAGAAAT GACCCTCCTT 4600
GGATCAGTTT TCTTTCCAGT CTAATCATCT TTGGAACTAA AACTTGTTCT 4650
AACTCGTCTC TTGGCATTCA GCTACTCCTA GATCTTTTGG TTTTATCCCC 4700
TGGCCTCAGA GCCATTTATA TTCCCAGAGT AGGCAGTACA GGATCTCGTG 4750
TTGATTTGCT GTGGTTACCC AGTGTCTTCT CTACATGGCA TAAAGCGGCA 4800
AAGCCCACCA TTAGGTGAGG CGGTCCCGAG TTGAGGTAGA GTGGGGCAGA 4850
GGAAGATGGC AGTGAATATC AAACAGTAGA CCGCCATCAA CTTCTAACAG 4900
CCAGTACACA CACTGTTTCA TTTTGAGGTA ACGTTCAGTT TTGCATTTTG 4950
TTTAAATATT GAAGGCCTAG ACAAAGAACT AGAAAAAAAA AAGCAGTTTC 5000
CAGGCCCATC CATATTGTAA TTTTTCTTTA TCTGCAGATA TTGCCTGTAG 5050
TCTAAAGATC TCTTTGGAAG ACAAAGCATT GGCTATATAT CTTTTGCCTT 5100
TTCCATGCAT CTAAATCTTC TCTGGAGATT ATCTCCCTAC TGTGTAGGTT 5150
AAGGGCAGTC TCGACTTTTC CTTTTTTGAG TCCTGTGTGG CTCTTTGAAT 5200
CAGCGTGAAA CTGAGGCTCC AGCTCCCTGT GTTGTGTGTG TGTGCCATCC 5250
ATGGGCTTGG GTGTCAGTTT GTCACAGGTA TCTGCCAGCA TTCAAGGTTT 5300
TGGATCATTT CATGAGGATC TTTCCTTTGA CTGGGTGCTG TGAGGACACA 5350
CCTGGGTCTG TGCCTGAGAT TGCCAGGCAA GATTAAGGAA AGTTTTCATG 5400
```

FIG. 86C

```
TGGCTTTTGT TTTGAGGTTA TTCTCAAAAC CTTAATTTCT TATATTTTCT 5450
GTTGACTAAG GCACCAGTAA CCCATTCTTC ACCCTCCATT TGTATGGCAA 5500
TTTAAAAGTC TTTGGCTTTG CTCTGAATTT AATTAAAACT GCCTTTTATG 5550
AACAGACTTC GAGTTTTGCC ATTTTGGGCA AGCCCTTCCG CTTGTCCCTT 5600
CCTAGTGGCT AATAAAGTAA AAAAACCCAC ACTACTTTGT TCTCTTTTTC 5650
TCATATTCAT TGGGCTGTTG TATTCAGCCA GTCTCATGCT TTCCCTGGGT 5700
CTTCACGGAT TGCTTTCCAA GCTGCCTTGT TGCGGGGTTG CTGCAGAGCA 5750
GCAACTGGAC CTTTCCAGCT GTCGCCATGT TCCTTCCACT AAAGTAGAGG 5800
GTTCTTAAAA TGGAAAAACC TGTGGGCTCT TCATATACCT CCCTTTAGTT 5850
AAGTAATAGA CCAGGCAGCT TCTCATCTCA GCATTTACCT GTTAATATTT 5900
TTGTGAATAG TGCTCTCTAC CTGTGGGTGG CCGTTCTCTT CCACTTGCTC 5950
GTCTCCCCCC AGCCCCATTC TGCATAATCT ACCATTCTTC TCCTCTCTTT 6000
CTCTTCTTAT ACAGACCCTC ATTACTGGGG CCCAAGATGT GGGATACTAC 6050
TGTTAGTATT ATTTAACTAT TTGTAGATT TAAAAGATTT CTGGTTAAGG 6100
GAGGTGGGGG TCACTGTTCA TCACTCTTAA AATATGTGTT TTCTCTATAG 6150
AAAAGTAAAA TGTGTTTATG GTCCCAAACA GTCAACTCAC AAATTTTAT 6200
AACAAAATTT CCTTGTAAAA ACTAGGGACC ATCTATATAT TCCCTTTAAG 6250
ATCTAGTTCT TTTTGTAGGT GTTCAGCAAT GGTGATAAAG CAGAATATTC 6300
TCCTACCTCA CGTCATTAAA GTCAGAAGAT TATAGACCTT CTCAAACTAT 6350
AAGTCCCTCT TCTTGCCGTT GGCCTTTCTG ACTCTGGAAT GACCACTGTT 6400
CATTGAAAAA TAGTTTTCTG ACTATTGGTC TGGCTCTAAC AGTTTGTTTG 6450
TTCATCCAGC AAATGTTTAT GAGTGATGAC CATGTGCCAG AAATGTCAGG 6500
TATGTGTCCT TCCCTTGGCG CCACATAGTA GTTACTAAT GTTTGGGGGA 6550
TTGTACTTGG ACTGTCATAG CCTCTGCGTT TGACCTTAAA ATAGCTCTTC 6600
CCAGTAAGAT TGTGCAATTT TTATTCACAG CTCTTCCATG TAGACTTACC 6650
TTTCCTCATA GAGCTATCCT GGTTAATAAC AGGCCAAGAT TCTCCCATTA 6700
TCCCCTGTTG TCTCCTGTAG CTTTGATAAT GCCTGGGAGA TTCCTTGGTG 6750
TAAGTGTCAT GGATACCGAC TGTTTTATG TTGGAATTTG TTCCAACATA 6800
ATTAGAATCT GTTTGGTGAG TTGAAAGGTA AGTTGGCTCA GAGTTGCACA 6850
GTAGGGCATT AAATGTTTAA GCAAAGCATC TGCCCACACT CCCCTTTCCA 6900
ATCTAGTGCC TTCCTTGAAC TTTTTCCTGA GCTGCTACGT CCCTAATCCC 6950
CCTTGTTGGG AGGATTTTCG TATCACCCTT ATGGGACCTG TCACCATGTC 7000
CTGTACTATT TGGAATTGGT TTTCCAGTCT TTCAACAACC GTTGTGGCTA 7050
ACTATGTTTT AGAAGGGCTG GAGGTGTGGG CCCTGTCTTC GGGTCTCAGG 7100
ACCCAAAGAT CCTTTAGTCA GTTGTTGGGT CTTCCAAGAG CCAGACATTA 7150
ATACAGATTG AACTCCATCA GTCCCTAAT TGTCAGCCTT TACCTCCCTC 7200
CCAGAGCAAG GAGTTTAGGG ATTCTAAAGC TTAGTGTCCA CACATCATTC 7250
TACCAGACCT TAGAGCTTTA GAAGCTCAAT CTAAAATACT GTAACTCAGC 7300
ATAAACTATT ACTATCACTC CTTTGAACTC AGTCTCCATG AGCAGTGTTT 7350
TGTTGGAAAT ACATAGAACG GCTTAATGCC TAGAGGGTGG TGGATAGTGA 7400
AGGACGGTCA AGGTTATATT TTTGACTGCT TAGGGATTCT TTGGATCCAA 7450
GAAACAGAAA TGTTCAAGCG GAATAAAGGA GGGAGTGGAG TTGTGGTAAG 7500
GATGCAGGGT ATTTCGCAGA ACCCAGGACG GGAAGTGCCT TTGGTTCTTG 7550
GGTGGAGCTG GAACTGCAGA GCTTTGCACC TAGTCCTTTC TCCCGCTTCA 7600
CAGTCTGCTT ATGGTATATG TGGCCCCAA ATAGGCACTC TAGTCCTCAA 7650
GTCTACACCA CCTTCCAACT CTGGGGATCA CCATGAACAA ATTCTCAATT 7700
TCCCATACTT AATTTTTTT TTTTTGAGA TGGAGTCTCG CTGTGTCGCC 7750
CAGGCTGGAG TGCAGTGGTG CAGTCTCAAC TCACCACAAC CTCTGCCTCC 7800
CAGGTTCAAG CAGTTCTCTG CCTCAACCTC CCGAGTAGCT GGGATTACAG 7850
GCGCCTGCCA CCATGCCCAG CTAATGTTCA TATTTTAGT AGAGACAGGG 7900
TTTCACCGTC TTGGCTAGGC TGGTCTTGAA CTCCTGACCC TCATGATCCA 7950
CCCACCTCGG CCTCCCAAAG TGCTAAGATT ACAGGCGTGA GCCACCGCGC 8000
CCGGCCCATA CTTCGTATTC TTAAAAAAAA CTACACTCAG CCCAGCACAT 8050
TGATCAAGTA TCTATCTCTG AGCAGTTGGC CTTGCCAGGG AGAGCAGAGA 8100
```

FIG. 86D

```
TGTGGCAGGC TCCTTCAGCT GGAGACAGGG AGCTTCTCAG AGAAGTGAGC    8150
AGAGACTCCA CAGACACCCT AAAAAGGCTT CTACTCAAGA AGTAAAGCCA    8200
CTACTCCTGC CTTTTTGCTT AGTGGACAGG AAGGCACAGG AGTTTGTCTG    8250
GGACATCATA GAAATTCTTA GGTTTAACTT AATTCTGGTC ATTGTCTTCT    8300
TTATTTCCTG TTTTTCTTCC CTTTGTCAGT CTTCGCATCC AAGATTTCTT    8350
CCCTCCCTCT TGTGGGCCAG CCTGTCCTGT TCCAGAGCTA GCCTGTTCCT    8400
GGGTAGCCTT CCTTAGCCTC CATTCAGCCT CAGGTCTTTT GCCTTCTTCC    8450
GTGTTTATTT AGAGAGCAGA ATCTAATAAC GGGTTCCACT GTAGCCACTA    8500
TCCATGGACT TCTGGGTCCT CTTCAGGTTT GAGTGCTTGA AAATGTTCAT    8550
TCTCTGGGCT TGTGGCCTGT CTCCTCCACT CTCCTCCTCA CCCTCTCGCT    8600
CCTTCCTGTG TGAGGGCCGC TCTGCAGTAA TGTTCTCAGG CAAGCCTTCC    8650
TAGGCACCTC AGAAACTACT TTGCCAGAGC CAGTAAGAAT ATATAATATT    8700
GGAGCAGTTG CCAGGATAGA AATTAAATAT AGATTCCAGT TTAGGATAGA    8750
GTTTTTACCG AGAGCTCTTT AGACAGTATA CCTGTGTCTT CTCTGGCAAT    8800
TGCTTTCATT TTAGTCCTAT ATAAAAGCTT TCCTTTTCTG TTTTTTTTA     8850
AAACTATGCT TTTGCTTGCC TAAATCTTTT GATCTTATAT TTCTCTCATC    8900
TCAGAGCCTG TCCTGAGTTG TAAGGTATTT CATACTGCCT TACTTAAAAG    8950
TTTTTAAAC TACTAGAGTC ATTTGATACA CACAGAAGTT ACCTAATAAT     9000
CCAAAGATGT CCATCAAGGG AGGAAGGGTG GGTCATCAGA CTTTGCCTTT    9050
GATGTTGTAG ACTAGGCTCC TGAGTTAAGC AGCAGAGGGA CAGCAGTGCC    9100
ATGTGCCTTC ACTGTGTCCC AGGAAATCTG GGTTGGTTCC AGTGGGAAAT    9150
ACCAGTATTT CTTGGTTCTG GAAAGTAGCA AAAGAGTAGG AGATGGGGAA    9200
ATAGGGATGG GGAGAGCAAG CCCCGCATGT CCATGGCGAG TCAGGTGGGG    9250
AGCACGGGTG GAAGGGCCGG CTGTTGACAG ACAGACTAAG CTGTGTGGTG    9300
CTCTTGCCGC CCCTTCCTGG GTACAGAGCT TGAGAAAAAT GCAGCCGACC    9350
ACTCCCTGTG TTTGTACAGA GCAAAGCCCA AAAGCCAACC TCAGATCTCC    9400
TGATTTGGCA GCTGAAGAAA TCAGCAGAGT CCTGATTGCC TGATTCAGTC    9450
CCAAAAATGA ATGTCAGGCC CCGCCCCCTC CCCACCAACA TTGCCTCTCC    9500
TACATTCTCC TTCTGCCCCT AAATCAGACA GGAGGCCAGA GAGGAGTATT    9550
GCTCAATGCG TGCTATGTGC AACTCCTCAG GCCTTGTGCC ACCTCCATGC    9600
TGAGCCCTGA AGCAGGGTGT CCTGGGTGCC TGTGTGTCAG CTCCCTCCTC    9650
TCTACCTACC TCTGACCTTC TTGTGGGTGA GGGTGGCCAT GCTTATGGCC    9700
ATCTTAAAAC TGGAGAGGCA GAGAACTACT TATGAGTCTG TAGACCACGT    9750
GTTGTCTTCC ATGGCCTGTT TCTCCTGCTG TCTGGGTGAG TGAGCCTGCA    9800
ACGCAATGCC CATGAGAGTA AATGCCTCCT GACCTACCCT GCTCAGCACT    9850
GTTCTAGTGT CTTGGCCTTG AAAGAAAAGC CTGACTTCCT GCTGACACAT    9900
GTGGTAGGGG CATGGCAGCT ATGAGGCACC TCCTACGTCT GTTTTCTGGC    9950
TGTGGTGACT TGGGATTTTT AACCTTATAT ATCTTTTTCC TTTACTCAAA    10000
ACAAAACAAT TTTTAGCACA CTGAAAAAAA AAAAAGCCA AATGTTTTGT     10050
GCCTTTCTAA GGCAGCACTG TATCCCAGGC TGCATTTTAG GACTTAATAT    10100
GGAAATACCA GAGTCTGAGC TCCTCTACCT TGAGTTTCAT TAGTCCTTAG    10150
TGTCTAGGAG ACAGGAAAGA ATGCTCTCTG TGACTGGAGA GGTGACATGC    10200
AGGTGCAGTG TGTCTGGAGT CCCTTTCCCC TGCTGTGAGA CTTCAGTGGA    10250
GGAGAGAAGC ATTGTACCCT GGGATCATTT GGTTGGTTCC AATCACAAGC    10300
TTAGTTATCA GGTTGCATGC CTTGTCTCCT GCAAAGACA GAATGTTTCA     10350
CAATTCCCAG GTAAACTCTG GACCATTCCA AGTGTCCTAG CCTTCTGATG    10400
ACATTAATTA CCTAGTTGTG TCGAGGAGTA TAGGATGGAC TCTCCTGAGA    10450
AGGGGAGGTT GGTGGCTTTG TCTTTTCTTT TTGCTGGATC CTGAACTGGT    10500
CTAGACCTCC TGCCCCCACC CCCCAGCCCC CATCAGATGT GGCTGGCCTT    10550
TCATTTGAAG GCTTCAGACT TAAAGCATTA AGCAGCTAGT GCCCTCTGCA    10600
GGGCCTGGTT TCCCCAGGGA AGGGCAGCAA GGAACATGGG ACCAGAAGCC    10650
TGTCCTCAGT AATGTGACTA TAGTGAGCTT TAGCAAAAGT TTTTCTATAT    10700
AATGACATCT TACTTATCTT TTACCCTTTC CTCAGTTTTC CCTGCCTTT     10750
AACTAATAAA GAATTGGGAG ACAGAAATTT TAAAGTCCTC CTTATTCAAG    10800
```

FIG. 86E

```
ATTTTGAAAT TCTTAGCCTG GGAGTGCTGG AGAGAACCTG ATGCTTTCTC  10850
CAGAATGAAG AGTCCCAATT TGTATATCAG TGTTAAGAAG AAAACAAAAC  10900
AAACACATAG GTGAGATTTT CGTGGACTAT TTTAAAAATG TGTCATTAAT  10950
ATAAAAAATT TATATTAGCA GTATTAATC ATTCTCACCT GTAAAGAATA   11000
AGAAAAACAG AAGGTAAATA TTCTTACAGA GAATAGCAGA GCTTTAAGAT  11050
TCATTTTCAT TTAAGTCCA TTTTATTTTG CCAGTGTATT AATGTTTAGA   11100
AGTCTGTTTT ACTAATGTTA TTTATTAATT TTTTTCATT TCCATACACA    11150
GTTAGTTAAC TAAAGAGCTT TTTCAAGCAC CCATGTCTGT AAAAAAATAT  11200
TTTTAAATAA AGTTTCTTTT GTTGTAGCAG Aaaaaaaaaa a (SEQ ID NO: 91)
```

FIG. 87

```
MAGNVKKSSGAGGGSGSGGSGSGGLIGLMKDAFQPHHHHHHHLSPHPPGTVDKKMVEKCW
KLMDKVVRLCQNPKLALKNSPPYILDLLPDTYQHLRTILSRYEGKMETLGENEYFRVFME
NLMKKTKQTISLFKEGKERMYEENSQPRRNLTKLSLIFSHMLAELKGIFPSGLFQGDTFR
ITKADAAEFWRKAFGEKTIVPWKSFRQALHEVHPISSGLEAMALKSTIDLTCNDYISVFE
FDIFTRLFQPWSSLLRNWNSLAVTHPGYMAFLTYDEVKARLQKFIHKPGSYIFRLSCTRL
GQWAIGYVTADGNILQTIPHNKPLFQALIDGFREGFYLFPDGRNQNPDLTGLCEPTPQDH
IKVTQEQYELYCEMGSTFQLCKICAENDKDVKIEPCGHLMCTSCLTSWQESEGQGCPFCR
CEIKGTEPIVVDPFDPRGSGSLLRQGAEGAPSPNYDDDDDERADDTLFMMKELAGAKVER
PPSPFSMAPQASLPPVPPRLDLLPQRVCVPSSASALGTASKAASGSLHKDKPLPVPPTLR
DLPPPPPPDRPYSVGAESRPQRRPLPCTPGDCPSRDKLPPVPSSRLGDSWLPRPIPKVPV
SAPSSSDPWTGRELTNRHSLPFSLPSQMEPRPDVPRLGSTFSLDTSMSMNSSPLVGPECD
HPKIKPSSSANAIYSLAARPLPVPKLPPGEQCEGEEDTEYMTPSSRPLRPLDTSQSSRAC
DCDQQIDSCTYEAMYNIQSQAPSITESSTFGEGNLAAAHANTGPEESENEDDGYDVPKPP
VPAVLARRTLSDISNASSSFGWLSLDGDPTTNVTEGSQVPERPPKPFPRRINSERKAGSC
QQGSGPAASAATASPQLSSEIENLMSQGYSYQDIQKALVIAQNNIEMAKNILREFVSISS
PAHVAT- (SEQ ID NO: 92)
```

FIG. 88A

```
atgggcgggaaccactcccacaagccccccgtgtttgacgagaatgaggaagtcaacttt    60
 M  G  G  N  H  S  H  K  P  P  V  F  D  E  N  E  E  V  N  F    20 gaccattttcagattctgcgggccattggtaaagggagttttggaaaggtatgcatcgtg   120
 D  H  F  Q  I  L  R  A  I  G  K  G  S  F  G  K  V  C  I  V    40 cagaagcgagacactaagaaaatgtatgcaatgaagtacatgaacaagcagaagtgcatc   180
 Q  K  R  D  T  K  K  M  Y  A  M  K  Y  M  N  K  Q  K  C  I    60 gagagggatgaggttcggaatgttttccgggagctgcagatcatgcaagggctggagcac   240
 E  R  D  E  V  R  N  V  F  R  E  L  Q  I  M  Q  G  L  E  H    80 cccttcctggtcaatctgtggtactccttccaggatgaggaggacatgttcatggtggtg   300
 P  F  L  V  N  L  W  Y  S  F  Q  D  E  E  D  M  F  M  V  V   100 gacctgctcctgggaggcgacctgcgctaccatctgcagcagaatgtgcatttcacagag   360
 D  L  L  L  G  G  D  L  R  Y  H  L  Q  Q  N  V  H  F  T  E   120 gggactgtgaaactctacatctgtgagctggcactggccctggagtatcttcagaggtac   420
 G  T  V  K  L  Y  I  C  E  L  A  L  A  L  E  Y  L  Q  R  Y   140 cacatcatccacagagacatcaagccagacaatatcctgctggatgaacacggacatgtt   480
 H  I  I  H  R  D  I  K  P  D  N  I  L  L  D  E  H  G  H  V   160 cacattacagacttcaacatagcgacggtagtgaaaggagcagaaagggcttcctccatg   540
 H  I  T  D  F  N  I  A  T  V  V  K  G  A  E  R  A  S  S  M   180 gctggcaccaagccctacatggctccagaagtattccaggtgtacatggacagaggcccc   600
 A  G  T  K  P  Y  M  A  P  E  V  F  Q  V  Y  M  D  R  G  P   200 ggatactcgtaccctgtcgactggtggtccctgggcatcacagcctatgagctgctgcgg   660
 G  Y  S  Y  P  V  D  W  W  S  L  G  I  T  A  Y  E  L  L  R   220 ggctggaggccgtacgaaatccactcggtcacgcccatcgatgaaatcctcaacatgttc   720
 G  W  R  P  Y  E  I  H  S  V  T  P  I  D  E  I  L  N  M  F   240 aaggtggagcgtgtccactactcctccacgtggtgcaaggggatggtggccctgctgagg   780
 K  V  E  R  V  H  Y  S  S  T  W  C  K  G  M  V  A  L  L  R   260 aagctcctgaccaaggatcctgagagccgcgtgtccagccttcatgacatacagagcgtg   840
 K  L  L  T  K  D  P  E  S  R  V  S  S  L  H  D  I  Q  S  V   280 ccctacttggccgacatgaactgggacgcggtgttcaagaaggcactgatgcccggcttt   900
 P  Y  L  A  D  M  N  W  D  A  V  F  K  K  A  L  M  P  G  F   300 gtgcccaataaagggaggttgaactgcgatccacatttgagcttgaagagatgattcta   960
 V  P  N  K  G  R  L  N  C  D  P  T  F  E  L  E  E  M  I  L   320 gaatccaagccacttcacaaaaagaagaagcgattggcaaagaacagatccagggatggc  1020
 E  S  K  P  L  H  K  K  K  K  R  L  A  K  N  R  S  R  D  G   340 acaaaggacagctgcccgctgaatggacacctgcagcactgtttggagactgtccgggag  1080
 T  K  D  S  C  P  L  N  G  H  L  Q  H  C  L  E  T  V  R  E   360
```

FIG. 88B

```
gaattcatcatattcaacagagagaatgtaccgccggaagcaccaggagctgcaagccat 1140
 E   F   I   I   F   N   R   E   N   V   P   P   E   A   P   G   A   A   S   H   380 gcagatggagctgcagagccctgagtacaagctgagcaagctccgcacctcgaccatcat 1200
 A   D   G   A   A   E   P   -   V   Q   A   E   Q   A   P   H   L   D   H   H   400 gaccgactacaaccccaactactgctttgctggcaagacctcctccatcagtgacctgaa 1260
 D   R   L   Q   P   Q   L   L   L   C   W   Q   D   L   L   H   Q   -   P   E   420 ggaggtgccgcggaaaaacatcaccctcattcggggtctgggccatggcgcctttgggga 1320
 G   G   A   A   E   K   H   H   P   H   S   G   S   G   P   W   R   L   W   G   440 ggtgtatgaaggccaggtgtccggaatgcccaacgacccaagcccctgcaagtggctgt 1380
 G   V   -   R   P   G   V   R   N   A   Q   R   P   K   P   P   A   S   G   C   460 gaagacgctgcctgaagtgtgctctgaacaggacgaactggatttcctcatggaagccct 1440
 E   D   A   A   -   S   V   L   -   T   G   R   T   G   F   P   H   G   S   P   480 gatcatcagcaaattcaaccaccagaacattgttcgctgcattggggtgagcctgcaatc 1500
 D   H   Q   Q   I   Q   P   P   E   H   C   S   L   H   W   G   E   P   A   I   500 cctgccccggttcatcctgctggagctcatggcggggggagacctcaagtccttcctccg 1560
 P   A   P   V   H   P   A   G   A   H   G   G   G   R   P   Q   V   L   P   P   520 agagacccgccctcgcccgagccagccctcctccctggccatgctggaccttctgcacgt 1620
 R   D   P   P   S   P   E   P   A   L   L   P   G   H   A   G   P   S   A   R   540 ggctcgggacattgcctgtggctgtcagtatttggaggaaaaccacttcatccaccgaga 1680
 G   S   G   H   C   L   W   L   S   V   F   G   G   K   P   L   H   P   P   R   560 cattgctgccagaaactgcctcttgacctgtccaggccctggaagagtggccaagattgg 1740
 H   C   C   Q   K   L   P   L   D   L   S   R   P   W   K   S   G   Q   D   W agacttcgggatggcccgagacatctacagggcgagctactatagaaagggaggctgtgc 1800
 R   L   R   D   G   P   R   H   L   Q   G   E   L   L   -   K   G   R   L   C   600 catgctgccagttaagtggatgcccccagaggccttcatggaaggaatattcacttctaa 1860
 H   A   A   S   -   V   D   A   P   R   G   L   H   G   R   N   I   H   F   -   620 aacagacacatggtcctttggagtgctgctatgggaaatcttttctcttggatatatgcc 1920
 N   R   H   M   V   L   W   S   A   A   M   G   N   L   F   S   W   I   Y   A   640 atacccagcaaaagcaaccaggaagttctggagtttgtcaccagtggaggccggatgga 1980
 I   P   Q   Q   K   Q   P   G   S   S   G   V   C   H   Q   W   R   P   D   G   660 cccacccaagaactgccctgggcctgtataccggataatgactcagtgctggcaacatca 2040
 P   T   Q   E   L   P   W   A   C   I   P   D   N   D   S   V   L   A   T   S   680 gcctgaagacaggcccaactttgccatcattttggagaggattgaatactgcacccagga 2100
 A   -   R   Q   A   Q   L   C   H   H   F   G   E   D   -   I   L   H   P   G   700 cccggatgtaatcaacaccgctttgccgatagaatatggtccacttgtggaagaggaaga 2160
 P   G   C   N   Q   H   R   F   A   D   R   I   W   S   T   C   G   R   G   R   720
```

FIG. 88C

```
gaaagtgcctgtgaggcccaaggaccctgagggggttcctcctctcctggtctctcaaca  2220
 E  S  A  C  E  A  Q  G  P  -  G  G  S  S  S  P  G  L  S  T    740 ggcaaaacgggaggaggagcgcagcccagctgccccaccacctctgcctaccacctcctc  2280
 G  K  T  G  G  G  A  Q  P  S  C  P  T  T  S  A  Y  H  L  L    760 tggcaaggctgcaaagaaacccacagctgcagagatctctgttcgagtccctagagggcc  2340
 W  Q  G  C  K  E  T  H  S  C  R  D  L  C  S  S  P  -  R  A    780 ggccgtggaaggggggacacgtgaatatggcattctctcagtccaaccctccttcggagtt  2400
 G  R  G  R  G  T  R  E  Y  G  I  L  S  V  Q  P  S  F  G  V    800 gcacaaggtccacggatccagaaacaagcccaccagcttgtggaacccaacgtacggctc  2460
 A  Q  G  P  R  I  Q  K  Q  A  H  Q  L  V  E  P  N  V  R  L    820 ctggtttacagagaaacccaccaaaaagaataatcctatagcaagaaggagccacacga  2520
 L  V  Y  R  E  T  H  Q  K  E  -  S  Y  S  K  E  G  A  T  R    840 caggggtaacctggggctggagggaagctgtactgtcccacctaacgttgcaactgggag  2580
 Q  G  -  P  G  A  G  G  K  L  Y  C  P  T  -  R  C  N  W  E    860 acttccggggggcctcactgctcctagagccctcttcgctgactgccaatatgaaggaggt  2640
 T  S  G  G  L  T  A  P  R  A  L  F  A  D  C  Q  Y  E  G  G    880 acctctgttcaggctacgtcacttcccttgtgggaatgtcaattacggctaccagcaaca  2700
 T  S  V  Q  A  T  S  L  P  L  W  E  C  Q  L  R  L  P  A  T    900 gggcttgcccttagaagccgctactgccctggagctggtcattacgaggataccattct  2760
 G  L  A  L  R  S  R  Y  C  P  W  S  W  S  L  R  G  Y  H  S    920 gaaaagcaagaatagcatgaaccagcctgggccctga    (SEQ ID NO: 93)
 E  K  Q  E  -  H  E  P  A  W  A  L     (SEQ ID NO: 94)
```

FIG. 88D

```
atgggcgggaaccactcccacaagccccccgtgtttgacgagaatgaggaagtcaacttt    60
 M  G  G  N  H  S  H  K  P  P  V  F  D  E  N  E  E  V  N  F     20 gaccattttcagattctgcggccattggtaaagggagttttggaaaggtatgcatcgtg   120
 D  H  F  Q  I  L  R  A  I  G  K  G  S  F  G  K  V  C  I  V     40 cagaagcgagacactaagaaaatgtatgcaatgaagtacatgaacaagcagaagtgcatc   180
 Q  K  R  D  T  K  K  M  Y  A  M  K  Y  M  N  K  Q  K  C  I     60 gagagggatgaggttcggaatgttttccgggagctgcagatcatgcaagggctggagcac   240
 E  R  D  E  V  R  N  V  F  R  E  L  Q  I  M  Q  G  L  E  H     80 cccttcctggtcaatctgtggtactccttccaggatgaggaggacatgttcatggtggtg   300
 P  F  L  V  N  L  W  Y  S  F  Q  D  E  E  D  M  F  M  V  V    100 gacctgctcctgggaggcgacctgcgctaccatctgcagcagaatgtgcatttcacagag   360
 D  L  L  L  G  G  D  L  R  Y  H  L  Q  Q  N  V  H  F  T  E    120 gggactgtgaaactctacatctgtgagctggcactggccctggagtatcttcagaggtac   420
 G  T  V  K  L  Y  I  C  E  L  A  L  A  L  E  Y  L  Q  R  Y    140 cacatcatccacagagacatcaagccagacaatatcctgctggatgaacacggacatgtt   480
 H  I  I  H  R  D  I  K  P  D  N  I  L  L  D  E  H  G  H  V    160 cacattacagacttcaacatagcgacggtagtgaaaggagcagaaagggcttcctccatg   540
 H  I  T  D  F  N  I  A  T  V  V  K  G  A  E  R  A  S  S  M    180 gctggcaccaagccctacatggctccagaagtattccaggtgtacatggacagaggcccc   600
 A  G  T  K  P  Y  M  A  P  E  V  F  Q  V  Y  M  D  R  G  P    200 ggatactcgtaccctgtcgactggtggtccctgggcatcacagcctatgagctgctgcgg   660
 G  Y  S  Y  P  V  D  W  W  S  L  G  I  T  A  Y  E  L  L  R    220 ggctggaggccgtacgaaatccactcggtcacgcccatcgatgaaatcctcaacatgttc   720
 G  W  R  P  Y  E  I  H  S  V  T  P  I  D  E  I  L  N  M  F    240 aaggtggagcgtgtccactactcctccacgtggtgcaaggggatggtggccctgctgagg   780
 K  V  E  R  V  H  Y  S  S  T  W  C  K  G  M  V  A  L  L  R    260 aagctcctgaccaaggatcctgagagccgcgtgtccagccttcatgacatacagagcgtg   840
 K  L  L  T  K  D  P  E  S  R  V  S  S  L  H  D  I  Q  S  V    280 ccctacttggccgacatgaactgggacgcggtgttcaagaaggcactgatgcccggcttt   900
 P  Y  L  A  D  M  N  W  D  A  V  F  K  K  A  L  M  P  G  F    300 gtgcccaataaagggaggttgaactgcgatccacatttgagcttgaagagatgattcta   960
 V  P  N  K  G  R  L  N  C  D  P  T  F  E  L  E  E  M  I  L    320 gaatccaagccacttcacaaaaagaagaagcgattggcaaagaacagatccagggatggc  1020
 E  S  K  P  L  H  K  K  K  K  R  L  A  K  N  R  S  R  D  G    340 acaaaggacagctgcccgctgaatggacacctgcagcactgtttggagactgtccgggag  1080
 T  K  D  S  C  P  L  N  G  H  L  Q  H  C  L  E  T  V  R  E    360
```

FIG. 88E

```
gaattcatcatattcaacagagagaagggtctgggccatggcgccttt ggggaggtgtat 1140
 E  F  I  I  F  N  R  E  K  G  L  G  H  G  A  F  G  E  V  Y   380 gaaggccaggtgtccggaatgcccaacgacccaagcccctgcaagtggctgtgaagacg 1200
 E  G  Q  V  S  G  M  P  N  D  P  S  P  L  Q  V  A  V  K  T   400 ctgcctgaagtgtgctctgaacaggacgaactggatttcctcatggaagccctgatcatc 1260
 L  P  E  V  C  S  E  Q  D  E  L  D  F  L  M  E  A  L  I  I   420 agcaaattcaaccaccagaacattgttcgctgcattggggtgagcctgcaatccctgccc 1320
 S  K  F  N  H  Q  N  I  V  R  C  I  G  V  S  L  Q  S  L  P   440 cggttcatcctgctggagctcatggcggggggagacctcaagtccttcctccgagagacc 1380
 R  F  I  L  L  E  L  M  A  G  G  D  L  K  S  F  L  R  E  T   460 cgccctcgcccgagccagcccctcctccctggccatgctggaccttctgcacgtggctcgg 1440
 R  P  R  P  S  Q  P  S  S  L  A  M  L  D  L  L  H  V  A  R   480 gacattgcctgtggctgtcagtatttggaggaaaaccacttcatccaccgagacattgct 1500
 D  I  A  C  G  C  Q  Y  L  E  E  N  H  F  I  H  R  D  I  A   500 gccagaaactgcctcttgacctgtccaggccctggaagagtggccaagattggagacttc 1560
 A  R  N  C  L  L  T  C  P  G  P  G  R  V  A  K  I  G  D  F   520 gggatggccccgagacatctacagggcgagctactatagaaagggaggctgtgccatgctg 1620
 G  M  A  R  D  I  Y  R  A  S  Y  Y  R  K  G  G  C  A  M  L   540 ccagttaagtggatgcccccagaggccttcatggaaggaatattcacttctaaaacagac 1680
 P  V  K  W  M  P  P  E  A  F  M  E  G  I  F  T  S  K  T  D   560 acatggtcctttggagtgctgctatgggaaatcttttctcttggatatatgccataccc 1740
 T  W  S  F  G  V  L  L  W  E  I  F  S  L  G  Y  M  P  Y  P   580 agcaaaagcaaccaggaagttctggagtttgtcaccagtggaggccggatggacccaccc 1800
 S  K  S  N  Q  E  V  L  E  F  V  T  S  G  G  R  M  D  P  P   600 aagaactgccctgggcctgtataccggataatgactcagtgctggcaacatcagcctgaa 1860
 K  N  C  P  G  P  V  Y  R  I  M  T  Q  C  W  Q  H  Q  P  E   620 gacaggcccaactttgccatcattttggagaggattgaatactgcacccaggacccggat 1920
 D  R  P  N  F  A  I  I  L  E  R  I  E  Y  C  T  Q  D  P  D   640 gtaatcaacaccgctttgccgatagaatatggtccacttgtggaagaggaagagaaagtg 1980
 V  I  N  T  A  L  P  I  E  Y  G  P  L  V  E  E  E  E  K  V   660 cctgtgaggcccaaggaccctgaggggttcctcctctcctggtctctcaacaggcaaaa 2040
 P  V  R  P  K  D  P  E  G  V  P  P  L  L  V  S  Q  Q  A  K   680 cgggaggaggagcgcagcccagctgccccaccacctctgcctaccacctcctctggcaag 2100
 R  E  E  E  R  S  P  A  A  P  P  P  L  P  T  T  S  S  G  K   700 gctgcaaagaaacccacagctgcagagatctctgttcgagtccctagagggccggccgtg 2160
 A  A  K  K  P  T  A  A  E  I  S  V  R  V  P  R  G  P  A  V   720
```

FIG. 88F

```
gaagggggacacgtgaatatggcattctctcagtccaaccctccttcggagttgcacaag  2220
 E  G  G  H  V  N  M  A  F  S  Q  S  N  P  P  S  E  L  H  K   740 gtccacggatccagaaacaagcccaccagcttgtggaacccaacgtacggctcctggttt  2280
 V  H  G  S  R  N  K  P  T  S  L  W  N  P  T  Y  G  S  W  F   760 acagagaaacccaccaaaaagaataatcctatagcaaagaaggagccacacgacagggt  2340
 T  E  K  P  T  K  K  N  N  P  I  A  K  K  E  P  H  D  R  G   780 aacctggggctggagggaagctgtactgtcccacctaacgttgcaactgggagacttccg  2400
 N  L  G  L  E  G  S  C  T  V  P  P  N  V  A  T  G  R  L  P   800 ggggcctcactgctcctagagccctcttcgctgactgccaatatgaaggaggtacctctg  2460
 G  A  S  L  L  E  P  S  S  L  T  A  N  M  K  E  V  P  L   820 ttcaggctacgtcacttcccttgtgggaatgtcaattacggctaccagcaacagggcttg  2520
 F  R  L  R  H  F  P  C  G  N  V  N  Y  G  Y  Q  Q  Q  G  L   840 cccttagaagccgctactgcccctggagctggtcattacgaggataccattctgaaaagc  2580
 P  L  E  A  A  T  A  P  G  A  G  H  Y  E  D  T  I  L  K  S   860 aagaatagcatgaaccagcctgggccctga  (SEQ ID NO: 127)
 K  N  S  M  N  Q  P  G  P  -   (SEQ ID NO: 128)
```

FIG. 89A

```
GTCCCACATC CCGCATCCGG CATCCCAGCG GCCGGGCATG TAGCAGCGGC   50
AGCAACGGCG GAAT*ATG*GGC GGGAACCACT CCCACAAGCC CCCCGTGTTT  100
GACGAGAATG AGGAAGTCAA CTTTGACCAT TTTCAGATTC TGCGGGCCAT  150
TGGTAAAGGG AGTTTTGGAA AGGTATGCAT CGTGCAGAAG CGAGACACTA  200
AGAAAATGTA TGCAATGAAG TACATGAACA AGCAGAAGTG CATCGAGAGG  250
GATGAGGTTC GGAATGTTTT CCGGGAGCTG CAGATCATGC AAGGGCTGGA  300
GCACCCCTTC CTGGTCAATC TGTGGTACTC CTTCCAGGAT GAGGAGGACA  350
TGTTCATGGT GGTGGACCTG CTCCTGGGAG GCGACCTGCG CTACCATCTG  400
CAGCAGAATG TGCATTTCAC AGAGGGGACT GTGAAACTCT ACATCTGTGA  450
GCTGGCACTG GCCCTGGAGT ATCTTCAGAG GTACCACATC ATCCACAGAG  500
ACATCAAGCC AGACAATATC CTGCTGGATG AACACGGACA TGTTCACATT  550
ACAGACTTCA ACATAGCGAC GGTAGTGAAA GGAGCAGAAA GGGCTTCCTC  600
CATGGCTGGC ACCAAGCCCT ACATGGCTCC AGAAGTATTC CAGGTGTACA  650
TGGACAGAGG CCCCGGATAC TCGTACCCTG TCGACTGGTG GTCCCTGGGC  700
ATCACAGCCT ATGAGCTGCT GCGGGGCTGG AGGCCGTACG AAATCCACTC  750
GGTCACGCCC ATCGATGAAA TCCTCAACAT GTTCAAGGTG GAGCGTGTCC  800
ACTACTCCTC CACGTGGTGC AAGGGGATGG TGGCCCTGCT GAGGAAGCTC  850
CTGACCAAGG ATCCTGAGAG CCGCGTGTCC AGCCTTCATG ACATACAGAG  900
CGTGCCCTAC TTGGCCGACA TGAACTGGGA CGCGGTGTTC AAGAAGGCAC  950
TGATGCCCGG CTTTGTGCCC AATAAAGGGA GGTTGAACTG CGATCCCACA 1000
TTTGAGCTTG AAGAGATGAT TCTAGAATCC AAGCCACTTC ACAAAAAGAA 1050
GAAGCGATTG GCAAAGAACA GATCCAGGGA TGGCACAAAG GACAGCTGCC 1100
CGCTGAATGG ACACCTGCAG CACTGTTTGG AGACTGTCCG GGAGGAATTC 1150
ATCATATTCA ACAGAGAGAA GCTCAGGAGG CAGCAGGGAC AGGGCAGCCA 1200
GCTCTTGGAC ACCGACAGCC GAGGGGGAGG CCAGGCCCAA AGCAAGCTCC 1250
AGGACGGGTG CAACAACAAC CTCCTCACCC ACACCTGCAC CCGTGGCTGC 1300
AGCAGC*TGA*G CCCACACTTG TTGCTGCTCA ACAGGACTGC ACTCGTCTCT 1350
GCCCTGCCCA CCCAGAGCCC CTCTTTGTGC CCTGATGGTC CCTGTCTCAC 1400
CCCTGAAAAC ATCAGATGCA GAAAAGCCC TGGACTTGGA GCTGGGAAGC 1450
CTGGGTTCTG GTCCCATCTC CATGACTGAT TCACGTGTGA CCTCAGACAA 1500
GTCACGCCCT CTCTGTGCCT CCGTTTTCTG CATCTGCCAA AGGGGTTAAA 1550
CACTTCTGCC CCACTTCAAA TTACAAGATT ATGGGGAGAA CCCAATTAGG 1600
TAGGAAACAT GAAAAACCTT TGATATTTAT AAAATCATTT TTACGTGCAA 1650
AATATAACCT TAATATTTGA AGTGACCCCC ATTCCCCAAA GCAATCAAAC 1700
CGTCATGACT TTGCAATTTG GCACATCCTA GCTTGTTAGA GGGCACTTCC 1750
GAAAACACA GCCCTGACAG CAAAATAAAG GTCTGATATG TTGGCCCCTT 1800
CTATGGAAAC AACGCTGCCA AATCCTGGAG CAAAACCTGA AGTGTCTTCA 1850
TGTGCATTCT CTGGCAGGCC ACAGTCCTGA GCTTGTAAGA TGGTGCAGCA 1900
TGCAGACCAG ACTTGTCCCC AAGGTCTCAG CGCTGCGGTC TCACTCCTCC 1950
CCTCATTTAA GAAGACTATC CTTACCTTTT AGTTTCAGCA GTCCTCACCA 2000
CCACCATATC CCCAGTGCTG GGATGGCACA CAGGTGTCCA TTCAGATGAG 2050
AGTTGGGTCG CTGAGCATTG GTTACTCCTG CAGAGTGTAA TCAGCACCCC 2100
ATCCAACTGG CCCGAAAGCC CAGACCTGCA GCAGAACTCT CCAACTCTCT 2150
ATCAGCTTTC AGGGTTTTCT CTCCTGGGAA GGGTGTAAAA TCAGCTTGTC 2200
AGATTCTTCT TACAGAGAGT ATCCAATCGG TATTGGTGGA GCGGCTCCCT 2250
ATTTATACAA TAGGAAGCAT GGGTGCTTAG AAAGTTTATT TCAGGAGGAA 2300
AATGGGTTCA CACAAAAAGC AAACTACATT CTGATCTGCT CAGGGAGAAG 2350
CTTGCCTTTG AACTGGAAGA TGTTGGGATG AGCAGGGAAA GCTTAGACTT 2400
TGGAGTCAGG TTTGTGTTCA GAATCCAGCC CTGCTGGCTA CTAACTAACT 2450
GGGAGACCTT AGGCAAAGCA TGCAATCGCT CTGAATGGCA GTTTCCTCAT 2500
TTTTAAACAG GGATAATAAA ACTAATATTG CAGGGGAGTT ACAGGGTTAA 2550
ATAAGATCCT GTGTGTAACC CCAAGCATTG GATGACTCAT AGAATGGCCT 2600
TTTTTGTCAG CATAATCGTC ATCATTATTT AGATACTTTC TTCCTTCACT 2650
CACCCAGCAG GTCAGTTTTC TGTGCAAACA AACCTGTTTA GGATTCTTCC 2700
```

FIG. 89B

```
AAATGTTCTT CCTGGGGTCT TTGATATTTG TTTGTTACAT CCTGCTGAAG  2750
TTCGACTGTG TTTTTATTTT TTCATCCAAC TTCCATTTTT CACTTTTTAC  2800
ATGATTACTC AATCCTTGGG GCTGTCCATG TCATCTCTTA GATTCTTAA   2850
AAGACATTTT AATGTATGGT TAGGTTTTAT ATTTTTATTT TTTAAAAAAG  2900
AAATAGTCAG TGTTTTCCTC CTTTCAACCG AGACTATTTC TGGATTGTGT  2950
GCTCCTCGTC AGTTGACTTG TTTTGCACAC TTTTCTTTAC TTCATGTCCC  3000
CATCAACAAC CGTCCTGCTC CCCACCTCCC CCAGGAAATA AGGGGCCTGC  3050
TCCTCTCCCT ACTGTGACCC TGGAGGCTCT TAAGATGATG ATGGTTTTTT  3100
TTATTGGGCT GAGTTCACGA ATTAGGGGCA GGAGCTGGAA GTCGCCCTAG  3150
GAACACCAGA TTTCCTGGTT CTGTTCAAGT TGGCATTTCT TGTTTGGAAT  3200
AAACTATTTC TTGGACATTC CTTC (SEQ ID NO: 95)
```

FIG. 90

```
MGGNHSHKPPVFDENEEVNFDHFQILRAIGKGSFGKVCIVQKRDTKKMYAMKYMNKQKC
IERDEVRNVFRELQIMQGLEHPFLVNLWYSFQDEEDMFMVVDLLLGGDLRYHLQQNVHF
TEGTVKLYICELALALEYLQRYHIIHRDIKPDNILLDEHGHVHITDFNIATVVKGAERA
SSMAGTKPYMAPEVFQVYMDRGPGYSYPVDWWSLGITAYELLRGWRPYEIHSVTPIDEI
LNMFKVERVHYSSTWCKGMVALLRKLLTKDPESRVSSLHDIQSVPYLADMNWDAVFKKA
LMPGFVPNKGRLNCDPTFELEEMILESKPLHKKKKRLAKNRSRDGTKDSCPLNGHLQHC
LETVREEFIIFNREKLRRQQGQGSQLLDTDSRGGGQAQSKLQDGCNNNLLTHTCTRGCS
S (SEQ ID NO: 96)
```

FIG. 91A

```
atggtcagctggggtcgtttcatctgcctggtcgtggtcaccatggcaaccttgtccctg    60
 M  V  S  W  G  R  F  I  C  L  V  V  V  T  M  A  T  L  S  L     20 gcccggccctccttcagtttagttgaggataccacattagagccagaagatgccatctca   120
 A  R  P  S  F  S  L  V  E  D  T  T  L  E  P  E  D  A  I  S     40 tccggagatgatgaggatgacaccgatggtgcggaagattttgtcagtgagaacagtaac   180
 S  G  D  D  E  D  D  T  D  G  A  E  D  F  V  S  E  N  S  N     60 aacaagagagcaccatactggaccaacacagaaaagatggaaaagcggctccatgctgtg   240
 N  K  R  A  P  Y  W  T  N  T  E  K  M  E  K  R  L  H  A  V     80 cctgcggccaacactgtcaagtttcgctgcccagccggggggaacccaatgccaaccatg   300
 P  A  A  N  T  V  K  F  R  C  P  A  G  G  N  P  M  P  T  M    100 cggtggctgaaaaacgggaaggagtttaagcaggagcatcgcattggaggctacaaggta   360
 R  W  L  K  N  G  K  E  F  K  Q  E  H  R  I  G  G  Y  K  V    120 cgaaaccagcactggagcctcattatggaaagtgtggtcccatctgacaagggaaattat   420
 R  N  Q  H  W  S  L  I  M  E  S  V  V  P  S  D  K  G  N  Y    140 acctgtgtagtggagaatgaatacgggtccatcaatcacacgtaccacctggatgttgtg   480
 T  C  V  V  E  N  E  Y  G  S  I  N  H  T  Y  H  L  D  V  V    160 gagcgatcgcctcaccggcccatcctccaagccggactgccggcaaatgcctccacagtg   540
 E  R  S  P  H  R  P  I  L  Q  A  G  L  P  A  N  A  S  T  V    180 gtcggaggagacgtagagtttgtctgcaaggtttacagtgatgcccagccccacatccag   600
 V  G  G  D  V  E  F  V  C  K  V  Y  S  D  A  Q  P  H  I  Q    200 tggatcaagcacgtggaaaagaacggcagtaaatacgggcccgacgggctgccctacctc   660
 W  I  K  H  V  E  K  N  G  S  K  Y  G  P  D  G  L  P  Y  L    220 aaggttctcaaggccgccggtgttaacaccacggacaaagagattgaggttctctatatt   720
 K  V  L  K  A  A  G  V  N  T  T  D  K  E  I  E  V  L  Y  I    240 cggaatgtaacttttgaggacgctggggaatatacgtgcttggcgggtaattctattggg   780
 R  N  V  T  F  E  D  A  G  E  Y  T  C  L  A  G  N  S  I  G    260 atatcctttcactctgcatggttgacagttctgccagcgcctggaagagaaaaggagatt   840
 I  S  F  H  S  A  W  L  T  V  L  P  A  P  G  R  E  K  E  I    280 acagcttccccagactacctggagatagccatttactgcatagggggtcttcttaatcgcc   900
 T  A  S  P  D  Y  L  E  I  A  I  Y  C  I  G  V  F  L  I  A    300 tgtatggtggtaacagtcatcctgtgccgaatgaagaacacgaccaagaagccagacttc   960
 C  M  V  V  T  V  I  L  C  R  M  K  N  T  T  K  K  P  D  F    320 agcagccagccggctgtgcacaagctgaccaaacgtatccccctgcggagacaggtaaca  1020
 S  S  Q  P  A  V  H  K  L  T  K  R  I  P  L  R  R  Q  V  T    340 gtttcggctgagtccagctcctccatgaactccaacacccgctggtgaggataacaaca  1080
 V  S  A  E  S  S  S  S  M  N  S  N  T  P  L  V  R  I  T  T    360
```

FIG. 91B

```
cgcctctcttcaacggcagacaccccatgctggcaggggtctccgagtatgaacttcca  1140
 R  L  S  S  T  A  D  T  P  M  L  A  G  V  S  E  Y  E  L  P    380 gaggacccaaaatggagtttccaagagataagctgacactgggcaagcccctgggagaa  1200
 E  D  P  K  W  E  F  P  R  D  K  L  T  L  G  K  P  L  G  E    400 ggttgctttgggcaagtggtcatggcggaagcagtgggaattgacaaagacaagcccaag  1260
 G  C  F  G  Q  V  V  M  A  E  A  V  G  I  D  K  D  K  P  K    400 gaggcggtcaccgtggccgtgaagatgttgaaagatgatgccacagagaagacctttct  1320
 E  A  V  T  V  A  V  K  M  L  K  D  D  A  T  E  K  D  L  S    440 gatctggtgtcagagatggagatgatgaagatgattgggaaacacaagaatatcataaat  1380
 D  L  V  S  E  M  E  M  M  K  M  I  G  K  H  K  N  I  I  N    460 cttcttggagcctgcacacaggatgggcctctctatgtcatagttgagtatgcctctaaa  1440
 L  L  G  A  C  T  Q  D  G  P  L  Y  V  I  V  E  Y  A  S  K    480 ggcaacctccgagaatacctccgagcccggaggccacccgggatggagtactcctatgac  1500
 G  N  L  R  E  Y  L  R  A  R  R  P  P  G  M  E  Y  S  Y  D    500 attaaccgtgttcctgaggagcagatgaccttcaaggacttggtgtcatgcacctaccag  1560
 I  N  R  V  P  E  E  Q  M  T  F  K  D  L  V  S  C  T  Y  Q    520 ctggccagaggcatggagtacttggcttcccaaaaatgtattcatcgagatttagcagcc  1620
 L  A  R  G  M  E  Y  L  A  S  Q  K  C  I  H  R  D  L  A  A    540 agaaatgttttggtaacagaaaacaatgtgatgaaaatagcagactttggactcgccaga  1680
 R  N  V  L  V  T  E  N  N  V  M  K  I  A  D  F  G  L  A  R    560 gatatcaacaatatagactattacaaaaagaccaccaatgggcggcttccagtcaagtgg  1740
 D  I  N  N  I  D  Y  Y  K  K  T  T  N  G  R  L  P  V  K  W    580 atggctccagaagccctgtttgatagagtatacactcatcagagtgatgtctggtccttc  1800
 M  A  P  E  A  L  F  D  R  V  Y  T  H  Q  S  D  V  W  S  F    600 ggggtgttaatgtgggagatcttcactttagggggctcgccctacccagggattcccgtg  1860
 G  V  L  M  W  E  I  F  T  L  G  G  S  P  Y  P  G  I  P  V    620 gaggaacttttttaagctgctgaaggaaggacacagaatggataagccagccaactgcacc  1920
 E  E  L  F  K  L  L  K  E  G  H  R  M  D  K  P  A  N  C  T    640 aacgaactgtacatgatgatgagggactgttggcatgcagtgccctcccagagaccaacg  2040
 N  E  L  Y  M  M  M  R  D  C  W  H  A  V  P  S  Q  R  P  T    660 ttcaagcagttggtagaagacttggatcgaattctcactctcacaaccaatgaggtaaag  2100
 F  K  Q  L  V  E  D  L  D  R  I  L  T  L  T  T  N  E  V  K    700 gcgacacaggaggagaaccgggagctgaggagcaggtgtgaggagctccacgggaagaac  2160
 A  T  Q  E  E  N  R  E  L  R  S  R  C  E  E  L  H  G  K  N    720 ctggaactggggaagatcatggacaggttcgaagaggttgtgtaccaggccatggaggaa  2220
 L  E  L  G  K  I  M  D  R  F  E  E  V  V  Y  Q  A  M  E  E    740
```

FIG. 91C

```
gttcagaagcagaaggaacttttccaaagctgaaatccagaaagttctaaaagaaaaagac 2280
 V  Q  K  Q  K  E  L  S  K  A  E  I  Q  K  V  L  K  E  K  D   760 caacttaccacagatctgaactccatggagaagtccttctccgacctcttcaagcgtttt 2340
 Q  L  T  T  D  L  N  S  M  E  K  S  F  S  D  L  F  K  R  F   780 gagaaacagaaagaggtgatcgagggctaccgcaagaacgaagagtcactgaagaagtgc 2400
 E  K  Q  K  E  V  I  E  G  Y  R  K  N  E  E  S  L  K  K  C   800 gtggaggattacctggcaaggatcacccaggagggccagaggtaccaagccctgaaggcc 2460
 V  E  D  Y  L  A  R  I  T  Q  E  G  Q  R  Y  Q  A  L  K  A   820 cacgcggaggagaagctgcagctggcaaacgaggagatcgcccaggtccggagcaaggcc 2520
 H  A  E  E  K  L  Q  L  A  N  E  E  I  A  Q  V  R  S  K  A   840 caggcggaagcgttggccctccaggccagcctgaggaaggagcagatgcgcatccagtcg 2580
 Q  A  E  A  L  A  L  Q  A  S  L  R  K  E  Q  M  R  I  Q  S   860 ctggagaagacagtggagcagaagactaaagagaacgaggagctgaccaggatctgcgac 2640
 L  E  K  T  V  E  Q  K  T  K  E  N  E  E  L  T  R  I  C  D   880 gacctcatctccaagatggagaagatctga (SEQ ID NO: 97)
 D  L  I  S  K  M  E  K  I  -  (SEQ ID NO: 98)
```

FIG. 92A

```
AATTTGTTGA GGAATTTCCC CCTAGCCTTG ACCCCTTGAC AGCTCCCGCT   50
CCTACTCAGT GCTGGGGAGA AGTAGGGAGG CCTTAAGCGA AGAGATGGGT  100
CTGCACTTTG GAGGAGCCGG ACACTGTTGA CTTTCCTGAT GTGAAATCTA  150
CCCAGGAACA AAACACCAGT GACTGCAGCA GCAGCGGCAG CGCCTCGGTT  200
CCTGAGCCCA CCGCAGGCTG AAGGCATTGC GCGTAGTCCA TGCCCGTAGA  250
GGAAGTGTGC AGATGGGATT AACGTCCACA TGGAGATATG GAAGAGGACC  300
GGGGATTGGT ACCGTAACCA TGGTCAGCTG GGGTCGTTTC ATCTGCCTGG  350
TCGTGGTCAC CATGGCAACC TTGTCCCTGG CCCGGCCCTC CTTCAGTTTA  400
GTTGAGGATA CCACATTAGA GCCAGAAGAT GCCATCTCAT CCGGAGATGA  450
TGAGGATGAC ACCGATGGTG CGGAAGATTT TGTCAGTGAG AACAGTAACA  500
ACAAGAGAGC ACCATACTGG ACCAACACAG AAAAGATGGA AAAGCGGCTC  550
CATGCTGTGC CTGCGGCCAA CACTGTCAAG TTTCGCTGCC CAGCCGGGGG  600
GAACCCAATG CCAACCATGC GGTGGCTGAA AAACGGGAAG GAGTTTAAGC  650
AGGAGCATCG CATTGGAGGC TACAAGGTAC GAAACCAGCA CTGGAGCCTC  700
ATTATGGAAA GTGTGGTCCC ATCTGACAAG GGAAATTATA CCTGTGTAGT  750
GGAGAATGAA TACGGGTCCA TCAATCACAC GTACCACCTG GATGTTGTGG  800
AGCGATCGCC TCACCGGCCC ATCCTCCAAG CCGGACTGCC GGCAAATGCC  850
TCCACAGTGG TCGGAGGAGA CGTAGAGTTT GTCTGCAAGG TTTACAGTGA  900
TGCCCAGCCC CACATCCAGT GGATCAAGCA CGTGGAAAAG AACGGCAGTA  950
AATACGGGCC CGACGGGCTG CCCTACCTCA AGGTTCTCAA GGCCGCCGGT 1000
GTTAACACCA CGGACAAAGA GATTGAGGTT CTCTATATTC GGAATGTAAC 1050
TTTTGAGGAC GCTGGGGAAT ATACGTGCTT GGCGGGTAAT TCTATTGGGA 1100
TATCCTTTCA CTCTGCATGG TTGACAGTTC TGCCAGCGCC TGGAAGAGAA 1150
AAGGAGATTA CAGCTTCCCC AGACTACCTG GAGATAGCCA TTTACTGCAT 1200
AGGGGTCTTC TTAATCGCCT GTATGGTGGT AACAGTCATC CTGTGCCGAA 1250
TGAAGAACAC GACCAAGAAG CCAGACTTCA GCAGCCAGCC GGCTGTGCAC 1300
AAGCTGACCA AACGTATCCC CCTGCGGAGA CAGGTAACAG TTTCGGCTGA 1350
GTCCAGCTCC TCCATGAACT CCAACACCCC GCTGGTGAGG ATAACAACAC 1400
GCCTCTCTTC AACGGCAGAC ACCCCCATGC TGGCAGGGGT CTCCGAGTAT 1450
GAACTTCCAG AGGACCCAAA ATGGGAGTTT CCAAGAGATA AGCTGACACT 1500
GGGCAAGCCC CTGGGAGAAG GTTGCTTTGG GCAAGTGGTC ATGGCGGAAG 1550
CAGTGGGAAT TGACAAAGAC AAGCCCAAGG AGGCGGTCAC CGTGGCCGTG 1600
AAGATGTTGA AAGATGATGC CACAGAGAAA GACCTTTCTG ATCTGGTGTC 1650
AGAGATGGAG ATGATGAAGA TGATTGGGAA ACACAAGAAT ATCATAAATC 1700
TTCTTGGAGC CTGCACACAG GATGGGCCTC TCTATGTCAT AGTTGAGTAT 1750
GCCTCTAAAG GCAACCTCCG AGAATACCTC CGAGCCCGGA GGCCACCCGG 1800
GATGGAGTAC TCCTATGACA TTAACCGTGT TCCTGAGGAG CAGATGACCT 1850
TCAAGGACTT GGTGTCATGC ACCTACCAGC TGGCCAGAGG CATGGAGTAC 1900
TTGGCTTCCC AAAAATGTAT TCATCGAGAT TTAGCAGCCA GAAATGTTTT 1950
GGTAACAGAA AACAATGTGA TGAAAATAGC AGACTTTGGA CTCGCCAGAG 2000
ATATCAACAA TATAGACTAT TACAAAAAGA CCACCAATGG GCGGCTTCCA 2050
GTCAAGTGGA TGGCTCCAGA AGCCCTGTTT GATAGAGTAT ACACTCATCA 2100
GAGTGATGTC TGGTCCTTCG GGGTGTTAAT GTGGGAGATC TTCACTTTAG 2150
GGGGCTCGCC CTACCCAGGG ATTCCCGTGG AGGAACTTTT TAAGCTGCTG 2200
AAGGAAGGAC ACAGAATGGA TAAGCCAGCC AACTGCACCA ACGAACTGTA 2250
CATGATGATG AGGGACTGTT GGCATGCAGT GCCCTCCCAG AGACCAACGT 2300
TCAAGCAGTT GGTAGAAGAC TTGGATCGAA TTCTCACTCT CACAACCAAT 2350
GAGGAGGAGA AGAAGGTTTC TGGAGCAGTG GACTGCCACA AGCCACCATG 2400
TAACCCCTCT CACCTGCCGT GCGTACTGGC TGTGGACCAG TAGGACTCAA 2450
GGTGGACGTG CGTTCTGCCT TCCTTGTTAA TTTTGTAATA ATTGGAGAAG 2500
ATTTATGTCA GCACACACTT ACAGAGCACA AATGCAGTAT ATAGGTGCTG 2550
GATGTATGTA AATATATTCA AATTATGTAT AAATATATAT TATATATTTA 2600
CAAGGAGTTA TTTTTTGTAT TGATTTTAAA TGGATGTCCC AATGCACCTA 2650
GAAAATTGGT CTCTCTTTTT TTAATAGCTA TTTGCTAAAT GCTGTTCTTA 2700
```

FIG. 92B

```
CACATAATTT CTTAATTTTC ACCGAGCAGA GGTGGAAAAA TACTTTTGCT   2750
TTCAGGGAAA ATGGTATAAC GTTAATTTAT TAATAAATTG GTAATATACA   2800
AAACAATTAA TCATTATAG  TTTTTTTTGT AATTTAAGTG GCATTTCTAT   2850
GCAGGCAGCA CAGCAGACTA GTTAATCTAT TGCTTGGACT TAACTAGTTA   2900
TCAGATCCTT TGAAAAGAGA ATATTTACAA TATATGACTA ATTTGGGGAA   2950
AATGAAGTTT TGATTTATTT GTGTTTAAAT GCTGCTGTCA GACGATTGTT   3000
CTTAGACCTC CTAAATGCCC CATATTAAAA GAACTCATTC ATAGGAAGGT   3050
GTTTCATTTT GGTGTGCAAC CCTGTCATTA CGTCAACGCA ACGTCTAACT   3100
GGACTTCCCA AGATAAATGG TACCAGCGTC CTCTTAAAAG ATGCCTTAAT   3150
CCATTCCTTG AGGACAGACC TTAGTTGAAA TGATAGCAGA ATGTGCTTCT   3200
CTCTGGCAGC TGGCCTTCTG CTTCTGAGTT GCACATTAAT CAGATTAGCC   3250
TGTATTCTCT TCAGTGAATT TTGATAATGG CTTCCAGACT CTTTGGCGTT   3300
GGAGACGCCT GTTAGGATCT TCAAGTCCCA TCATAGAAAA TTGAAACACA   3350
GAGTTGTTCT GCTGATAGTT TTGGGGATAC GTCCATCTTT TTAAGGGATT   3400
GCTTTCATCT AATTCTGGCA GGACCTCACC AAAAGATCCA GCCTCATACC   3450
TACATCAGAC AAAATATCGC CGTTGTTCCT TCTGTACTAA AGTATTGTGT   3500
TTTGCTTTGG AAACACCCAC TCACTTTGCA ATAGCCGTGC AAGATGAATG   3550
CAGATTACAC TGATCTTATG TGTTACAAAA TTGGAGAAAG TATTTAATAA   3600
AACCTGTTAA TTTTTATACT GACAATAAAA ATGTTCTAC  AGATATTAAT   3650
GTTAACAAGA CAAAATAAAT GTCACGCAAC TTATTTTTT  AATAaaaaaa   3700
aaaaaaaa (SEQ ID NO: 99)
```

FIG. 93

```
MVSWGRFICLVVVTMATLSLARPSFSLVEDTTLEPEDAISSGDDEDDTDGAEDFVSENSN
NKRAPYWTNTEKMEKRLHAVPAANTVKFRCPAGGNPMPTMRWLKNGKEFKQEHRIGGYKV
RNQHWSLIMESVVPSDKGNYTCVVENEYGSINHTYHLDVVERSPHRPILQAGLPANASTV
VGGDVEFVCKVYSDAQPHIQWIKHVEKNGSKYGPDGLPYLKVLKAAGVNTTDKEIEVLYI
RNVTFEDAGEYTCLAGNSIGISFHSAWLTVLPAPGREKEITASPDYLEIAIYCIGVFLIA
CMVVTVILCRMKNTTKKPDFSSQPAVHKLTKRIPLRRQVTVSAESSSSMNSNTPLVRITT
RLSSTADTPMLAGVSEYELPEDPKWEFPRDKLTLGKPLGEGCFGQVVMAEAVGIDKDKPK
EAVTVAVKMLKDDATEKDLSDLVSEMEMMKMIGKHKNIINLLGACTQDGPLYVIVEYASK
GNLREYLRARRPPGMEYSYDINRVPEEQMTFKDLVSCTYQLARGMEYLASQKCIHRDLAA
RNVLVTENNVMKIADFGLARDINNIDYYKKTTNGRLPVKWMAPEALFDRVYTHQSDVWSF
GVLMWEIFTLGGSPYPGIPVEELFKLLKEGHRMDKPANCTNELYMMMRDCWHAVPSQRPT
FKQLVEDLDRILTLTTNEEEKKVSGAVDCHKPPCNPSHLPCVLAVDQ- (SEQ ID NO: 100)
```

FIG. 94A

```
atggtcagctggggtcgtttcatctgcctggtcgtggtcaccatggcaaccttgtccctg    60
 M  V  S  W  G  R  F  I  C  L  V  V  V  T  M  A  T  L  S  L     20 gcccggccctccttcagtttagttgaggataccacattagagccagaagatgccatctca   120
 A  R  P  S  F  S  L  V  E  D  T  T  L  E  P  E  D  A  I  S     40 tccggagatgatgaggatgacaccgatggtgcggaagattttgtcagtgagaacagtaac   180
 S  G  D  D  E  D  D  T  D  G  A  E  D  F  V  S  E  N  S  N     60 aacaagagagcaccatactggaccaacacagaaaagatggaaaagcggctccatgctgtg   240
 N  K  R  A  P  Y  W  T  N  T  E  K  M  E  K  R  L  H  A  V     80 cctgcggccaacactgtcaagtttcgctgcccagccggggggaacccaatgccaaccatg   300
 P  A  A  N  T  V  K  F  R  C  P  A  G  G  N  P  M  P  T  M    100 cggtggctgaaaaacgggaaggagtttaagcaggagcatcgcattggaggctacaaggta   360
 R  W  L  K  N  G  K  E  F  K  Q  E  H  R  I  G  G  Y  K  V    120 cgaaaccagcactggagcctcattatggaaagtgtggtcccatctgacaagggaaattat   420
 R  N  Q  H  W  S  L  I  M  E  S  V  V  P  S  D  K  G  N  Y    140 acctgtgtagtggagaatgaatacgggtccatcaatcacacgtaccacctggatgttgtg   480
 T  C  V  V  E  N  E  Y  G  S  I  N  H  T  Y  H  L  D  V  V    160 gagcgatcgcctcaccggcccatcctccaagccggactgccggcaaatgcctccacagtg   540
 E  R  S  P  H  R  P  I  L  Q  A  G  L  P  A  N  A  S  T  V    180 gtcggaggagacgtagagtttgtctgcaaggtttacagtgatgcccagccccacatccag   600
 V  G  G  D  V  E  F  V  C  K  V  Y  S  D  A  Q  P  H  I  Q    200 tggatcaagcacgtggaaaagaacggcagtaaatacgggcccgacgggctgccctacctc   660
 W  I  K  H  V  E  K  N  G  S  K  Y  G  P  D  G  L  P  Y  L    220 aaggttctcaaggccgccggtgttaacaccacggacaaagagattgaggttctctatatt   720
 K  V  L  K  A  A  G  V  N  T  T  D  K  E  I  E  V  L  Y  I    240 cggaatgtaacttttgaggacgctggggaatatacgtgcttggcgggtaattctattggg   780
 R  N  V  T  F  E  D  A  G  E  Y  T  C  L  A  G  N  S  I  G    260 atatcctttcactctgcatggttgacagttctgccagcgcctggaagagaaaaggagatt   840
 I  S  F  H  S  A  W  L  T  V  L  P  A  P  G  R  E  K  E  I    280 acagcttccccagactacctggagatagccatttactgcatagggcgtcttcttaatcgcc   900
 T  A  S  P  D  Y  L  E  I  A  I  Y  C  I  G  V  F  L  I  A    300 tgtatggtggtaacagtcatcctgtgccgaatgaagaacacgaccaagaagccagacttc   960
 C  M  V  V  T  V  I  L  C  R  M  K  N  T  T  K  K  P  D  F    320 agcagccagccggctgtgcacaagctgaccaaacgtatcccctgcggagacaggtaaca  1020
 S  S  Q  P  A  V  H  K  L  T  K  R  I  P  L  R  R  Q  V  T    340 gtttcggctgagtccagctcctccatgaactccaacaccccgctggtgaggataacaaca  1080
 V  S  A  E  S  S  S  S  M  N  S  N  T  P  L  V  R  I  T  T    360
```

FIG. 94B

```
cgcctctcttcaacggcagacaccccatgctggcaggggtctccgagtatgaacttcca 1140
 R  L  S  S  T  A  D  T  P  M  L  A  G  V  S  E  Y  E  L  P    380 gaggacccaaaatggagtttccaagagataagctgacactgggcaagcccctgggagaa 1200
 E  D  P  K  W  E  F  P  R  D  K  L  T  L  G  K  P  L  G  E    400 ggttgctttgggcaagtggtcatggcggaagcagtgggaattgacaaagacaagcccaag 1260
 G  C  F  G  Q  V  V  M  A  E  A  V  G  I  D  K  D  K  P  K    420 gaggcggtcaccgtggccgtgaagatgttgaaagatgatgccacagagaaagacctttct 1320
 E  A  V  T  V  A  V  K  M  L  K  D  D  A  T  E  K  D  L  S    440 gatctggtgtcagagatggagatgatgaagatgattgggaaacacaagaatatcataaat 1380
 D  L  V  S  E  M  E  M  M  K  M  I  G  K  H  K  N  I  I  N    460 cttcttggagcctgcacacaggatgggcctctctatgtcatagttgagtatgcctctaaa 1440
 L  L  G  A  C  T  Q  D  G  P  L  Y  V  I  V  E  Y  A  S  K    480 ggcaacctccgagaatacctccgagcccggaggccacccgggatggagtactcctatgac 1500
 G  N  L  R  E  Y  L  R  A  R  R  P  P  G  M  E  Y  S  Y  D    500 attaaccgtgttcctgaggagcagatgaccttcaaggacttggtgtcatgcacctaccag 1560
 I  N  R  V  P  E  E  Q  M  T  F  K  D  L  V  S  C  T  Y  Q    520 ctggccagaggcatggagtacttggcttcccaaaaatgtattcatcgagatttagcagcc 1620
 L  A  R  G  M  E  Y  L  A  S  Q  K  C  I  H  R  D  L  A  A    540 agaaatgttttggtaacagaaaacaatgtgatgaaaatagcagactttggactcgccaga 1680
 R  N  V  L  V  T  E  N  N  V  M  K  I  A  D  F  G  L  A  R    560 gatatcaacaatatagactattacaaaaagaccaccaatgggcggcttccagtcaagtgg 1740
 D  I  N  N  I  D  Y  Y  K  K  T  T  N  G  R  L  P  V  K  W    580 atggctccagaagccctgtttgatagagtatacactcatcagagtgatgtctggtccttc 1800
 M  A  P  E  A  L  F  D  R  V  Y  T  H  Q  S  D  V  W  S  F    600 ggggtgttaatgtgggagatcttcactttagggggctcgccctacccagggattcccgtg 1860
 G  V  L  M  W  E  I  F  T  L  G  G  S  P  Y  P  G  I  P  V    620 gaggaactttttaagctgctgaaggaaggacacagaatggataagccagccaactgcacc 1920
 E  E  L  F  K  L  L  K  E  G  H  R  M  D  K  P  A  N  C  T    640 aacgaactgtacatgatgatgagggactgttggcatgcagtgccctcccagagaccaacg 1980
 N  E  L  Y  M  M  M  R  D  C  W  H  A  V  P  S  Q  R  P  T    660 ttcaagcagttggtagaagacttggatcgaattctcactctcacaaccaatgaggtaaat 2040
 F  K  Q  L  V  E  D  L  D  R  I  L  T  L  T  T  N  E  V  N    680 aaagttaaacaagaaaagactgttttaaattcagaagttcttgaacagagaaaagtctta 2100
 K  V  K  Q  E  K  T  V  L  N  S  E  V  L  E  Q  R  K  V  L    700 gaaaaatgcaatagagtgtccatgttagctgtagaagagtatgaggagatgcaagtaaac 2160
 E  K  C  N  R  V  S  M  L  A  V  E  E  Y  E  E  M  Q  V  N
```

FIG. 94C

```
ctggagctggagaaggaccttcgaaagaaagcagagtcatttgcacaagagatgttcatt 2220
 L   E   L   E   K   D   L   R   K   K   A   E   S   F   A   Q   E   M   F   I gagcaaaacaagctaaagagacaaagccaccttctgctgcagagctccatccctgatcag 2280
 E   Q   N   K   L   K   R   Q   S   H   L   L   L   Q   S   S   I   P   D   Q cagcttttgaaagctttagacgaaaatgcaaaactcacccagcaacttgaagaagagaga 2340
 Q   L   L   K   A   L   D   E   N   A   K   L   T   Q   Q   L   E   E   E   R attcagcatcaacaaaaggtcaaagaattagaagagcaactagaaatgaaacactccac  2400
 I   Q   H   Q   Q   K   V   K   E   L   E   E   Q   L   E   N   E   T   L   H aaagaaatacacaacctcaaacagcaactggagcttctagaggaagataaaaaggaattg 2460
 K   E   I   H   N   L   K   Q   Q   L   E   L   L   E   E   D   K   K   E   L gaattgaaatatcagaattctgaagagaaagccagaaatttaaagcactctgttgatgaa 2520
 E   L   K   Y   Q   N   S   E   E   K   A   R   N   L   K   H   S   V   D   E ctccagaaacgagtgaaccagtctgagaattcagtacctccaccacctcctcctccacca 2580
 L   Q   K   R   V   N   Q   S   E   N   S   V   P   P   P   P   P   P   P   P ccacttccccctccacctcccaatcctatccgatccctcatgtccatgatccggaaacga 2640
 P   L   P   P   P   P   P   N   P   I   R   S   L   M   S   M   I   R   K   R tcccaccccagtggcagtggtgctaagaaagaaaaggcaactcaaccagaaacaactgaa 2700
 S   H   P   S   G   S   G   A   K   K   E   K   A   T   Q   P   E   T   T   E gaagtcacagatctaaagaggcaagcagttgaagagatgatggatagaattaaaaaggga 2760
 E   V   T   D   L   K   R   Q   A   V   E   E   M   M   D   R   I   K   K   G gttcatcttagacccgttaatcagacagccagaccgaagacaaagccagaatcttcgaaa 2820
 V   H   L   R   P   V   N   Q   T   A   R   P   K   T   K   P   E   S   S   K ggctgcgaaagtgcagtggatgaactaaaaggaatactggggacacttaacaaatccact 2880
 G   C   E   S   A   V   D   E   L   K   G   I   L   G   T   L   N   K   S   T agttcaagaagcttaaaatcccttgaccctgaaaacagtgaaactgagttagaaaggatt 2940
 S   S   R   S   L   K   S   L   D   P   E   N   S   E   T   E   L   E   R   I ttgcgtcgcagaaaggtgacagcagaagcagatagcagtagtccaactgggatattagcc 3000
 L   R   R   R   K   V   T   A   E   A   D   S   S   S   P   T   G   I   L   A acctcagagtccaaatccatgccagtgttgggttctgtatccagtgtaacaaaaacagcc 3060
 T   S   E   S   K   S   M   P   V   L   G   S   V   S   S   V   T   K   T   A ttgaacaagaaaactctggaggcagaattcaacagcccgtcccccccaacacctgagcca 3120
 L   N   K   K   T   L   E   A   E   F   N   S   P   S   P   P   T   P   E   P ggtgaagggccccgtaaattggaaggatgcacaagttccaaggttacgtttcagcctccc 3180
 G   E   G   P   R   K   L   E   G   C   T   S   S   K   V   T   F   Q   P   P agtagcattggatgcaggaaaaaatacattgacggtgaaaaacaagccgaaccagttgta 3240
 S   S   I   G   C   R   K   K   Y   I   D   G   E   K   Q   A   E   P   V   V
```

FIG. 94D

```
gttttagatcctgtttctacacatgaaccccaaaccaaagaccaggttgctgaaaaagat 3300
 V  L  D  P  V  S  T  H  E  P  Q  T  K  D  Q  V  A  E  K  D ccaactcaacacaaggaggatgaaggcgaaattcaaccagaaaacaaagaagacagcatt 3360
 P  T  Q  H  K  E  D  E  G  E  I  Q  P  E  N  K  E  D  S  I gaaaacgtgagagagacagacagctccaactgctga (SEQ ID NO: 101)
 E  N  V  R  E  T  D  S  S  N  C  -  (SEQ ID NO: 102)
```

FIG. 95A

```
ATTGCGTCCC GCTCTACCTC TGTGGTTCTT TGGGAGCGAC CCCCGGGAAG   50
CGTCCAAAGT GGAGTTCCCA CACACGCTGC GAACCCACAG CCGGTTTTCT  100
CTGAACTCGC GTCCCTGAGT CCGGGAGGTG GAGGCGGAGA AAAGGGTGCG  150
GAGCGACCCC ACGCAGGGCC GCCCCCCCTC CCACCAGCGC GTCCTGCCGC  200
GCCGGCAGCC ACAGGCTGGC ATAGCGGCTG CCGACCCGCC CTCGTTCCTC  250
CACCCCCTGA ACGGGACTGC TGGGCCCGCC CCGCCCCGCC TGCAGGTGAA  300
GCGGCCGCAG CCGCCGAGTA GGTGCGTGGG GATGATCTCA CTCGCGCGCT  350
CCGCGCCAGG AGGAGGAGGA GCGGGAGCGG ATCCAACTTC CGGGTAGTGG  400
AGCCGCAAGC CACCGGCATC TTGCTTTTTC TTCCCCCTCC TCCTGTGTGC  450
CCCGCGCCGC TCCCTCTTTC CCTTTTATTC CCGGCCCCAC CCGCCAAA*AT*  500
*G*AACAGCTCG GACGAAGAGA AGCAGCTGCA GCTCATTACC AGTCTGAAGG  550
AGCAAGCAAT AGGCGAATAT GAAGACCTTA GAGCAGAGAA CCAGAAAACA  600
AAGGAGAAGT GTGACAAAAT TAGGCAAGAA CGAGATGAAG CCGTTAAAAA  650
ACTGGAAGAA TTTCAGAAAA TTTCTCACAT GGTCATAGAG GAAGTTAATT  700
TCATGCAGAA CCATCTTGAA ATAGAGAAGA CTTGTCGAGA AAGTGCTGAA  750
GCTTTGGCAA CAAAGCTAAA TAAAGAAAAT AAAACGTTGA AAAGAATCAG  800
CATGTTGTAC ATGGCCAAGC TGGGACCAGA TGTAATAACT GAAGAGATAA  850
ACATTGATGA TGAAGATTCG ACTACAGACA CAGACGGTGC CGCCGAGACT  900
TGTGTCTCAG TACAGTGTCA GAAGCAAATT AAAGAACTTC GAGATCAAAT  950
TGTATCTGTT CAGGAGGAAA AGAAGATTTT AGCCATTGAG CTGGAAAATC 1000
TCAAGAGCAA ACTCGTAGAA GTAATTGAAG AAGTAAATAA AGTTAAACAA 1050
GAAAAGACTG TTTTAAATTC AGAAGTTCTT GAACAGAGAA AAGTCTTAGA 1100
AAAATGCAAT AGAGTGTCCA TGTTAGCTGT AGAAGAGTAT GAGGAGATGC 1150
AAGTAAACCT GGAGCTGGAG AAGGACCTTC GAAAGAAAGC AGAGTCATTT 1200
GCACAAGAGA TGTTCATTGA GCAAAACAAG CTAAAGAGAC AAAGCCACCT 1250
TCTGCTGCAG AGCTCCATCC CTGATCAGCA GCTTTTGAAA GCTTTAGACG 1300
AAAATGCAAA ACTCACCCAG CAACTTGAAG AAGAGAGAAT TCAGCATCAA 1350
CAAAAGGTCA AAGAATTAGA AGAGCAACTA GAAAATGAAA CACTCCACAA 1400
AGAAATACAC AACCTCAAAC AGCAACTGGA GCTTCTAGAG GAAGATAAAA 1450
AGGAATTGGA ATTGAAATAT CAGAATTCTG AAGAGAAAGC CAGAAATTTA 1500
AAGCACTCTG TTGATGAACT CCAGAAACGA GTGAACCAGT CTGAGAATTC 1550
AGTACCTCCA CCACCTCCTC CTCCACCACC ACTTCCCCCT CCACCTCCCA 1600
ATCCTATCCG ATCCCTCATG TCCATGATCC GGAAACGATC CCACCCCAGT 1650
GGCAGTGGTG CTAAGAAAGA AAAGGCAACT CAACCAGAAA CAACTGAAGA 1700
AGTCACAGAT CTAAAGAGGC AAGCAGTTGA AGAGATGATG GATAGAATTA 1750
AAAAGGGAGT TCATCTTAGA CCCGTTAATC AGACAGCCAG ACCGAAGACA 1800
AAGCCAGAAT CTTCGAAAGG CTGCGAAAGT GCAGTGGATG AACTAAAAGG 1850
AATACTGGGG ACACTTAACA AATCCACTAG TTCAAGAAGC TTAAAATCCC 1900
TTGACCCTGA AAACAGTGAA ACTGAGTTAG AAAGGATTTT GCGTCGCAGA 1950
AAGGTGACAG CAGAAGCAGA TAGCAGTAGT CCAACTGGGA TATTAGCCAC 2000
CTCAGAGTCC AAATCCATGC CAGTGTTGGG TTCTGTATCC AGTGTAACAA 2050
AAACAGCCTT GAACAAGAAA ACTCTGGAGG CAGAATTCAA CAGCCCGTCC 2100
CCCCCAACAC CTGAGCCAGG TGAAGGGCCC CGTAAATTGG AAGGATGCAC 2150
AAGTTCCAAG GTTACGTTTC AGCCTCCCAG TAGCATTGGA TGCAGGAAAA 2200
AATACATTGA CGGTGAAAAA CAAGCCGAAC CAGTTGTAGT TTTAGATCCT 2250
GTTTCTACAC ATGAACCCCA AACCAAAGAC CAGGTTGCTG AAAAAGATCC 2300
AACTCAACAC AAGGAGGATG AAGGCGAAAT TCAACCAGAA AACAAAGAAG 2350
ACAGCATTGA AAACGTGAGA GAGACAGACA GCTCCAACTG CTGATCCATA 2400
AACCAGAAGC CTGACATGTT TGGAAGTCCT TTTCAATAAG CACATGATTA 2450
GTGTTGTTAT ATTGGCAAGG GCTGTAGACA TTCTGCTCTG GTCACTGTAT 2500
TCAGAATACA GGTTCTTTTC TGGTGTCACT TTTGTAAGTA GCAACTATAA 2550
ACATAAGTAA GCTGTTTAGC AAAACACACA TTCCTAGTAG GTTTTGGTTT 2600
TTTGATCTTT ATAAAGATGA GGTTTTTTTC CTAGTTACTG TATTAAGTAT 2650
GACTTCTTTT AGAAGGTTAC AAAAAAATTC AGATGTTGAT ACCTTTTTAG 2700
```

FIG. 95B

```
GAAATGTGCA TACCACTCAT CAAATGGAAT GCTGAAAGTT TGAGGTGCTT 2750
GTATATAATC GGATAAACAA AACTGATCAA CCCAATGTGA TTTTAAAAGC 2800
CCCCAAAGAA GCTTCTGTTT TGGGTCTGAT CCTCTTGATG GAGAAACTGC 2850
AGCAGCATGG AAATTGTTGG GTACTGTGGC ATACAAGTTA TTTTCTACAG 2900
TAGACTGAGA TAAACTGAAA ACTCAGGAGC TGGCATCAAA CTCGTAGTCC 2950
CATAGTCAGT GTTAATTACA CACATTGTTA ACTATTGGAT GAAAAATACA 3000
TGCTATTGAT TGTGTCCAAA GCCTCCCGAG GACCTCCGTG GGGATGCTCT 3050
GGTAGCCTGA ATACAGAACT GAGGTGAAAG TCCAAACCTT GAATTTTACA 3100
GTAGTAAGTT GGTAAACCAT GTGCTCTGTG CTATGAGTTA ATTATGTTTT 3150
CCCAAATACT AATGTGGCAC AAGTACCATA TTTTATCAGA GTTCTTATGT 3200
ACAGTATGGT GAAGATAAGT GACAAGCACA CATTTTCTT GCTTCACTGC 3250
TGTTCTATAT TACACAGGTT TGTTGTTGTT TTTTTAAAA AAGAAATTAA 3300
GCAGTAGTTA GTCTCTAAAA ATACAATGTT TCAGGCTACC ACAGTGAATA 3350
AATAGAAATG TAATCAGGGA TTAAAAAAAA AACTTATGCA GCTTTTCAAA 3400
GTTGATTGTT TCAAAATTGG TGTTTATTTA AAATAAGTGG TAATGTACTT 3450
GAATGCACTT TTTATGACAA TGATTCAGTA ATGGTAATTT TACTATTAAA 3500
GAAAGTGAAA GGTTTAGTTT TGTTAGCATG GCTCAGCATG TAGCTGTCAG 3550
GTGTTTTTCA CCTAAGGGCA AAAGAAAATG ATAGTAATAA TTGCAGTAGT 3600
TGTATTGTAT TGTATTTTG CACGTGTGGT AAGCATAGGC TTGAAGAGGT 3650
GGGTAGGCAG GTACATGTAC TTCCTAAATT TGGAGATAAT TATCTTTCTG 3700
TAAGTTCGTT ATGCTTGACT GTTTCCATGT TCTCCCAATA ATGATTTAT 3750
AGTTACTTAT CACTTTACTC ATGGAGAATT AAAACGTAAT GTTTTCAAC 3800
TGTATCTTTC TTTAACTGGA TAATACTGCT ATATGATATG CTTACTACAG 3850
ACTGCATTAA TTCACGAAAC GAATTCTGTT ATGCTGTAAT TTGAACTCTC 3900
CTCACCACAA CTTATTAAAA AGGCACCAAT AGTTTCCCAT TAAGGGTCAG 3950
TTGTGGTTAT TATTAACGTT TCTGGTTTAG TTCCCCAAGC TTGACATTCT 4000
TTAATAGAAA ATTGTATATG ATTTGACAAC TTTAGTAATT TTTAATAGTC 4050
CCTAAGATGG TTTATTGAGT TTTCTTTCAT GTTTCTTTGT GCTGTCTTCC 4100
TTCTTGCATC TGTGATCTGT CTGCCAGCAT GCAACTCACA CACATTAGG 4150
AATATAAAAA TATGTACACT GTCTTTCCAT ATTTCATCAC ACCATCACAG 4200
AATAATATGG TTATCAAAAT ACCCTCCTTT CTAGAGTAAG AAGTTGCCCT 4250
TTGGGTGAAA TGTGTTAGCT GGACTAGGGA ACAATTAGTA ACAGGTATTT 4300
TGAAAGTATT CCTGCCTTTT TTAAGCTGCT TACTTTCTCT CACTGTGATT 4350
ACAAAGCATT TTAAATTAAT TTGACATGAA GGTATTTGAT GGAAGATATT 4400
CACTCACCTT TTTCTGCCTA CAGTTTTTCC CTTTTCACTT TGGTTTTGAG 4450
GGGGTTTTGC CCCTGGCTGG GGTGACACTG TCAACCAAAG CAAGGGATCC 4500
CAAATAGGAA GACATAGGAG AACCGTGCTT ATATCTGCAA GGTATGTTCA 4550
TAGCTATTGC ACACACAAAA CTTACATACG TCCTGCTTAC ACAATTTTAA 4600
GTTGGAAAAG ACTGCATCTT TATGTTTTTG ATTTCTCTAA AAGGTTATTT 4650
ATGCTTCCTT CTGTTTGGGA AAGATAAATT AAGTCTTGTG CGCTATAGAG 4700
GATTTTTTT CTTTAAGAAA AACGAATGTT GATGCATTTT ATAGCCCGAG 4750
TGAGGAACAG AGATAGAGGT ACTTTGTGCC ATTGCTATTA AAGAAAAGA 4800
AAATGTCTCT TTTTTTTCT GGAAGAATAA GATTTAATT AAAGCACTTG 4850
CACCCTTTTG TATGTGAGCT GGTCTCAAAC AAAGTCCTCA CCCACAGCAG 4900
TTTCAGCAGC TGAACAGTCC CATGGAAGTT CTGACTGGCA GGCATCAACA 4950
GGGCTATTAG CACCCAGCAT AGTTTGCCCT GAGTACGGAG GATGGATGCT 5000
TTGGCTCTAA CTACTCACCA ATAATTGCTC CTTCCTTACC TTCTTTGTTA 5050
ATGGTAAACT GCTGGAAATG GAGTAGTACA GGTAACAATT ATTTTAATT 5100
GTCTTTCCAG ACCAGTTTTT GGTTGTGTGT TCAGTAAATG ATAGTCTGTA 5150
TCACAGCCTT CAAGTCTGGA TTATTTTCT AAATGCATAC TCTACCTGTT 5200
CAGTTACACT CGTTGTGGAA CAACATTAGC TTATATACCA GTAAGTTGTC 5250
GAGAATGGAT AACCATCTGT CATTATCACT GACCTTCAAA GACTCATCAA 5300
GCAGTCCCTG CATAAGGATT GGAGTGGTTT GAAGTTTCTC TTCCAAGCAC 5350
TAACATGTCC C (SEQ ID NO: 103)
```

FIG. 96

```
MNSSDEEKQLQLITSLKEQAIGEYEDLRAENQKTKEKCDKIRQERDEAVKKLEEFQKISH
MVIEEVNFMQNHLEIEKTCRESAEALATKLNKENKTLKRISMLYMAKLGPDVITEEINID
DEDSTTDTDGAAETCVSVQCQKQIKELRDQIVSVQEEKKILAIELENLKSKLVEVIEEVN
KVKQEKTVLNSEVLEQRKVLEKCNRVSMLAVEEYEEMQVNLELEKDLRKKAESFAQEMFI
EQNKLKRQSHLLLQSSIPDQQLLKALDENAKLTQQLEEERIQHQQKVKELEEQLENETLH
KEIHNLKQQLELLEEDKKELELKYQNSEEKARNLKHSVDELQKRVNQSENSVPPPPPPPP
PLPPPPPNPIRSLMSMIRKRSHPSGSGAKKEKATQPETTEEVTDLKRQAVEEMMDRIKKG
VHLRPVNQTARPKTKPESSKGCESAVDELKGILGTLNKSTSSRSLKSLDPENSETELERI
LRRRKVTAEADSSSPTGILATSESKSMPVLGSVSSVTKTALNKKTLEAEFNSPSPPTPEP
GEGPRKLEGCTSSKVTFQPPSSIGCRKKYIDGEKQAEPVVVLDPVSTHEPQTKDQVAEKD
PTQHKEDEGEIQPENKEDSIENVRETDSSNC- (SEQ ID NO: 104)
```

FIG. 97

```
atggccgcccagggagagcccggctacctggcggcgcagtcggaccccggctccaacagc    60
 M  A  A  Q  G  E  P  G  Y  L  A  A  Q  S  D  P  G  S  N  S    20 gagcgcagcaccgactccccagtgcccggctccgaggacgacttggtcgccggggcgacc   120
 E  R  S  T  D  S  P  V  P  G  S  E  D  D  L  V  A  G  A  T    40 ctgcacagcccggagtggagcgaggagcgcttccgcgtggacaggaagaaacttgaggcc   180
 L  H  S  P  E  W  S  E  E  R  F  R  V  D  R  K  K  L  E  A    60 atgttacaagctgctgctgaagggaaaggcagaagtggggaagacttttttcaaaaggag   240
 M  L  Q  A  A  A  E  G  K  G  R  S  G  E  D  F  F  Q  K  E    80 gagaagaaggtttctggagcagtggactgccacaagccaccatgtaaccccctctcacctg   300
 E  K  K  V  S  G  A  V  D  C  H  K  P  P  C  N  P  S  H  L   100 ccgtgcgtactggctgtggaccagtag (SEQ ID NO: 105)
 P  C  V  L  A  V  D  Q  -  (SEQ ID NO: 106)
```

FIG. 98A

```
ATGGCCGCCC AGGGAGAGCC CGGCTACCTG GCGGCGCAGT CGGACCCCGG  50
CTCCAACAGC GAGCGCAGCA CCGACTCCCC AGTGCCCGGC TCCGAGGACG  100
ACTTGGTCGC CGGGGCGACC CTGCACAGCC CGGAGTGGAG CGAGGAGCGC  150
TTCCGCGTGG ACAGGAAGAA ACTTGAGGCC ATGTTACAAG CTGCTGCTGA  200
AGGGAAAGGC AGAAGTGGGG AAGACTTTTT TCAAAAGATC ATGGAGGAAA  250
CAAATACGCA GATTGCTTGG CCATCAAAAC TGAAGATCGG AGCCAAATCC  300
AAGAAAGATC CCCATATTAA GGTTTCTGGA AAGAAGAAG ATGTTAAAGA  350
AGCCAAGGAA ATGATCATGT CTGTCTTAGA CACAAAAAGC AATCGAGTCA  400
CACTGAAGAT GGATGTTTCA CATACAGAAC ATTCACATGT AATCGGCAAA  450
GGTGGCAACA ATATTAAAAA AGTGATGGAA GAAACCGGAT GCCATATCCA  500
CTTTCCAGAT TCCAACAGGA ATAACCAAGC AGAAAAAGC AACCAGGTAT  550
CTATAGCGGG ACAACCAGCA GGAGTAGAAT CTGCCCGAGT TAGAATTCGG  600
GAGCTGCTTC CTTTGGTGCT GATGTTTGAG CTACCAATTG CTGGAATTCT  650
TCAACCGGTT CCTGATCCTA ATTCCCCTC TATTCAGCAT ATATCACAAA  700
CGTACAATAT TTCAGTATCA TTTAAACAGC GTTCCCGAAT GTATGGTGCT  750
ACTGTCATAG TACGAGGGTC TCAGAATAAC ACTAGTGCTG TGAAGGAAGG  800
AACTGCCATG CTGTTAGAAC ATCTTGCTGG GAGCTTAGCA TCAGCTATTC  850
CTGTGAGCAC ACAACTAGAT ATTGCAGCTC AACATCATCT CTTTATGATG  900
GGTCGAAATG GGAGCAACAT CAAACATATC ATGCAGAGAA CAGGTGCTCA  950
GATCCACTTT CCTGATCCCA GTAATCCACA AAAGAAATCT ACCGTCTACC  1000
TCCAGGGCAC CATTGAGTCT GTCTGTCTTG CAAGGCAATA TCTCATGGGT  1050
TGTCTTCCTC TTGTGTTGAT GTTTGATATG AAGGAAGAAA TTGAAGTAGA  1100
TCCACAATTC ATTGCGCAGT TGATGGAACA GCTTGATGTC TTCATCAGTA  1150
TTAAACCAAA GCCCAAACAG CCAAGCAAGT CTGTGATTGT GAAAAGTGTT  1200
GAGCGAAATG CCTTAAATAT GTATGAAGCA AGGAAATGTC TCCTCGGACT  1250
TGAAAGCAGT GGGGTTACCA TAGCAACCAG TCCATCCCCA GCATCCTGCC  1300
CTGCCGGCCT GGCATGTCCC AGCCTGGATA TCTTAGCTTC AGCAGGCCTT  1350
GGACTCACTG GACTAGGTCT TTTGGGACCC ACCACCTTAT CTCTGAACAC  1400
TTCAACAACC CCAAACTCAC TCTTGAATGC TCTTAATAGC TCAGTCAGTC  1450
CTTTGCAAAG TCCAAGTTCT GGTACACCCA GCCCCACATT ATGGGCACCC  1500
CCACTTGCTA ATACTTCAAG TGCCACAGGT TTTTCTGCTA TACCACACCT  1550
TATGATTCCA TCTACTGCCC AAGCCACATT AACTAATATT TTGTTGTCTG  1600
GAGTGCCCAC CTATGGGCAC ACAGCTCCAT CTCCCCCTCC TGGCTTGACT  1650
CCTGTTGATG TCCATATCAA CAGTATGCAG ACCGAAGGCA AAAAAATCTC  1700
TGCTGCTTTA AATGGACATG CACAGTCTCC AGATATAAAA TATGGTGCAA  1750
TATCCACTTC ATCACTTGGA GAAAAAGTGC TGAGTGCAAA TCACGGGGAT  1800
CCGTCCATCC AGACAAGTGG GTCTGAGCAG ACATCTCCCA AATCAAGCCC  1850
CACTGAAGGT TGTAATGATG CTTTTGTTGA AGTAGGCATG CCTCGAAGTC  1900
CTTCCCATTC TGGGAATGCT GGTGACTTGA AACAGATGAT GTGTCCCTCC  1950
AAGGTTTCCT GTGCCAAAAG GCAGACAGTG GAACTATTGC AAGGCACGAA  2000
AAACTCACAC TTACACAGCA CTGACAGGTT GCTCTCAGAC CCTGAACTGA  2050
GTGCTACCGA AAGCCCTTTG GCTGACAAGA AGGCTCCAGG GAGTGAGCGC  2100
GCTGCAGAGA GGGCAGCAGC TGCCCAGCAA AACTCCGAAA GGGCCCACCT  2150
TGCTCCACGG TCATCATATG TCAACATGCA GGCATTTGAC TATGAACAGA  2200
AGAAGCTATT AGCCACCAAA GCTATGTTAA AGAAACCAGT GGTGACGGAG  2250
GTCAGAACGC CCACAAATAC CTGGAGTGGC CTGGGTTTTT CTAAATCCAT  2300
GCCAGCTGAA ACTATCAAGG AGTTGAGAAG GCCAATCAT GTGTCCTATA  2350
AGCCCACAAT GACAACCACT TATGAGGGCT CATCCATGTC CCTTTCACGG  2400
TCCAACAGTC GTGAGCACTT GGGAGGTGGA AGCGAATCTG ATAACTGGAG  2450
AGACCGAAAT GGAATTGGAC CTGGAAGTCA TAGTGAATTT GCAGCTTCTA  2500
TTGGCAGCCC TAAGCGTAAA CAAAACAAAT CAACGGAACA CTATCTCAGC  2550
AGTAGCAATT ACATGGACTG CATTTCCTCG CTGACAGGAA GCAATGGCTG  2600
TAACTTAAAT AGCTCTTTCA AAGGTTCTGA CCTCCCTGAG CTCTTCAGCA  2650
AACTGGGCCT GGGCAAATAC ACAGATGTTT TCCAGCAACA AGAGATCGAT  2700
```

FIG. 98B

```
CTTCAGACAT TCCTCACTCT CACAGATCAG GATCTGAAGG AGCTGGGAAT  2750
AACTACTTTT GGTGCCAGGA GGAAAATGCT GCTTGCAATT TCAGAACTAA  2800
ATAAAAACCG AAGAAAGCTT TTTGAATCGC CAAATGCACG CACCTCTTTC  2850
CTGGAAGGTG GAGCGAGTGG AAGGCTACCC CGTCAGTATC ACTCAGACAT  2900
TGCTAGTGTC AGTGGCCGCT GGTAGCAGCA CCCTCTTGGC ACATGCCCGC  2950
TGACTAACTG TAAAGTGGAC ACAGGAGATG TATGAACAGC CTTCACAGCA  3000
CACCATCCTT AGCACTCTGG GTGTCTGGTA TCAGGACCAA AGCATTTTAT  3050
TCGCACCTGT ACTTTATGGC AAAAAGGAAG AAGAGAGAGA AGATGTTCTT  3100
ATGATGTCAT ACAGAACAC (SEQ ID NO: 107)
```

FIG. 99

```
MAAQGEPGYLAAQSDPGSNSERSTDSPVPGSEDDLVAGATLHSPEWSEERFRVDRKKLEA
MLQAAAEGKGRSGEDFFQKIMEETNTQIAWPSKLKIGAKSKKDPHIKVSGKKEDVKEAKE
MIMSVLDTKSNRVTLKMDVSHTEHSHVIGKGGNNIKKVMEETGCHIHFPDSNRNNQAEKS
NQVSIAGQPAGVESARVRIRELLPLVLMFELPIAGILQPVPDPNSPSIQHISQTYNISVS
FKQRSRMYGATVIVRGSQNNTSAVKEGTAMLLEHLAGSLASAIPVSTQLDIAAQHHLFMM
GRNGSNIKHIMQRTGAQIHFPDPSNPQKKSTVYLQGTIESVCLARQYLMGCLPLVLMFDM
KEEIEVDPQFIAQLMEQLDVFISIKPKPKQPSKSVIVKSVERNALNMYEARKCLLGLESS
GVTIATSPSPASCPAGLACPSLDILASAGLGLTGLGLLGPTTLSLNTSTTPNSLLNALNS
SVSPLQSPSSGTPSPTLWAPPLANTSSATGFSAIPHLMIPSTAQATLTNILLSGVPTYGH
TAPSPPPGLTPVDVHINSMQTEGKKISAALNGHAQSPDIKYGAISTSSLGEKVLSANHGD
PSIQTSGSEQTSPKSSPTEGCNDAFVEVGMPRSPSHSGNAGDLKQMMCPSKVSCAKRQTV
ELLQGTKNSHLHSTDRLLSDPELSATESPLADKKAPGSERAAERAAAAQQNSERAHLAPR
SSYVNMQAFDYEQKKLLATKAMLKKPVVTEVRTPTNTWSGLGFSKSMPAETIKELRRANH
VSYKPTMTTTYEGSSMSLSRSNSREHLGGGSESDNWRDRNGIGPGSHSEFAASIGSPKRK
QNKSTEHYLSSSNYMDCISSLTGSNGCNLNSSFKGSDLPELFSKLGLGKYTDVFQQQEID
LQTFLTLTDQDLKELGITTFGARRKMLLAISELNKNRRKLFESPNARTSFLEGGASGRLP
RQYHSDIASVSGRW- (SEQ ID NO: 108)
```

FIG. 100A

```
atgggcgcccctgcctgcgccctcgcgctctgcgtggccgtggccatcgtggccggcgcc    60
 M  G  A  P  A  C  A  L  A  L  C  V  A  V  A  I  V  A  G  A    20 tcctcggagtccttggggacggagcagcgcgtcgtggggcgagcggcagaagtcccgggc   120
 S  S  E  S  L  G  T  E  Q  R  V  V  G  R  A  A  E  V  P  G    40 ccagagcccggccagcaggagcagttggtcttcggcagcggggatgctgtggagctgagc   180
 P  E  P  G  Q  Q  E  Q  L  V  F  G  S  G  D  A  V  E  L  S    60 tgtcccccgcccggggggtggtcccatggggcccactgtctgggtcaaggatggcacaggg   240
 C  P  P  P  G  G  G  P  M  G  P  T  V  W  V  K  D  G  T  G    80 ctggtgccctcggagcgtgtcctggtggggccccagcggctgcaggtgctgaatgcctcc   300
 L  V  P  S  E  R  V  L  V  G  P  Q  R  L  Q  V  L  N  A  S   100 cacgaggactccggggcctacagctgccggcagcggctcacgcagcgcgtactgtgccac   360
 H  E  D  S  G  A  Y  S  C  R  Q  R  L  T  Q  R  V  L  C  H   120 ttcagtgtgcgggtgacagacgctccatcctcgggagatgacgaagacggggaggacgag   420
 F  S  V  R  V  T  D  A  P  S  S  G  D  D  E  D  G  E  D  E   140 gctgaggacacaggtgtggacacaggggccccttactggacacggcccgagcggatggac   480
 A  E  D  T  G  V  D  T  G  A  P  Y  W  T  R  P  E  R  M  D   160 aagaagctgctggccgtgccggccgccaacaccgtccgcttccgctgcccagccgctggc   540
 K  K  L  L  A  V  P  A  A  N  T  V  R  F  R  C  P  A  A  G   180 aaccccactccctccatctcctggctgaagaacggcagggagttccgcggcgagcaccgc   600
 N  P  T  P  S  I  S  W  L  K  N  G  R  E  F  R  G  E  H  R   200 attggaggcatcaagctgcggcatcagcagtggagcctggtcatggaaagcgtggtgccc   660
 I  G  G  I  K  L  R  H  Q  Q  W  S  L  V  M  E  S  V  V  P   220 tcggaccgcggcaactacacctgcgtcgtggagaacaagtttggcagcatccggcagacg   720
 S  D  R  G  N  Y  T  C  V  V  E  N  K  F  G  S  I  R  Q  T   240 tacacgctggacgtgctggagcgctccccgcaccggcccatcctgcaggcggggctgccg   780
 Y  T  L  D  V  L  E  R  S  P  H  R  P  I  L  Q  A  G  L  P   260 gccaaccagacggcggtgctgggcagcgacgtggagttccactgcaaggtgtacagtgac   840
 A  N  Q  T  A  V  L  G  S  D  V  E  F  H  C  K  V  Y  S  D   280 gcacagccccacatccagtggctcaagcacgtggaggtgaatggcagcaaggtgggcccg   900
 A  Q  P  H  I  Q  W  L  K  H  V  E  V  N  G  S  K  V  G  P   300 gacggcacaccctacgttaccgtgctcaagacggcgggcgctaacaccaccgacaaggag   960
 D  G  T  P  Y  V  T  V  L  K  T  A  G  A  N  T  T  D  K  E   320 ctagaggttctctccttgcacaacgtcacctttgaggacgccggggagtacacctgcctg  1020
 L  E  V  L  S  L  H  N  V  T  F  E  D  A  G  E  Y  T  C  L   340 gcgggcaattctattgggttttctcatcactctgcgtggctggtggtgctgccagccgag  1080
 A  G  N  S  I  G  F  S  H  H  S  A  W  L  V  V  L  P  A  E   360
```

FIG. 100B

```
gaggagctggtggaggctgacgaggcgggcagtgtgtatgcaggcatcctcagctacggg  1140
 E   E   L   V   E   A   D   E   A   G   S   V   Y   A   G   I   L   S   Y   G    380 gtgggcttcttcctgttcatcctggtggtggcggctgtgacgctctgccgcctgcgcagc  1200
 V   G   F   F   L   F   I   L   V   V   A   A   V   T   L   C   R   L   R   S    400 cccccaagaaaggcctgggctcccccaccgtgcacaagatctcccgcttcccgctcaag   1260
 P   P   K   K   G   L   G   S   P   T   V   H   K   I   S   R   F   P   L   K    420 cgacaggtgtccctggagtccaacgcgtccatgagctccaacacaccactggtgcgcatc  1320
 R   Q   V   S   L   E   S   N   A   S   M   S   S   N   T   P   L   V   R   I    440 gcaaggctgtcctcaggggagggccccacgctggccaatgtctccgagctcgagctgcct  1380
 A   R   L   S   S   G   E   G   P   T   L   A   N   V   S   E   L   E   L   P    460 gccgaccccaaatggagctgtctcgggcccggctgaccctgggcaagcccttggggag    1440
 A   D   P   K   W   E   L   S   R   A   R   L   T   L   G   K   P   L   G   E    480 ggctgcttcggccaggtggtcatggcggaggccatcggcattgacaaggaccgggccgcc  1500
 G   C   F   G   Q   V   V   M   A   E   A   I   G   I   D   K   D   R   A   A    500 aagcctgtcaccgtagccgtgaagatgctgaaagacgatgccactgacaaggacctgtcg  1560
 K   P   V   T   V   A   V   K   M   L   K   D   D   A   T   D   K   D   L   S    520 gacctggtgtctgagatggagatgatgaagatgatcgggaaacacaaaaacatcatcaac  1620
 D   L   V   S   E   M   E   M   M   K   M   I   G   K   H   K   N   I   I   N    540 ctgctgggcgcctgcacgcagggcgggcccctgtacgtgctggtggagtacgcggccaag  1680
 L   L   G   A   C   T   Q   G   G   P   L   Y   V   L   V   E   Y   A   A   K    560 ggtaacctgcgggagtttctgcgggcgcggcggccccccgggcctggactactccttcgac  1740
 G   N   L   R   E   F   L   R   A   R   R   P   P   G   L   D   Y   S   F   D    580 acctgcaagccgccccgaggagcagctcaccttcaaggacctggtgtcctgtgcctaccag  1800
 T   C   K   P   P   E   E   Q   L   T   F   K   D   L   V   S   C   A   Y   Q    600 gtggcccggggcatggagtacttggcctcccagaagtgcatccacagggacctggctgcc  1860
 V   A   R   G   M   E   Y   L   A   S   Q   K   C   I   H   R   D   L   A   A    620 cgcaatgtgctggtgaccgaggacaacgtgatgaagatcgcagacttcgggctggcccgg  1920
 R   N   V   L   V   T   E   D   N   V   M   K   I   A   D   F   G   L   A   R    640 gacgtgcacaacctcgactactacaagaagacaaccaacggccggctgcccgtgaagtgg  1980
 D   V   H   N   L   D   Y   Y   K   K   T   T   N   G   R   L   P   V   K   W    660 atggcgcctgaggccttgtttgaccgagtctacactcaccagagtgacgtctggtccttt  2040
 M   A   P   E   A   L   F   D   R   V   Y   T   H   Q   S   D   V   W   S   F    680 ggggtcctgctctgggagatcttcacgctggggggctccccgtaccccggcatccctgtg  2100
 G   V   L   L   W   E   I   F   T   L   G   G   S   P   Y   P   G   I   P   V    700 gaggagctcttcaagctgctgaaggagggccaccgcatggacaagcccgccaactgcaca  2160
 E   E   L   F   K   L   L   K   E   G   H   R   M   D   K   P   A   N   C   T    720
```

FIG. 100C

```
cacgacctgtacatgatcatgcgggagtgctggcatgccgcgccctcccagaggcccacc 2220
 H   D   L   Y   M   I   M   R   E   C   W   H   A   A   P   S   Q   R   P   T    740 ttcaagcagctggtggaggacctggaccgtgtccttaccgtgacgtccaccgacatggat 2280
 F   K   Q   L   V   E   D   L   D   R   V   L   T   V   T   S   T   D   M   D    760 gagatcaaagggaaagaccgtgtgattctggccttggagaaggaacttggcgtgcaggct 2340
 E   I   K   G   K   D   R   V   I   L   A   L   E   K   E   L   G   V   Q   A    780 gggcagacccagaagctgcttctgcagaaagaggctttggatgagcagctggttcaggtc 2400
 G   Q   T   Q   K   L   L   L   Q   K   E   A   L   D   E   Q   L   V   Q   V    800 aaggaggccgagcggcaccacagtagtccaaagagagagctcccgcccgggatcggggac 2460
 K   E   A   E   R   H   H   S   S   P   K   R   E   L   P   P   G   I   G   D    820 atggtggagctcatgggcgtccaggatcaacatatggacgagcgagatgtgaggcgattt 2520
 M   V   E   L   M   G   V   Q   D   Q   H   M   D   E   R   D   V   R   R   F    840 caactaaaaattgctgaactgaattcagtgatacggaagctggaagacagaaatacgctg 2580
 Q   L   K   I   A   E   L   N   S   V   I   R   K   L   E   D   R   N   T   L    860 ttggcagatgagaggaatgaactgctgaaacgctcacgagagaccgaggttcagctgaag 2640
 L   A   D   E   R   N   E   L   L   K   R   S   R   E   T   E   V   Q   L   K    880 cccctggtggagaagaacaagcggatgaacaagaagaatgaggatctgttgcagagtatc 2700
 P   L   V   E   K   N   K   R   M   N   K   K   N   E   D   L   L   Q   S   I    900 cagaggatggaggagaaaatcaagaacctcacgcgggaaaacgtggaaatgaaagaaaag 2760
 Q   R   M   E   E   K   I   K   N   L   T   R   E   N   V   E   M   K   E   K    920 ctgtcagcgcaggcgtctctgaagcggcatacctccttgaatgacctcagcctgacgagg 2820
 L   S   A   Q   A   S   L   K   R   H   T   S   L   N   D   L   S   L   T   R    940 gatgagcaggagatcgagttcctgaggctgcaggtgctggagcagcagcacgtcattgac 2880
 D   E   Q   E   I   E   F   L   R   L   Q   V   L   E   Q   Q   H   V   I   D    960 gacctctcactggagagagaacggctgttgcgctccaaaaggcatcgagggaaaagtctg 2940
 D   L   S   L   E   R   E   R   L   L   R   S   K   R   H   R   G   K   S   L    980 aaaccgcccaagaagcatgttgtggagacattttttggatttgatgaggagtctgtggac 3000
 K   P   P   K   K   H   V   V   E   T   F   F   G   F   D   E   E   S   V   D   1000 tcagaaacgttgtccgaaacatcctacaacacagacaggacagacaggaccccagccacg 3060
 S   E   T   L   S   E   T   S   Y   N   T   D   R   T   D   R   T   P   A   T   1020 cccgaagaagacttggacgatgccacagcccgagaggaggctgacctgcgcttctgccag 3120
 P   E   E   D   L   D   D   A   T   A   R   E   E   A   D   L   R   F   C   Q   1040 ctgacccggggagtaccaggccctgcaacgcgcctacgccctgctccaggagcaggtggga 3180
 L   T   R   E   Y   Q   A   L   Q   R   A   Y   A   L   L   Q   E   Q   V   G   1060 ggcacgctggacgctgagagggaggcccggactcgggagcagctacaagctgatctgctg 3240
 G   T   L   D   A   E   R   E   A   R   T   R   E   Q   L   Q   A   D   L   L   1080
```

FIG. 100D

```
aggtgtcaggccaaaatcgaagatttggagaagttactggttgagaagggacaggattcc 3300
 R  C  Q  A  K  I  E  D  L  E  K  L  L  V  E  K  G  Q  D  S  1100 aagtgggttgaagagaagcagctgctcatcagaacaaaccaagacttgctggaaaagatt 3360
 K  W  V  E  E  K  Q  L  L  I  R  T  N  Q  D  L  L  E  K  I  1120 tacagactggaaatggaagagaaccagctgaagaatgaaatgcaagacgccaaggatcag 3420
 Y  R  L  E  M  E  E  N  Q  L  K  N  E  M  Q  D  A  K  D  Q  1140 aacgagctgttagaattcagagtgctagaactcgaagagagagagaggaggtcgccagca 3480
 N  E  L  L  E  F  R  V  L  E  L  E  E  R  E  R  R  S  P  A  1160 tttaacctccaaatcaccaccttccccgagaaccacagcagcgctctccagctgttctgt 3540
 F  N  L  Q  I  T  T  F  P  E  N  H  S  S  A  L  Q  L  F  C  1180 caccaggaaggagttaaggatgtgaatgtttctgaacttatgaagaaattagatatcctt 3600
 H  Q  E  G  V  K  D  V  N  V  S  E  L  M  K  K  L  D  I  L  1200 ggcgataacgggaatttgagaaatgaagaacaggttgcaataatccaagctggaactgtg 3660
 G  D  N  G  N  L  R  N  E  E  Q  V  A  I  I  Q  A  G  T  V  1220 cttgccctgtgtgaaaagtggctgaagcaaatagaggggaccgaggccgccctgacccag 3720
 L  A  L  C  E  K  W  L  K  Q  I  E  G  T  E  A  A  L  T  Q  1240 aagatgctggacctggagaaggagaaggacctgttcagcaggcagaagggctacctggaa 3780
 K  M  L  D  L  E  K  E  K  D  L  F  S  R  Q  K  G  Y  L  E  1260 gaggagctcgactaccggaagcaagcccttgaccaggcttacctgaaaatccaagacctg 3840
 E  E  L  D  Y  R  K  Q  A  L  D  Q  A  Y  L  K  I  Q  D  L  1280 gaggccacactgtacacagcgctgcagcaggagccggggcggagggccggtgaggcgctg 3900
 E  A  T  L  Y  T  A  L  Q  Q  E  P  G  R  R  A  G  E  A  L  1300 agcgagggccagcgggaggacctgcaggctgctgtggaaaaggtgcgcaggcagatcctc 3960
 S  E  G  Q  R  E  D  L  Q  A  A  V  E  K  V  R  R  Q  I  L  1320 aggcagagccgcgagttcgacagccagatcctgcgggagcgcatggagctgctgcagcag 4020
 R  Q  S  R  E  F  D  S  Q  I  L  R  E  R  M  E  L  L  Q  Q  1340 gcccagcagagaatccgagaactggaggacaaactggagtttcagaagcggcacctgaaa 4080
 A  Q  Q  R  I  R  E  L  E  D  K  L  E  F  Q  K  R  H  L  K  1360 gaactggaggaaaagttttgttcctttttttgttttctcactagcattcattctgtgg 4140
 E  L  E  E  K  F  L  F  L  F  L  F  F  S  L  A  F  I  L  W  1380 ccttga (SEQ ID NO: 109)
 P  -   (SEQ ID NO: 110)
```

FIG. 101A

```
GGTGCCGTGC CTGAGCCGGG CGCGGGCGAC CGAGGGAGCT GCAGCCACCC    50
GCGTGCGGCA CGCGCCGGCC GCCTGCCCGG ATCGCGGCCA CCAGTGCCGC   100
GGCCTCTCGA CTCCCGCCCC GCCGAGCCGC GCGCGCGACT GCCATCCTCC   150
TCAATTGCTT TTTACGATTT TTTTTGTGCA TGCATTCATT TTCTGTTCCG   200
TTTTGTCCTT TTTAAGGCGG TGGCGGCGGC GACAGCGGCG TAAGCTCGCA   250
GCGGGGAGGG GGCGGCCGGA GGATGCGGCG CGGGGCTGCG CTCGCTACGT   300
CCGCTGCTGC TGCCCGGCTC GGGCCTGAGC GCCGAGCAGG ATCCCAAGTG   350
ATGGTGGTTT CCTCGGAGGG CGAGCTGAGT CCTGCGCGAC TGGTTAGCAC   400
GGTGGAGCTG GTAGCCACGC CTGCTGGCTG GCGTGCGTGA ACAGGTGTGG   450
ACCGCAGGAT CTCAGCACTC TGACCCAAGG GGAAGCATGT CGAAGAAAGG   500
CCGGAGCAAG GGCGAGAAGC CCGAGATGGA GACGGACGCG GTGCAGATGG   550
CCAACGAGGA GCTGCGGGCC AAGCTGACCA GCATTCAGAT CGAGTTCCAG   600
CAGGAAAAAA GCAAGGTGGG CAAACTGCGC GAGCGGCTGC AGGAGGCGAA   650
GCTGGAGCGC GAGCAGGAGC AGCGACGGCA CACGGCCTAC ATTTCGGAGC   700
TCAAGGCCAA GCTGCATGAG GAGAAGACCA AGGAGCTGCA GGCGCTGCGC   750
GAGGGGCTCA TCCGGCAGCA CGAGCAGGAG GCGGCGCGCA CCGCCAAGAT   800
CAAGGAGGGC GAGCTGCAGC GGCTGCAGGC CACGCTGAAC GTGCTGCGCG   850
ACGGCGCGGC CGACAAGGTC AAGACGGCGC TGCTGACCGA GGCGCGCGAG   900
GAGGCGCGCA GGGCCTTCGA TGGAGAGCGC CTGCGGCTGC AGCAGGAGAT   950
CCTGGAGCTC AAGGCAGCGC GCAAGCAGGC AGAGGAGGCG CTCAGTAACT  1000
GCATGCAGGC TGACAAGACC AAGGCAGCCG ACCTGCGTGC CGCCTACCAG  1050
GCGCACCAAG ACGAGGTGCA CCGCATCAAG CGCGAGTGCG AGCGCGACAT  1100
CCGCAGGCTG ATGGATGAGA TCAAAGGGAA AGACCGTGTG ATTCTGGCCT  1150
TGGAGAAGGA ACTTGGCGTG CAGGCTGGGC AGACCCAGAA GCTGCTTCTG  1200
CAGAAAGAGG CTTTGGATGA GCAGCTGGTT CAGGTCAAGG AGGCCGAGCG  1250
GCACCACAGT AGTCCAAAGA GAGAGCTCCC GCCCGGGATC GGGGACATGG  1300
TGGAGCTCAT GGGCGTCCAG GATCAACATA TGGACGAGCG AGATGTGAGG  1350
CGATTTCAAC TAAAAATTGC TGAACTGAAT TCAGTGATAC GGAAGCTGGA  1400
AGACAGAAAT ACGCTGTTGG CAGATGAGAG GAATGAACTG CTGAAACGCT  1450
CACGAGAGAC CGAGGTTCAG CTGAAGCCCC TGGTGGAGAA GAACAAGCGG  1500
ATGAACAAGA AGAATGAGGA TCTGTTGCAG AGTATCCAGA GGATGGAGGA  1550
GAAAATCAAG AACCTCACGC GGGAAAACGT GGAAATGAAA GAAAAGCTGT  1600
CAGCGCAGGC GTCTCTGAAG CGGCATACCT CCTTGAATGA CCTCAGCCTG  1650
ACGAGGGATG AGCAGGAGAT CGAGTTCCTG AGGCTGCAGG TGCTGGAGCA  1700
GCAGCACGTC ATTGACGACC TCTCACTGGA GAGAGAACGG CTGTTGCGCT  1750
CCAAAAGGCA TCGAGGGAAA AGTCTGAAAC CGCCCAAGAA GCATGTTGTG  1800
GAGACATTTT TTGGATTTGA TGAGGAGTCT GTGGACTCAG AAACGTTGTC  1850
CGAAACATCC TACAACACAG ACAGGACAGA CAGGACCCCA GCCACGCCCG  1900
AAGAAGACTT GGACGATGCC ACAGCCCGAG AGGAGGCTGA CCTGCGCTTC  1950
TGCCAGCTGA CCCGGGAGTA CCAGGCCCTG CAACGCGCCT ACGCCCTGCT  2000
CCAGGAGCAG GTGGGAGGCA CGCTGGACGC TGAGAGGGAG GCCCGGACTC  2050
GGGAGCAGCT ACAAGCTGAT CTGCTGAGGT GTCAGGCCAA AATCGAAGAT  2100
TTGGAGAAGT TACTGGTTGA GAAGGGACAG GATTCCAAGT GGGTTGAAGA  2150
GAAGCAGCTG CTCATCAGAA CAAACCAAGA CTTGCTGGAA AAGATTTACA  2200
GACTGGAAAT GGAAGAGAAC CAGCTGAAGA ATGAAATGCA AGACGCCAAG  2250
GATCAGAACG AGCTGTTAGA ATTCAGAGTG CTAGAACTCG AAGAGAGAGA  2300
GAGGAGGTCG CCAGCATTTA ACCTCCAAAT CACCACCTTC CCCGAGAACC  2350
ACAGCAGCGC TCTCCAGCTG TTCTGTCACC AGGAAGGAGT TAAGGATGTG  2400
AATGTTTCTG AACTTATGAA GAAATTAGAT ATCCTTGGCG ATAACGGAAA  2450
TTTGAGAAAT GAAGAACAGG TTGCAATAAT CCAAGCTGGA ACTGTGCTTG  2500
CCCTGTGTGA AAAGTGGCTG AAGCAAATAG AGGGGACCGA GGCCGCCCTG  2550
ACCCAGAAGA TGCTGGACCT GGAGAAGGAG AAGGACCTGT TCAGCAGGCA  2600
GAAGGGCTAC CTGGAAGAGG AGCTCGACTA CCGGAAGCAA GCCCTTGACC  2650
AGGCTTACCT GAAAATCCAA GACCTGGAGG CCACACTGTA CACAGCGCTG  2700
```

FIG. 101B

```
CAGCAGGAGC CGGGGCGGAG GGCCGGTGAG GCGCTGAGCG AGGGCCAGCG  2750
GGAGGACCTG CAGGCTGCTG TGGAAAAGGT GCGCAGGCAG ATCCTCAGGC  2800
AGAGCCGCGA GTTCGACAGC CAGATCCTGC GGGAGCGCAT GGAGCTGCTG  2850
CAGCAGGCCC AGCAGAGAAT CCGAGAACTG GAGGACAAAC TGGAGTTTCA  2900
GAAGCGGCAC CTGAAAGAAC TGGAGGAAAA GTTTTTGTTC CTTTTTTTGT  2950
TTTCTCACT AGCATTCATT CTGTGGCCT_T_ _GA_TGACTTCA GTGAGCCAAG  3000
AACTCGGGTT G (SEQ ID NO: 111)
```

FIG. 102

```
MSKKGRSKGEKPEMETDAVQMANEELRAKLTSIQIEFQQEKSKVGKLRERLQEAKLEREQ
EQRRHTAYISELKAKLHEEKTKELQALREGLIRQHEQEAARTAKIKEGELQRLQATLNVL
RDGAADKVKTALLTEAREEARRAFDGERLRLQQEILELKAARKQAEEALSNCMQADKTKA
ADLRAAYQAHQDEVHRIKRECERDIRRLMDEIKGKDRVILALEKELGVQAGQTQKLLLQK
EALDEQLVQVKEAERHHSSPKRELPPGIGDMVELMGVQDQHMDERDVRRFQLKIAELNSV
IRKLEDRNTLLADERNELLKRSRETEVQLKPLVEKNKRMNKKNEDLLQSIQRMEEKIKNL
TRENVEMKEKLSAQASLKRHTSLNDLSLTRDEQEIEFLRLQVLEQQHVIDDLSLERERLL
RSKRHRGKSLKPPKKHVVETFFGFDEESVDSETLSETSYNTDRTDRTPATPEEDLDDATA
REEADLRFCQLTREYQALQRAYALLQEQVGGTLDAEREARTREQLQADLLRCQAKIEDLE
KLLVEKGQDSKWVEEKQLLIRTNQDLLEKIYRLEMEENQLKNEMQDAKDQNELLEFRVLE
LEERERRSPAFNLQITTFPENHSSALQLFCHQEGVKDVNVSELMKKLDILGDNGNLRNEE
QVAIIQAGTVLALCEKWLKQIEGTEAALTQKMLDLEKEKDLFSRQKGYLEEELDYRKQAL
DQAYLKIQDLEATLYTALQQEPGRRAGEALSEGQREDLQAAVEKVRRQILRQSREFDSQI
LRERMELLQQAQQRIRELEDKLEFQKRHLKELEEKFLFLFLFFSLAFILWP-
(SEQ ID NO: 112)
```

FIG. 103A

```
atgaggctgctgaccctcctgggccttctgtgtggctcggtggccacccccttgggcccg    60
 M  R  L  L  T  L  L  G  L  L  C  G  S  V  A  T  P  L  G  P    20 aagtggcctgaacctgtgttcgggcgcctggcatccccggctttccaggggagtatgcc   120
 K  W  P  E  P  V  F  G  R  L  A  S  P  G  F  P  G  E  Y  A    40 aatgaccaggagcggcgctggaccctgactgcaccccccggctaccgcctgcgcctctac   180
 N  D  Q  E  R  R  W  T  L  T  A  P  P  G  Y  R  L  R  L  Y    60 ttcacccacttcgacctggagctctcccacctctgcgagtacgacttcgtcaagctgagc   240
 F  T  H  F  D  L  E  L  S  H  L  C  E  Y  D  F  V  K  L  S    80 tcgggggccaaggtgctggccacgctgtgcgggcaggagagcacagacacggagcgggcc   300
 S  G  A  K  V  L  A  T  L  C  G  Q  E  S  T  D  T  E  R  A   100 cctggcaaggacactttctactcgctgggctccagcctggacattaccttccgctccgac   360
 P  G  K  D  T  F  Y  S  L  G  S  S  L  D  I  T  F  R  S  D   120 tactccaacgagaagccgttcacggggttcgaggccttctatgcagccgaggatacccag   420
 Y  S  N  E  K  P  F  T  G  F  E  A  F  Y  A  A  E  D  T  Q   140 tatctccaagataccatgaaccatgtcctaagctgtgtcaagaaggagaaggaacgtaca   480
 Y  L  Q  D  T  M  N  H  V  L  S  C  V  K  K  E  K  E  R  T   160 gcggccttccaagccctggggctactttctgtggctgtgaggtctgagtttaaggtctat   540
 A  A  F  Q  A  L  G  L  L  S  V  A  V  R  S  E  F  K  V  Y   180 ttgcctcgcgtgctggacatcatccgagcggccctgcccccaaaggacttcgcccataag   600
 L  P  R  V  L  D  I  I  R  A  A  L  P  P  K  D  F  A  H  K   200 aggcagaaggcaatgcaggtggatgccacagtcttcacttgcatcagcatgctggctcga   660
 R  Q  K  A  M  Q  V  D  A  T  V  F  T  C  I  S  M  L  A  R   220 gcaatggggccaggcatccagcaggatatcaaggagctgctggagcccatgctggcagtg   720
 A  M  G  P  G  I  Q  Q  D  I  K  E  L  L  E  P  M  L  A  V   240 ggactaagccctgccctcactgcagtgctctacgacctgagccgtcagattccacagcta   780
 G  L  S  P  A  L  T  A  V  L  Y  D  L  S  R  Q  I  P  Q  L   260 aagaaggacattcaagatgggctactgaaaatgctgtccctggtccttatgcacaaaccc   840
 K  K  D  I  Q  D  G  L  L  K  M  L  S  L  V  L  M  H  K  P   280 cttcgccacccaggcatgcccaagggcctggcccatcagctggcctctcctggcctcacg   900
 L  R  H  P  G  M  P  K  G  L  A  H  Q  L  A  S  P  G  L  T   300 accctccctgaggccagcgatgtgggcagcatcactcttgccctccgaacgcttggcagc   960
 T  L  P  E  A  S  D  V  G  S  I  T  L  A  L  R  T  L  G  S   320 tttgaatttgaaggccactctctgacccaatttgttcgccactgtgcggatcatttcctg  1020
 F  E  F  E  G  H  S  L  T  Q  F  V  R  H  C  A  D  H  F  L   340 aacagtgagcacaaggagatccgcatggaggctgcccgcacctgctcccgcctgctcaca  1080
 N  S  E  H  K  E  I  R  M  E  A  A  R  T  C  S  R  L  L  T   360
```

FIG. 103B

```
ccctccatccacctcatcagtggccatgctcatgtggttagccagaccgcagtgcaagtg 1140
 P   S   I   H   L   I   S   G   H   A   H   V   V   S   Q   T   A   V   Q   V   380 gtggcagatgtgcttagcaaactgctcgtagttgggataacagatcctgaccctgacatt 1200
 V   A   D   V   L   S   K   L   L   V   V   G   I   T   D   P   D   P   D   I   400 cgctactgtgtcttggcgtccctggacgagcgctttgatgcacacctggcccaggcggag 1260
 R   Y   C   V   L   A   S   L   D   E   R   F   D   A   H   L   A   Q   A   E   420 aacttgcaggccttgtttgtggctctgaatgaccaggtgtttgagatccgggagctggcc 1320
 N   L   Q   A   L   F   V   A   L   N   D   Q   V   F   E   I   R   E   L   A   440 atctgcactgtgggccgactcagtagcatgaaccctgcctttgtcatgcctttcctgcgc 1380
 I   C   T   V   G   R   L   S   S   M   N   P   A   F   V   M   P   F   L   R   460 aagatgctcatccagattttgacagagttggagcacagtgggattggaagaatcaaagag 1440
 K   M   L   I   Q   I   L   T   E   L   E   H   S   G   I   G   R   I   K   E   480 cagagtgcccgcatgctggggcacctggtctccaatgccccccgactcatccgcccctac 1500
 Q   S   A   R   M   L   G   H   L   V   S   N   A   P   R   L   I   R   P   Y   500 atggagcctattctgaaggcattaattttgaaactgaaagatccagaccctgatccaaac 1560
 M   E   P   I   L   K   A   L   I   L   K   L   K   D   P   D   P   D   P   N   520 ccaggtgtgatcaataatgtcctggcaacaataggagaattggcacaggttagtggcctg 1620
 P   G   V   I   N   N   V   L   A   T   I   G   E   L   A   Q   V   S   G   L   540 gaaatgaggaaatgggttgatgaactttttattatcatcatggacatgctccaggattcc 1680
 E   M   R   K   W   V   D   E   L   F   I   I   I   M   D   M   L   Q   D   S   560 tctttgttggccaaaaggcaggtggctctgtggaccctgggacagttggtggccagcact 1740
 S   L   L   A   K   R   Q   V   A   L   W   T   L   G   Q   L   V   A   S   T   580 ggctatgtagtagagccctacaggaagtaccctactttgcttgaggtgctactgaatttt 1800
 G   Y   V   V   E   P   Y   R   K   Y   P   T   L   L   E   V   L   L   N   F   600 ctgaagactgagcagaaccagggtacacgcagagaggccatccgtgtgttagggctttta 1860
 L   K   T   E   Q   N   Q   G   T   R   R   E   A   I   R   V   L   G   L   L   620 ggggctttggatccttacaagcacaaagtgaacattggcatgatagaccagtcccgggat 1920
 G   A   L   D   P   Y   K   H   K   V   N   I   G   M   I   D   Q   S   R   D   640 gcctctgctgtcagcctgtcagaatccaagtcaagtcaggattcctctgactatagcact 1980
 A   S   A   V   S   L   S   E   S   K   S   S   Q   D   S   S   D   Y   S   T   660 agtgaaatgctggtcaacatgggaaacttgcctctggatgagttctacccagctgtgtcc 2040
 S   E   M   L   V   N   M   G   N   L   P   L   D   E   F   Y   P   A   V   S   680 atggtggccctgatgcggatcttccgagaccagtcactctctcatcatcacaccatggtt 2100
 M   V   A   L   M   R   I   F   R   D   Q   S   L   S   H   H   H   T   M   V   700 gtccaggccatcaccttcatcttcaagtccctgggactcaaatgtgtgcagttcctgccc 2160
 V   Q   A   I   T   F   I   F   K   S   L   G   L   K   C   V   Q   F   L   P   720
```

FIG. 103C

```
caggtcatgcccacgttccttaacgtcattcgagtctgtgatggggccatccgggaattt 2220
 Q   V   M   P   T   F   L   N   V   I   R   V   C   D   G   A   I   R   E   F   740 ttgttccagcagctgggaatgttggtgtcctttgtgaagagccacatcagaccttatatg 2280
 L   F   Q   Q   L   G   M   L   V   S   F   V   K   S   H   I   R   P   Y   M   760 gatgaaatagtcaccctcatgagagaattctgggtcatgaacacctcaattcagagcacg 2340
 D   E   I   V   T   L   M   R   E   F   W   V   M   N   T   S   I   Q   S   T   780 atcattcttctcattgagcaaattgtggtagctcttgggggtgaatttaagctctacctg 2400
 I   I   L   L   I   E   Q   I   V   V   A   L   G   G   E   F   K   L   Y   L   800 ccccagctgatcccacacatgctgcgtgtcttcatgcatgacaacagcccaggccgcatt 2460
 P   Q   L   I   P   H   M   L   R   V   F   M   H   D   N   S   P   G   R   I   820 gtctctatcaagttactggctgcaatccagctgtttggcgccaacctggatgactacctg 2520
 V   S   I   K   L   L   A   A   I   Q   L   F   G   A   N   L   D   D   Y   L   840 catttactgctgcctccattgttaagttgtttgatgcccctgaagctccactgccatct 2580
 H   L   L   L   P   P   I   V   K   L   F   D   A   P   E   A   P   L   P   S   860 cgaaaggcagcgctagagactgtggaccgcctgacggagtccctggatttcactgactat 2640
 R   K   A   A   L   E   T   V   D   R   L   T   E   S   L   D   F   T   D   Y   880 gcctcccggatcattcaccctattgttcgaacactggaccagagcccagaactgcgctcc 2700
 A   S   R   I   I   H   P   I   V   R   T   L   D   Q   S   P   E   L   R   S   900 acagccatggacacgctgtcttcacttgttttcagctggggaagaagtaccaaattttc 2760
 T   A   M   D   T   L   S   S   L   V   F   Q   L   G   K   K   Y   Q   I   F   920 attccaatggtgaataaagttctggtgcgacaccgaatcaatcatcagcgctatgatgtg 2820
 I   P   M   V   N   K   V   L   V   R   H   R   I   N   H   Q   R   Y   D   V   940 ctcatctgcagaattgtcaagggatacacacttgctgatgaagaggaggatcctttgatt 2880
 L   I   C   R   I   V   K   G   Y   T   L   A   D   E   E   E   D   P   L   I   960 taccagcatcggatgcttaggagtggccaaggggatgcattggctagtggaccagtggaa 2940
 Y   Q   H   R   M   L   R   S   G   Q   G   D   A   L   A   S   G   P   V   E   980 acaggacccatgaagaaactgcacgtcagcaccatcaacctccaaaaggcctggggcgct 3000
 T   G   P   M   K   K   L   H   V   S   T   I   N   L   Q   K   A   W   G   A   1000 gccaggagggtctccaaagatgactggctggaatggctgagacggctgagcctggagctg 3060
 A   R   R   V   S   K   D   D   W   L   E   W   L   R   R   L   S   L   E   L   1020 ctgaaggactcatcatcgccctccctgcgctcctgctgggccctggcacaggcctacaac 3120
 L   K   D   S   S   S   P   S   L   R   S   C   W   A   L   A   Q   A   Y   N   1040 ccgatggccagggatctcttcaatgctgcatttgtgtcctgctggtctgaactgaatgaa 3180
 P   M   A   R   D   L   F   N   A   A   F   V   S   C   W   S   E   L   N   E   1060 gatcaacaggatgagctcatcagaagcatcgagttggccctcacctcacaagacatcgct 3240
 D   Q   Q   D   E   L   I   R   S   I   E   L   A   L   T   S   Q   D   I   A   1080
```

FIG. 103D

```
gaagtcacacagaccctcttaaacttggctgaattcatggaacacagtgacaagggcccc 3300
 E  V  T  Q  T  L  L  N  L  A  E  F  M  E  H  S  D  K  G  P  1100 ctgccactgagagatgacaatggcattgttctgctgggtgagagagctgccaagtgccga 3360
 L  P  L  R  D  D  N  G  I  V  L  L  G  E  R  A  A  K  C  R  1120 gcatatgccaaagcactacactacaaagaactggagttccagaaaggcccccacccctgcc 3420
 A  Y  A  K  A  L  H  Y  K  E  L  E  F  Q  K  G  P  T  P  A  1140 attctagaatctctcatcagcattaataataagctacagcagccggaggcagcggccgga 3480
 I  L  E  S  L  I  S  I  N  N  K  L  Q  Q  P  E  A  A  A  G  1160 gtgttagaatatgccatgaaacactttggagagctggagatccaggctacctggtatgag 3540
 V  L  E  Y  A  M  K  H  F  G  E  L  E  I  Q  A  T  W  Y  E  1180 aaactgcacgagtgggaggatgcccttgtggcctatgacaagaaaatggacaccaacaag 3600
 K  L  H  E  W  E  D  A  L  V  A  Y  D  K  K  M  D  T  N  K  1200 gacgacccagagctgatgctgggccgcatgcgctgcctcgaggccttgggggaatggggt 3660
 D  D  P  E  L  M  L  G  R  M  R  C  L  E  A  L  G  E  W  G  1220 caactccaccagcagtgctgtgaaaagtggaccctggttaatgatgagacccaagccaag 3720
 Q  L  H  Q  Q  C  C  E  K  W  T  L  V  N  D  E  T  Q  A  K  1240 atggcccggatggctgctgcagctgcatggggtttaggtcagtgggacagcatggaagaa 3780
 M  A  R  M  A  A  A  A  A  W  G  L  G  Q  W  D  S  M  E  E  1260 tacacctgtatgatccctcgggacacccatgatggggcattttatagagctgtgctggca 3840
 Y  T  C  M  I  P  R  D  T  H  D  G  A  F  Y  R  A  V  L  A  1280 ctgcatcaggacctcttctccttggcacaacagtgcattgacaaggccagggacctgctg 3900
 L  H  Q  D  L  F  S  L  A  Q  Q  C  I  D  K  A  R  D  L  L  1300 gatgctgaattaactgcgatggcaggagagagttacagtcgggcatatggggccatggtt 3960
 D  A  E  L  T  A  M  A  G  E  S  Y  S  R  A  Y  G  A  M  V  1320 tcttgccacatgctgtccgagctggaggaggttatccagtacaaacttgtccccgagcga 4020
 S  C  H  M  L  S  E  L  E  E  V  I  Q  Y  K  L  V  P  E  R  1340 cgagagatcatccgccagatctggtgggagagactgcagggctgccagcgtatcgtagag 4080
 R  E  I  I  R  Q  I  W  W  E  R  L  Q  G  C  Q  R  I  V  E  1360 gactggcagaaaatccttatggtgcggtcccttgtggtcagccctcatgaagacatgaga 4140
 D  W  Q  K  I  L  M  V  R  S  L  V  V  S  P  H  E  D  M  R  1380 acctggctcaagtatgcaagcctgtgcggcaagagtggcaggctggctcttgctcataaa 4200
 T  W  L  K  Y  A  S  L  C  G  K  S  G  R  L  A  L  A  H  K  1400 actttagtgttgctcctgggagttgatccgtctcggcaacttgaccatcctctgccaaca 4260
 T  L  V  L  L  L  G  V  D  P  S  R  Q  L  D  H  P  L  P  T  1420 gttcaccctcaggtgacctatgcctacatgaaaaacatgtggaagagtgcccgcaagatc 4320
 V  H  P  Q  V  T  Y  A  Y  M  K  N  M  W  K  S  A  R  K  I  1440
```

FIG. 103E

```
gatgccttccagcacatgcagcattttgtccagaccatgcagcaacaggcccagcatgcc  4380
 D   A   F   Q   H   M   Q   H   F   V   Q   T   M   Q   Q   Q   A   Q   H   A  1460 atcgctactgaggaccagcagcataagcaggaactgcacaagctcatggcccgatgcttc  4440
 I   A   T   E   D   Q   Q   H   K   Q   E   L   H   K   L   M   A   R   C   F  1480 ctgaaacttggagagtggcagctgaatctacagggcatcaatgagagcacaatccccaaa  4500
 L   K   L   G   E   W   Q   L   N   L   Q   G   I   N   E   S   T   I   P   K  1500 gtgctgcagtactacagcgccgccacagagcacgaccgcagctggtacaaggcctggcat  4560
 V   L   Q   Y   Y   S   A   A   T   E   H   D   R   S   W   Y   K   A   W   H  1520 gcgtgggcagtgatgaacttcgaagctgtgctacactacaaacatcagaaccaagcccgc  4620
 A   W   A   V   M   N   F   E   A   V   L   H   Y   K   H   Q   N   Q   A   R  1540 gatgagaagaagaaactgcgtcatgccagcggggccaacatcaccaacgccaccactgcc  4680
 D   E   K   K   K   L   R   H   A   S   G   A   N   I   T   N   A   T   T   A  1560 gccaccacggccgccactgccaccaccactgccagcaccgagggcagcaacagtgagagc  4740
 A   T   T   A   A   T   A   T   T   T   A   S   T   E   G   S   N   S   E   S  1580 gaggccgagagcaccgagaacagcccccaccccatcgccgctgcagaagaaggtcactgag  4800
 E   A   E   S   T   E   N   S   P   T   P   S   P   L   Q   K   K   V   T   E  1600 gatctgtccaaaaccctcctgatgtacacggtgcctgccgtccagggcttcttccgttcc  4860
 D   L   S   K   T   L   L   M   Y   T   V   P   A   V   Q   G   F   F   R   S  1620 atctccttgtcacgaggcaacaacctccaggatacactcagagttctcaccttatggttt  4920
 I   S   L   S   R   G   N   N   L   Q   D   T   L   R   V   L   T   L   W   F  1640 gattatggtcactggccagatgtcaatgaggccttagtggagggggtgaaagccatccag  4980
 D   Y   G   H   W   P   D   V   N   E   A   L   V   E   G   V   K   A   I   Q  1660 attgatacctggctacaggttataccctcagctcattgcaagaattgatacgcccagaccc  5040
 I   D   T   W   L   Q   V   I   P   Q   L   I   A   R   I   D   T   P   R   P  1680 ttggtgggacgtctcattcaccagcttctcacagacattggtcggtaccaccccaggcc  5100
 L   V   G   R   L   I   H   Q   L   L   T   D   I   G   R   Y   H   P   Q   A  1700 ctcatctacccactgacagtggcttctaagtctaccacgacagcccggcacaatgcagcc  5160
 L   I   Y   P   L   T   V   A   S   K   S   T   T   A   R   H   N   A   A  1720 aacaagattctgaagaacatgtgtgagcacagcaacaccctggtccagcaggccatgatg  5220
 N   K   I   L   K   N   M   C   E   H   S   N   T   L   V   Q   Q   A   M   M  1740 gtgagcgaggagctgatccgagtggccatcctctggcatgagatgtggcatgaaggcctg  5280
 V   S   E   E   L   I   R   V   A   I   L   W   H   E   M   W   H   E   G   L  1760 gaagaggcatctcgtttgtactttggggaaaggaacgtgaaaggcatgtttgaggtgctg  5340
 E   E   A   S   R   L   Y   F   G   E   R   N   V   K   G   M   F   E   V   L  1780 gagcccttgcatgctatgatggaacggggcccccagactctgaaggaaacatccttaat  5400
 E   P   L   H   A   M   M   E   R   G   P   Q   T   L   K   E   T   S   F   N  1800
```

FIG. 103F

```
caggcctatggtcgagatttaatggaggcccaagagtggtgcaggaagtacatgaaatca  5460
 Q   A   Y   G   R   D   L   M   E   A   Q   E   W   C   R   K   Y   M   K   S   1820 gggaatgtcaaggacctcacccaagcctgggacctctattatcatgtgttccgacgaatc  5520
 G   N   V   K   D   L   T   Q   A   W   D   L   Y   Y   H   V   F   R   R   I   1840 tcaaagcagctgcctcagctcacatccttagagctgcaatatgtttccccaaaacttctg  5580
 S   K   Q   L   P   Q   L   T   S   L   E   L   Q   Y   V   S   P   K   L   L   1860 atgtgccgggaccttgaattggctgtgccaggaacatatgaccccaaccagccaatcatt  5640
 M   C   R   D   L   E   L   A   V   P   G   T   Y   D   P   N   Q   P   I   I   1880 cgcattcagtccatagcaccgtctttgcaagtcatcacatccaagcagaggccccggaaa  5700
 R   I   Q   S   I   A   P   S   L   Q   V   I   T   S   K   Q   R   P   R   K   1900 ttgacacttatgggcagcaacggacatgagtttgttttccttctaaaaggccatgaagat  5760
 L   T   L   M   G   S   N   G   H   E   F   V   F   L   L   K   G   H   E   D   1920 ctgcgccaggatgagcgtgtgatgcagctcttcggcctggttaacaccttctggccaat  5820
 L   R   Q   D   E   R   V   M   Q   L   F   G   L   V   N   T   L   L   A   N   1940 gacccaacatctcttcggaaaaacctcagcatccagagatacgctgtcatcccctttatcg  5880
 D   P   T   S   L   R   K   N   L   S   I   Q   R   Y   A   V   I   P   L   S   1960 accaactcgggcctcattggctgggttccccactgtgacacactgcacgccctcatccgg  5940
 T   N   S   G   L   I   G   W   V   P   H   C   D   T   L   H   A   L   I   R   1980 gactacagggagaagaagaagatccttctcaacatcgagcatcgcatcatgttgcggatg  6000
 D   Y   R   E   K   K   K   I   L   L   N   I   E   H   R   I   M   L   R   M   2000 gctccggactatgaccacttgactctgatgcagaaggtggaggtgtttgagcatgccgtc  6060
 A   P   D   Y   D   H   L   T   L   M   Q   K   V   E   V   F   E   H   A   V   2020 aataatacagctggggacgacctggccaagctgctgtggctgaaaagccccagctccgag  6120
 N   N   T   A   G   D   D   L   A   K   L   L   W   L   K   S   P   S   S   E   2040 gtgtggtttgaccgaagaaccaattatacccgttctttagcggtcatgtcaatggttggg  6180
 V   W   F   D   R   R   T   N   Y   T   R   S   L   A   V   M   S   M   V   G   2060 tatattttaggcctgggagatagacacccatccaacctgatgctggaccgtctgagtggg  6240
 Y   I   L   G   L   G   D   R   H   P   S   N   L   M   L   D   R   L   S   G   2080 aagatcctgcacattgactttggggactgctttgaggttgctatgacccgagagaagttt  6300
 K   I   L   H   I   D   F   G   D   C   F   E   V   A   M   T   R   E   K   F   2100 ccagagaagattccatttagactaacaagaatgttgaccaatgctatggaggttacaggc  6360
 P   E   K   I   P   F   R   L   T   R   M   L   T   N   A   M   E   V   T   G   2120 ctggatggcaactacagaatcacatgccacacagtgatggaggtgctgcgagagcacaag  6420
 L   D   G   N   Y   R   I   T   C   H   T   V   M   E   V   L   R   E   H   K   2140 gacagtgtcatggccgtgctggaagcctttgtctatgaccccttgctgaactggaggctg  6480
 D   S   V   M   A   V   L   E   A   F   V   Y   D   P   L   L   N   W   R   L   2160
```

FIG. 103G

```
atggacacaaataccaaaggcaacaagcgatcccgaacgaggacggattcctactctgct 6540
 M  D  T  N  T  K  G  N  K  R  S  R  T  R  T  D  S  Y  S  A   2180 ggccagtcagtcgaaattttggacggtgtggaacttggagagccagcccataagaaaacg 6600
 G  Q  S  V  E  I  L  D  G  V  E  L  G  E  P  A  H  K  K  T   2200 gggaccacagtgccagaatctattcattctttcattggagacggtttggtgaaaccagag 6660
 G  T  T  V  P  E  S  I  H  S  F  I  G  D  G  L  V  K  P  E   2220 gccctaaataagaaagctatccagattattaacagggttcgagataagctcactggtcgg 6720
 A  L  N  K  K  A  I  Q  I  I  N  R  V  R  D  K  L  T  G  R   2240 gacttctctcatgatgacactttggatgttccaacgcaagttgagctgctcatcaaacaa 6780
 D  F  S  H  D  D  T  L  D  V  P  T  Q  V  E  L  L  I  K  Q   2260 gcgacatcccatgaaaacctctgccagtgctatattggctggtgccctttctggtaa
 A  T  S  H  E  N  L  C  Q  C  Y  I  G  W  C  P  F  W  -
```

(SEQ ID NO: 113)
(SEQ ID NO: 114)

FIG. 104

```
AGACCAGGCC AGGCCAGCTG GACGGGCACA CC*ATG*AGGCT GCTGACCCTC  50
CTGGGCCTTC TGTGTGGCTC GGTGGCCACC CCCTTGGGCC CGAAGTGGCC  100
TGAACCTGTG TTCGGGCGCC TGGCATCCCC CGGCTTTCCA GGGGAGTATG  150
CCAATGACCA GGAGCGGCGC TGGACCCTGA CTGCACCCCC CGGCTACCGC  200
CTGCGCCTCT ACTTCACCCA CTTCGACCTG GAGCTCTCCC ACCTCTGCGA  250
GTACGACTTC GTCAAGCTGA GCTCGGGGGC CAAGGTGCTG GCCACGCTGT  300
GCGGGCAGGA GAGCACAGAC ACGGAGCGGG CCCCTGGCAA GGACACTTTC  350
TACTCGCTGG GCTCCAGCCT GGACATTACC TTCCGCTCCG ACTACTCCAA  400
CGAGAAGCCG TTCACGGGGT TCGAGGCCTT CTATGCAGCC GAGGACATTG  450
ACGAGTGCCA GGTGGCCCCG GGAGAGGCGC CCACCTGCGA CCACCACTGC  500
CACAACCACC TGGGCGGTTT CTACTGCTCC TGCCGCGCAG GCTACGTCCT  550
GCACCGTAAC AAGCGCACCT GCTCAGCCCT GTGCTCCGGC CAGGTCTTCA  600
CCCAGAGGTC TGGGGAGCTC AGCAGCCCTG AATACCCACG GCCGTATCCC  650
AAACTCTCCA GTTGCACTTA CAGCATCAGC TGGAGGAGG GGTTCAGTGT  700
CATTCTGGAC TTTGTGGAGT CCTTCGATGT GGAGACACAC CCTGAAACCC  750
TGTGTCCCTA CGACTTTCTC AAGATTCAAA CAGACAGAGA AGAACATGGC  800
CCATTCTGTG GGAAGACATT GCCCCACAGG ATTGAAACAA AAAGCAACAC  850
GGTGACCATC ACCTTTGTCA CAGATGAATC AGGAGACCAC ACAGGCTGGA  900
AGATCCACTA CACGAGCACA GCGCAGCCTT GCCCTTATCC GATGGCGCCA  950
CCTAATGGCC ACGTTTCACC TGTGCAAGCC AAATACATCC TGAAAGACAG  1000
CTTCTCCATC TTTTGCGAGA CTGGCTATGA GCTTCTGCAA GGTCACTTGC  1050
CCCTGAAATC CTTTACTGCA GTTGTCAGA AAGATGGATC TTGGGACCGG  1100
CCAATGCCCG CGTGCAGCAT TGTTGACTGT GGCCCTCCTG ATGATCTACC  1150
CAGTGGCCGA GTGGAGTACA TCACAGGTCC TGGAGTGACC ACCTACAAAG  1200
CTGTGATTCA GTACAGCTGT GAAGAGACCT TCTACACAAT GAAAGTGAAT  1250
GATGGTAAAT ATGTGTGTGA GGCTGATGGA TTCTGGACGA GCTCCAAAGG  1300
AGAAAAATCA CTCCCAGTCT GTGAGCCTGT TTGTGGACTA TCAGCCCGCA  1350
CAACAGGAGG GCGTATATAT GGAGGGCAAA AGGCAAAACC TGGTGATTTT  1400
CCTTGGCAAG TCCTGATATT AGGTGGAACC ACAGCAGCAG GTGCACTTTT  1450
ATATGACAAC TGGGTCCTAA CAGCTGCTCA TGCCGTCTAT GAGCAAAAAC  1500
ATGATGCATC CGCCCTGGAC ATTCGAATGG GCACCCTGAA AAGACTATCA  1550
CCTCATTATA CACAAGCCTG GTCTGAAGCT GTTTTATAC ATGAAGGTTA  1600
TACTCATGAT GCTGGCTTTG ACAATGACAT AGCACTGATT AAATTGAATA  1650
ACAAAGTTGT AATCAATAGC AACATCACGC CTATTTGTCT GCCAAGAAAA  1700
GAAGCTGAAT CCTTTATGAG GACAGATGAC ATTGGAACTG CATCTGGATG  1750
GGGATTAACC CAAAGGGGTT TTCTTGCTAG AAATCTAATG TATGTCGACA  1800
TACCGATTGT TGACCATCAA AAATGTACTG CTGCATATGA AAAGCCACCC  1850
TATCCAAGGG GAAGTGTAAC TGCTAACATG CTTTGTGCTG GCTTAGAAAG  1900
TGGGGGCAAG GACAGCTGCA GAGGTGACAG CGGAGGGGCA CTGGTGTTTC  1950
TAGATAGTGA AACAGAGAGG TGGTTTGTGG GAGGAATAGT GTCCTGGGGT  2000
TCCATGAATT GTGGGGAAGC AGGTCAGTAT GGAGTCTACA CAAAAGTTAT  2050
TAACTATATT CCCTGGATCG AGAACATAAT TAGTGATTTT *TAA*CTTGCGT  2100
GTCTGCAGTC AAGGATTCTT CATTTTAGA AATGCCTGTG AAGACCTTGG  2150
CAGCGACGTG GCTCGAGAAG CATTCATCAT TACTGTGGAC ATGGCAGTTG  2200
TTGCTCCACC CAAAAAAACA GACTCCAGGT GAGGCTGCTG TCATTTCTCC  2250
ACTTGCCAGT TTAATTCCAG CCTTACCCAT TGACTCAAGG GGACATAAAC  2300
CACGAGAGTG ACAGTCATCT TTGCCCACCC AGTGTAATGT CACTGCTCAA  2350
ATTACATTTC ATTACCTTAA AAAGCCAGTC TCTTTTCATA CTGGCTGTTG  2400
GCATTTCTGT AAACTGCCTG TCCATGCTCT TTGTTTTTAA ACTTGTTCTT  2450
ATTGAaaaaa aaaaaaaaaa a (SEQ ID NO: 115)
```

FIG. 105

```
MRLLTLLGLLCGSVATPLGPKWPEPVFGRLASPGFPGEYANDQERRWTLTAPPGYRLRLY
FTHFDLELSHLCEYDFVKLSSGAKVLATLCGQESTDTERAPGKDTFYSLGSSLDITFRSD
YSNEKPFTGFEAFYAAEDIDECQVAPGEAPTCDHHCNHLGGFYCSCRAGYVLHRNKRTC
SALCSGQVFTQRSGELSSPEYPRPYPKLSSCTYSISLEEGFSVILDFVESFDVETHPETL
CPYDFLKIQTDREEHGPFCGKTLPHRIETKSNTVTITFVTDESGDHTGWKIHYTSTAQPC
PYPMAPPNGHVSPVQAKYILKDSFSIFCETGYELLQGHLPLKSFTAVCQKDGSWDRPMPA
CSIVDCGPPDDLPSGRVEYITGPGVTTYKAVIQYSCEETFYTMKVNDGKYVCEADGFWTS
SKGEKSLPVCEPVCGLSARTTGGRIYGGQKAKPGDFPWQVLILGGTTAAGALLYDNWVLT
AAHAVYEQKHDASALDIRMGTLKRLSPHYTQAWSEAVFIHEGYTHDAGFDNDIALIKLNN
KVVINSNITPICLPRKEAESFMRTDDIGTASGWGLTQRGFLARNLMYVDIPIVDHQKCTA
AYEKPPYPRGSVTANMLCAGLESGGKDSCRGDSGGALVFLDSETERWFVGGIVSWGSMNC
GEAGQYGVYTKVINYIPWIENIISDF- (SEQ ID NO: 116)
```

FIG. 106A

```
GCTCCCGGCT TAGAGGACAG CGGGGAAGGC GGGCGGTGGG GCAGGGGGCC   50
TGAAGCGGCG GTACCGGTGC TGGCGGCGGC AGCTGAGGCC TTGGCCGAAG  100
CCGCGCGAAC CTCAGGGCAA G*ATG*CTTGGA ACCGGACCTG CCGCCGCCAC  150
CACCGCTGCC ACCACATCTA GCAATGTGAG CGTCCTGCAG CAGTTTGCCA  200
GTGGCCTAAA GAGCCGGAAT GAGGAAACCA GGGCCAAAGC CGCCAAGGAG  250
CTCCAGCACT ATGTCACCAT GGAACTCCGA GAGATGAGTC AAGAGGAGTC  300
TACTCGCTTC TATGACCAAC TGAACCATCA CATTTTGAA TTGGTTTCCA   350
GCTCAGATGC CAATGAGAGG AAAGGTGGCA TCTTGGCCAT AGCTAGCCTC  400
ATAGGAGTGG AAGGTGGGAA TGCCACCCGA ATTGGCAGAT TGCCAACTA   450
TCTTCGGAAC CTCCTCCCCT CCAATGACCC AGTTGTCATG GAAATGGCAT  500
CCAAGGCCAT TGGCCGTCTT GCCATGGCAG GGACACTTT TACCGCTGAG   550
TACGTGGAAT TTGAGGTGAA GCGAGCCCTG GAATGGCTGG GTGCTGACCG  600
CAATGAGGGC CGGAGACATG CAGCTGTCCT GGTTCTCCGT GAGCTGGCCA  650
TCAGCGTCCC TACCTTCTTC TTCCAGCAAG TGCAACCCTT CTTTGACAAC  700
ATTTTTGTGG CCGTGTGGGA CCCCAAACAG GCCATCCGTG AGGGAGCTGT  750
AGCCGCCCTT CGTGCCTGTC TGATTCTCAC AACCCAGCGT GAGCCGAAGG  800
AGATGCAGAA GCCTCAGTGG TACAGGCACA CATTTGAAGA AGCAGAGAAG  850
GGATTTGATG AGACCTTGGC CAAAGAGAAG GGCATGAATC GGGATGATCG  900
GATCCATGGA GCCTTGTTGA TCCTTAACGA GCTGGTCCGA ATCAGCAGCA  950
TGGAGGGAGA GCGTCTGAGA GAAGAAATGG AAGAAATCAC ACAGCAGCAG 1000
CTGGTACACG ACAAGTACTG CAAAGATCTC ATGGGCTTCG GAACAAAACC 1050
TCGTCACATT ACCCCCTTCA CCAGTTTCCA GGCTGTACAG CCCCAGCAGT 1100
CAAATGCCTT GGTGGGGCTG CTGGGGTACA GCTCTCACCA AGGCCTCATG 1150
GGATTTGGGA CCTCCCCCAG TCCAGCTAAG TCCACCCTGG TGGAGAGCCG 1200
GTGTTGCAGA GACTTGATGG AGGAGAAATT TGATCAGGTG TGCCAGTGGG 1250
TGCTGAAATG CAGGAATAGC AAGAACTCGC TGATCCAAAT GACAATCCTT 1300
AATTTGTTGC CCGCTTGGC TGCATTCCGA CCTTCTGCCT TCACAGATAC  1350
CCAGTATCTC CAAGATACCA TGAACCATGT CCTAAGCTGT GTCAAGAAGG 1400
AGAAGGAACG TACAGCGGCC TTCCAAGCCC TGGGGCTACT TTCTGTGGCT 1450
GTGAGGTCTG AGTTTAAGGT CTATTTGCCT CGCGTGCTGG ACATCATCCG 1500
AGCGGCCCTG CCCCCAAAGG ACTTCGCCCA TAAGAGGCAG AAGGCAATGC 1550
AGGTGGATGC CACAGTCTTC ACTTGCATCA GCATGCTGGC TCGAGCAATG 1600
GGGCCAGGCA TCCAGCAGGA TATCAAGGAG CTGCTGGAGC CCATGCTGGC 1650
AGTGGGACTA AGCCCTGCCC TCACTGCAGT GCTCTACGAC CTGAGCCGTC 1700
AGATTCCACA GCTAAAGAAG GACATTCAAG ATGGGCTACT GAAAATGCTG 1750
TCCCTGGTCC TTATGCACAA ACCCCTTCGC CACCCAGGCA TGCCCAAGGG 1800
CCTGGCCCAT CAGCTGGCCT CTCCTGGCCT CACGACCCTC CCTGAGGCCA 1850
GCGATGTGGG CAGCATCACT CTTGCCCTCC GAACGCTTGG CAGCTTTGAA 1900
TTTGAAGGCC ACTCTCTGAC CCAATTTGTT CGCCACTGTG CGGATCATTT 1950
CCTGAACAGT GAGCACAAGG AGATCCGCAT GGAGGCTGCC CGCACCTGCT 2000
CCCGCCTGCT CACACCCTCC ATCCACCTCA TCAGTGGCCA TGCTCATGTG 2050
GTTAGCCAGA CCGCAGTGCA AGTGGTGGCA GATGTGCTTA GCAAACTGCT 2100
CGTAGTTGGG ATAACAGATC CTGACCCTGA CATTCGCTAC TGTGTCTTGG 2150
CGTCCCTGGA CGAGCGCTTT GATGCACACC TGGCCCAGGC GGAGAACTTG 2200
CAGGCCTTGT TTGTGGCTCT GAATGACCAG GTGTTTGAGA TCCGGGAGCT 2250
GGCCATCTGC ACTGTGGGCC GACTCAGTAG CATGAACCCT GCCTTTGTCA 2300
TGCCTTTCCT GCGCAAGATG CTCATCCAGA TTTTGACAGA GTTGGAGCAC 2350
AGTGGGATTG GAAGAATCAA AGAGCAGAGT GCCCGCATGC TGGGGCACCT 2400
GGTCTCCAAT GCCCCCCGAC TCATCCGCCC CTACATGGAG CCTATTCTGA 2450
AGGCATTAAT TTTGAAACTG AAAGATCCAG ACCCTGATCC AAACCCAGGT 2500
GTGATCAATA ATGTCCTGGC AACAATAGGA GAATTGGCAC AGGTTAGTGG 2550
CCTGGAAATG AGGAAATGGG TTGATGAACT TTTTATTATC ATCATGGACA 2600
TGCTCCAGGA TTCCTCTTTG TTGGCCAAAA GGCAGGTGGC TCTGTGGACC 2650
CTGGGACAGT TGGTGGCCAG CACTGGCTAT GTAGTAGAGC CCTACAGGAA 2700
```

FIG. 106B

```
GTACCCTACT TTGCTTGAGG TGCTACTGAA TTTTCTGAAG ACTGAGCAGA  2750
ACCAGGGTAC ACGCAGAGAG GCCATCCGTG TGTTAGGGCT TTTAGGGGCT  2800
TTGGATCCTT ACAAGCACAA AGTGAACATT GGCATGATAG ACCAGTCCCG  2850
GGATGCCTCT GCTGTCAGCC TGTCAGAATC CAAGTCAAGT CAGGATTCCT  2900
CTGACTATAG CACTAGTGAA ATGCTGGTCA ACATGGGAAA CTTGCCTCTG  2950
GATGAGTTCT ACCCAGCTGT GTCCATGGTG GCCCTGATGC GGATCTTCCG  3000
AGACCAGTCA CTCTCTCATC ATCACACCAT GGTTGTCCAG GCCATCACCT  3050
TCATCTTCAA GTCCCTGGGA CTCAAATGTG TGCAGTTCCT GCCCCAGGTC  3100
ATGCCCACGT TCCTTAACGT CATTCGAGTC TGTGATGGGG CCATCCGGGA  3150
ATTTTTGTTC CAGCAGCTGG GAATGTTGGT GTCCTTTGTG AAGAGCCACA  3200
TCAGACCTTA TATGGATGAA ATAGTCACCC TCATGAGAGA ATTCTGGGTC  3250
ATGAACACCT CAATTCAGAG CACGATCATT CTTCTCATTG AGCAAATTGT  3300
GGTAGCTCTT GGGGGTGAAT TTAAGCTCTA CCTGCCCCAG CTGATCCCAC  3350
ACATGCTGCG TGTCTTCATG CATGACAACA GCCCAGGCCG CATTGTCTCT  3400
ATCAAGTTAC TGGCTGCAAT CCAGCTGTTT GGCGCCAACC TGGATGACTA  3450
CCTGCATTTA CTGCTGCCTC CTATTGTTAA GTTGTTTGAT GCCCCTGAAG  3500
CTCCACTGCC ATCTCGAAAG GCAGCGCTAG AGACTGTGGA CCGCCTGACG  3550
GAGTCCCTGG ATTTCACTGA CTATGCCTCC CGGATCATTC ACCCTATTGT  3600
TCGAACACTG GACCAGAGCC CAGAACTGCG CTCCACAGCC ATGGACACGC  3650
TGTCTTCACT TGTTTTTCAG CTGGGGAAGA AGTACCAAAT TTTCATTCCA  3700
ATGGTGAATA AAGTTCTGGT GCGACACCGA ATCAATCATC AGCGCTATGA  3750
TGTGCTCATC TGCAGAATTG TCAAGGGATA CACACTTGCT GATGAAGAGG  3800
AGGATCCTTT GATTACCAG CATCGGATGC TTAGGAGTGG CCAAGGGGAT  3850
GCATTGGCTA GTGGACCAGT GGAAACAGGA CCCATGAAGA AACTGCACGT  3900
CAGCACCATC AACCTCCAAA AGGCCTGGGG CGCTGCCAGG AGGGTCTCCA  3950
AAGATGACTG GCTGGAATGG CTGAGACGGC TGAGCCTGGA GCTGCTGAAG  4000
GACTCATCAT CGCCCTCCCT GCGCTCCTGC TGGGCCCTGG CACAGGCCTA  4050
CAACCCGATG GCCAGGGATC TCTTCAATGC TGCATTTGTG TCCTGCTGGT  4100
CTGAACTGAA TGAAGATCAA CAGGATGAGC TCATCAGAAG CATCGAGTTG  4150
GCCCTCACCT CACAAGACAT CGCTGAAGTC ACACAGACCC TCTTAAACTT  4200
GGCTGAATTC ATGGAACACA GTGACAAGGG CCCCCTGCCA CTGAGAGATG  4250
ACAATGGCAT TGTTCTGCTG GGTGAGAGAG CTGCCAAGTG CCGAGCATAT  4300
GCCAAAGCAC TACACTACAA AGAACTGGAG TTCCAGAAAG GCCCCACCCC  4350
TGCCATTCTA GAATCTCTCA TCAGCATTAA TAATAAGCTA CAGCAGCCGG  4400
AGGCAGCGGC CGGAGTGTTA GAATATGCCA TGAAACACTT TGGAGAGCTG  4450
GAGATCCAGG CTACCTGGTA TGAGAAACTG CACGAGTGGG AGGATGCCCT  4500
TGTGGCCTAT GACAAGAAAA TGGACACCAA CAAGGACGAC CCAGAGCTGA  4550
TGCTGGGCCG CATGCGCTGC CTCGAGGCCT TGGGGGAATG GGGTCAACTC  4600
CACCAGCAGT GCTGTGAAAA GTGGACCCTG GTTAATGATG AGACCCAAGC  4650
CAAGATGGCC CGGATGGCTG CTGCAGCTGC ATGGGGTTTA GGTCAGTGGG  4700
ACAGCATGGA AGAATACACC TGTATGATCC CTCGGGACAC CCATGATGGG  4750
GCATTTTATA GAGCTGTGCT GGCACTGCAT CAGGACCTCT TCTCCTTGGC  4800
ACAACAGTGC ATTGACAAGG CCAGGGACCT GCTGGATGCT GAATTAACTG  4850
CGATGGCAGG AGAGAGTTAC AGTCGGGCAT ATGGGGCCAT GGTTTCTTGC  4900
CACATGCTGT CCGAGCTGGA GGAGGTTATC CAGTACAAAC TTGTCCCCGA  4950
GCGACGAGAG ATCATCCGCC AGATCTGGTG GGAGAGACTG CAGGGCTGCC  5000
AGCGTATCGT AGAGGACTGG CAGAAAATCC TTATGGTGCG GTCCCTTGTG  5050
GTCAGCCCTC ATGAAGACAT GAGAACCTGG CTCAAGTATG CAAGCCTGTG  5100
CGGCAAGAGT GGCAGGCTGG CTCTTGCTCA TAAAACTTTA GTGTTGCTCC  5150
TGGGAGTTGA TCCGTCTCGG CAACTTGACC ATCCTCTGCC AACAGTTCAC  5200
CCTCAGGTGA CCTATGCCTA CATGAAAAAC ATGTGGAAGA GTGCCCGCAA  5250
GATCGATGCC TTCCAGCACA TGCAGCATTT TGTCCAGACC ATGCAGCAAC  5300
AGGCCCAGCA TGCCATCGCT ACTGAGGACC AGCAGCATAA GCAGGAACTG  5350
CACAAGCTCA TGGCCCGATG CTTCCTGAAA CTTGGAGAGT GGCAGCTGAA  5400
```

FIG. 106C

```
TCTACAGGGC ATCAATGAGA GCACAATCCC CAAAGTGCTG CAGTACTACA 5450
GCGCCGCCAC AGAGCACGAC CGCAGCTGGT ACAAGGCCTG GCATGCGTGG 5500
GCAGTGATGA ACTTCGAAGC TGTGCTACAC TACAAACATC AGAACCAAGC 5550
CCGCGATGAG AAGAAGAAAC TGCGTCATGC CAGCGGGGCC AACATCACCA 5600
ACGCCACCAC TGCCGCCACC ACGGCCGCCA CTGCCACCAC CACTGCCAGC 5650
ACCGAGGGCA GCAACAGTGA GAGCGAGGCC GAGAGCACCG AGAACAGCCC 5700
CACCCCATCG CCGCTGCAGA AGAAGGTCAC TGAGGATCTG TCCAAAACCC 5750
TCCTGATGTA CACGGTGCCT GCCGTCCAGG GCTTCTTCCG TTCCATCTCC 5800
TTGTCACGAG GCAACAACCT CCAGGATACA CTCAGAGTTC TCACCTTATG 5850
GTTTGATTAT GGTCACTGGC CAGATGTCAA TGAGGCCTTA GTGGAGGGGG 5900
TGAAAGCCAT CCAGATTGAT ACCTGGCTAC AGGTTATACC TCAGCTCATT 5950
GCAAGAATTG ATACGCCCAG ACCCTTGGTG GGACGTCTCA TTCACCAGCT 6000
TCTCACAGAC ATTGGTCGGT ACCACCCCCA GGCCCTCATC TACCCACTGA 6050
CAGTGGCTTC TAAGTCTACC ACGACAGCCC GGCACAATGC AGCCAACAAG 6100
ATTCTGAAGA ACATGTGTGA GCACAGCAAC ACCCTGGTCC AGCAGGCCAT 6150
GATGGTGAGC GAGGAGCTGA TCCGAGTGGC CATCCTCTGG CATGAGATGT 6200
GGCATGAAGG CCTGGAAGAG GCATCTCGTT TGTACTTTGG GGAAAGGAAC 6250
GTGAAAGGCA TGTTTGAGGT GCTGGAGCCC TTGCATGCTA TGATGGAACG 6300
GGGCCCCCAG ACTCTGAAGG AAACATCCTT TAATCAGGCC TATGGTCGAG 6350
ATTTAATGGA GGCCCAAGAG TGGTGCAGGA AGTACATGAA ATCAGGGAAT 6400
GTCAAGGACC TCACCCAAGC CTGGGACCTC TATTATCATG TGTTCCGACG 6450
AATCTCAAAG CAGCTGCCTC AGCTCACATC CTTAGAGCTG CAATATGTTT 6500
CCCCAAAACT TCTGATGTGC CGGGACCTTG AATTGGCTGT GCCAGGAACA 6550
TATGACCCCA ACCAGCCAAT CATTCGCATT CAGTCCATAG CACCGTCTTT 6600
GCAAGTCATC ACATCCAAGC AGAGGCCCCG GAAATTGACA CTTATGGGCA 6650
GCAACGGACA TGAGTTTGTT TTCCTTCTAA AAGGCCATGA AGATCTGCGC 6700
CAGGATGAGC GTGTGATGCA GCTCTTCGGC CTGGTTAACA CCCTTCTGGC 6750
CAATGACCCA ACATCTCTTC GGAAAAACCT CAGCATCCAG AGATACGCTG 6800
TCATCCCTTT ATCGACCAAC TCGGGCCTCA TTGGCTGGGT TCCCCACTGT 6850
GACACACTGC ACGCCCTCAT CCGGGACTAC AGGGAGAAGA AGAAGATCCT 6900
TCTCAACATC GAGCATCGCA TCATGTTGCG GATGGCTCCG GACTATGACC 6950
ACTTGACTCT GATGCAGAAG GTGGAGGTGT TGAGCATGC CGTCAATAAT 7000
ACAGCTGGGG ACGACCTGGC CAAGCTGCTG TGGCTGAAAA GCCCCAGCTC 7050
CGAGGTGTGG TTTGACCGAA GAACCAATTA TACCCGTTCT TTAGCGGTCA 7100
TGTCAATGGT TGGGTATATT TTAGGCCTGG GAGATAGACA CCCATCCAAC 7150
CTGATGCTGG ACCGTCTGAG TGGGAAGATC CTGCACATTG ACTTTGGGGA 7200
CTGCTTTGAG GTTGCTATGA CCCGAGAGAA GTTCCAGAG AAGATTCCAT 7250
TTAGACTAAC AAGAATGTTG ACCAATGCTA TGGAGGTTAC AGGCCTGGAT 7300
GGCAACTACA GAATCACATG CCACACAGTG ATGGAGGTGC TGCGAGAGCA 7350
CAAGGACAGT GTCATGGCCG TGCTGGAAGC CTTTGTCTAT GACCCCTTGC 7400
TGAACTGGAG GCTGATGGAC ACAAATACCA AAGGCAACAA GCGATCCCGA 7450
ACGAGGACGG ATTCCTACTC TGCTGGCCAG TCAGTCGAAA TTTTGGACGG 7500
TGTGGAACTT GGAGAGCCAG CCCATAAGAA AACGGGGACC ACAGTGCCAG 7550
AATCTATTCA TTCTTTCATT GGAGACGGTT TGGTGAAACC AGAGGCCCTA 7600
AATAAGAAAG CTATCCAGAT TATTAACAGG GTTCGAGATA AGCTCACTGG 7650
TCGGGACTTC TCTCATGATG ACACTTTGGA TGTTCCAACG CAAGTTGAGC 7700
TGCTCATCAA ACAAGCGACA TCCATGAAAA ACCTCTGCCA GTGCTATATT 7750
GGCTGGTGCC CTTTCTGGTA ACTGGAGGCC CAGATGTGCC CATCACGTTT 7800
TTTCTGAGGC TTTTGTACTT TAGTAAATGC TTCCACTAAA CTGAAACCAT 7850
GGTGAGAAAG TTTGACTTTG TTAAATATTT TGAAATGTAA ATGAAAAGAA 7900
CTACTGTATA TTAAAAGTTG GTTTGAACCA ACTTTCTAGC TGCTGTTGAA 7950
GAATATATTG TCAGAAACAC AAGGCTTGAT TTGGTTCCCA GGACAGTGAA 8000
ACATAGTAAT ACCACGTAAA TCAAGCCATT CATTTTGGGG AACAGAAGAT 8050
CCATAACTTT AGAAATACGG GTTTTGACTT AACTCACAAG AGAACTCATC 8100
```

FIG. 106D

```
ATAAGTACTT GCTGATGGAA GAATGACCTA GTTGCTCCTC TCAACATGGG   8150
TACAGCAAAC TCAGCACAGC CAAGAAGCCT CAGGTCGTGG AGAACATGGA   8200
TTAGGATCCT AGACTGTAAA GACACAGAAG ATGCTGACCT CACCCCTGCC   8250
ACCTATCCCA AGACCTCACT GGTCTGTGGA CAGCAGCAGA AATGTTTGCA   8300
AGATAGGCCA AAATGAGTAC AAAAGGTCTG TCTTCCATCA GACCCAGTGA   8350
TGCTGCGACT CACACGCTTC AATTCAAGAC CTGACCGCTA GTAGGGAGGT   8400
TTATTCAGAT CGCTGGCAGC CTCGGCTGAG CAGATGCACA GAGGGGATCA   8450
CTGTGCAGTG GGACCACCCT CACTGGCCTT CTGCAGCAGG GTTCTGGGAT   8500
GTTTCAGTG GTCAAAATAC TCTGTTTAGA GCAAGGGCTC AGAAAACAGA   8550
AATACTGTCA TGGAGGTGCT GAACACAGGG AAGGTCTGGT ACATATTGGA   8600
AATTATGAGC AGAACAAATA CTCAACTAAA TGCACAAAGT ATAAAGTGTA   8650
GCCATGTCTA GACACCATGT TGTATCAGAA TAATTTTTGT GCCAATAAAT   8700
GACATCAGAA TTTTAAACAT ATGTAaaaaa aaa (SEQ ID NO: 117)
```

FIG. 107

MLGTGPAAATTAATTSSNVSVLQQFASGLKSRNEETRAKAAKELQHYVTMELREMSQEES
TRFYDQLNHHIFELVSSSDANERKGGILAIASLIGVEGGNATRIGRFANYLRNLLPSNDP
VVMEMASKAIGRLAMAGDTFTAEYVEFEVKRALEWLGADRNEGRRHAAVLVLRELAISVP
TFFFQQVQPFFDNIFVAVWDPKQAIREGAVAALRACLILTTQREPKEMQKPQWYRHTFEE
AEKGFDETLAKEKGMNRDDRIHGALLILNELVRISSMEGERLREEMEEITQQQLVHDKYC
KDLMGFGTKPRHITPFTSFQAVQPQQSNALVGLLGYSSHQGLMGFGTSPSPAKSTLVESR
CCRDLMEEKFDQVCQWVLKCRNSKNSLIQMTILNLLPRLAAFRPSAFTDTQYLQDTMNHV
LSCVKKEKERTAAFQALGLLSVAVRSEFKVYLPRVLDIIRAALPPKDFAHKRQKAMQVDA
TVFTCISMLARAMGPGIQQDIKELLEPMLAVGLSPALTAVLYDLSRQIPQLKKDIQDGLL
KMLSLVLMHKPLRHPGMPKGLAHQLASPGLTTLPEASDVGSITLALRTLGSFEFEGHSLT
QFVRHCADHFLNSEHKEIRMEAARTCSRLLTPSIHLISGHAHVVSQTAVQVVADVLSKLL
VVGITDPDPDIRYCVLASLDERFDAHLAQAENLQALFVALNDQVFEIRELAICTVGRLSS
MNPAFVMPFLRKMLIQILTELEHSGIGRIKEQSARMLGHLVSNAPRLIRPYMEPILKALI
LKLKDPDPDPNPGVINNVLATIGELAQVSGLEMRKWVDELFIIIMDMLQDSSLLAKRQVA
LWTLGQLVASTGYVVEPYRKYPTLLEVLLNFLKTEQNQGTRREAIRVLGLLGALDPYKHK
VNIGMIDQSRDASAVSLSESKSSQDSSDYSTSEMLVNMGNLPLDEFYPAVSMVALMRIFR
DQSLSHHHTMVVQAITFIFKSLGLKCVQFLPQVMPTFLNVIRVCDGAIREFLFQQLGMLV
SFVKSHIRPYMDEIVTLMREFWVMNTSIQSTIILLIEQIVVALGGEFKLYLPQLIPHMLR
VFMHDNSPGRIVSIKLLAAIQLFGANLDDYLHLLLPPIVKLFDAPEAPLPSRKAALETVD
RLTESLDFTDYASRIIHPIVRTLDQSPELRSTAMDTLSSLVFQLGKKYQIFIPMVNKVLV
RHRINHQRYDVLICRIVKGYTLADEEEDPLIYQHRMLRSGQGDALASGPVETGPMKKLHV
STINLQKAWGAARRVSKDDWLEWLRRLSLELLKDSSSPSLRSCWALAQAYNPMARDLFNA
AFVSCWSELNEDQQDELIRSIELALTSQDIAEVTQTLLNLAEFMEHSDKGPLPLRDDNGI
VLLGERAAKCRAYAKALHYKELEFQKGPTPAILESLISINNKLQQPEAAAGVLEYAMKHF
GELEIQATWYEKLHEWEDALVAYDKKMDTNKDDPELMLGRMRCLEALGEWGQLHQQCCEK
WTLVNDETQAKMARMAAAAAWGLGQWDSMEEYTCMIPRDTHDGAFYRAVLALHQDLFSLA
QQCIDKARDLLDAELTAMAGESYSRAYGAMVSCHMLSELEEVIQYKLVPERREIIRQIWW
ERLQGCQRIVEDWQKILMVRSLVVSPHEDMRTWLKYASLCGKSGRLALAHKTLVLLLGVD
PSRQLDHPLPTVHPQVTYAYMKNMWKSARKIDAFQHMQHFVQTMQQQAQHAIATEDQQHK
QELHKLMARCFLKLGEWQLNLQGINESTIPKVLQYYSAATEHDRSWYKAWHAWAVMNFEA
VLHYKHQNQARDEKKKLRHASGANITNATTAATTAATATTTASTEGSNSESEAESTENSP
TPSPLQKKVTEDLSKTLLMYTVPAVQGFFRSISLSRGNNLQDTLRVLTLWFDYGHWPDVN
EALVEGVKAIQIDTWLQVIPQLIARIDTPRPLVGRLIHQLLTDIGRYHPQALIYPLTVAS
KSTTTARHNAANKILKNMCEHSNTLVQQAMMVSEELIRVAILWHEMWHEGLEEASRLYFG
ERNVKGMFEVLEPLHAMMERGPQTLKETSFNQAYGRDLMEAQEWCRKYMKSGNVKDLTQA
WDLYYHVFRRISKQLPQLTSLELQYVSPKLLMCRDLELAVPGTYDPNQPIIRIQSIAPSL
QVITSKQRPRKLTLMGSNGHEFVFLLKGHEDLRQDERVMQLFGLVNTLLANDPTSLRKNL
SIQRYAVIPLSTNSGLIGWVPHCDTLHALIRDYREKKKILLNIEHRIMLRMAPDYDHLTL
MQKVEVFEHAVNNTAGDDLAKLLWLKSPSSEVWFDRRTNYTRSLAVMSMVGYILGLGDRH
PSNLMLDRLSGKILHIDFGDCFEVAMTREKFPEKIPFRLTRMLTNAMEVTGLDGNYRITC
HTVMEVLREHKDSVMAVLEAFVYDPLLNWRLMDTNTKGNKRSRTRTDSYSAGQSVEILDG
VELGEPAHKKTGTTVPESIHSFIGDGLVKPEALNKKAIQIINRVRDKLTGRDFSHDDTLD
VPTQVELLIKQATSHENLCQCYIGWCPFW- (SEQ ID NO: 118)

FIG. 108A

```
atggtcagctggggtcgtttcatctgcctggtcgtggtcaccatggcaaccttgtccctg    60
 M   V   S   W   G   R   F   I   C   L   V   V   V   T   M   A   T   L   S   L      20 gcccggccctccttcagtttagttgaggataccacattagagccagaagatgccatctca   120
 A   R   P   S   F   S   L   V   E   D   T   T   L   E   P   E   D   A   I   S      40 tccggagatgatgaggatgacaccgatggtgcggaagattttgtcagtgagaacagtaac   180
 S   G   D   D   E   D   D   T   D   G   A   E   D   F   V   S   E   N   S   N      60 aacaagagagcaccatactggaccaacacagaaaagatggaaaagcggctccatgctgtg   240
 N   K   R   A   P   Y   W   T   N   T   E   K   M   E   K   R   L   H   A   V      80 cctgcggccaacactgtcaagtttcgctgcccagccggggggaacccaatgccaaccatg   300
 P   A   A   N   T   V   K   F   R   C   P   A   G   G   N   P   M   P   T   M     100 cggtggctgaaaaacgggaaggagtttaagcaggagcatcgcattggaggctacaaggta   360
 R   W   L   K   N   G   K   E   F   K   Q   E   H   R   I   G   G   Y   K   V     120 cgaaaccagcactggagcctcattatggaaagtgtggtcccatctgacaagggaaattat   420
 R   N   Q   H   W   S   L   I   M   E   S   V   V   P   S   D   K   G   N   Y     140 acctgtgtagtggagaatgaatacgggtccatcaatcacacgtaccacctggatgttgtg   480
 T   C   V   V   E   N   E   Y   G   S   I   N   H   T   Y   H   L   D   V   V     160 gagcgatcgcctcaccggcccatcctccaagccggactgccggcaaatgcctccacagtg   540
 E   R   S   P   H   R   P   I   L   Q   A   G   L   P   A   N   A   S   T   V     180 gtcggaggagacgtagagtttgtctgcaaggtttacagtgatgcccagccccacatccag   600
 V   G   G   D   V   E   F   V   C   K   V   Y   S   D   A   Q   P   H   I   Q     200 tggatcaagcacgtggaaaagaacggcagtaaatacgggcccgacgggctgccctacctc   660
 W   I   K   H   V   E   K   N   G   S   K   Y   G   P   D   G   L   P   Y   L     220 aaggttctcaaggccgccggtgttaacaccacggacaaagagattgaggttctctatatt   720
 K   V   L   K   A   A   G   V   N   T   T   D   K   E   I   E   V   L   Y   I     240 cggaatgtaacttttgaggacgctggggaatatacgtgcttggcgggtaattctattggg   780
 R   N   V   T   F   E   D   A   G   E   Y   T   C   L   A   G   N   S   I   G     260 atatcctttcactctgcatggttgacagttctgccagcgcctggaagagaaaaggagatt   840
 I   S   F   H   S   A   W   L   T   V   L   P   A   P   G   R   E   K   E   I     280 acagcttccccagactacctggagatagccatttactgcatagggtgtcttcttaatcgcc   900
 T   A   S   P   D   Y   L   E   I   A   I   Y   C   I   G   V   F   L   I   A     300 tgtatggtggtaacagtcatcctgtgccgaatgaagaacacgaccaagaagccagacttc   960
 C   M   V   V   T   V   I   L   C   R   M   K   N   T   T   K   K   P   D   F     320 agcagccagccggctgtgcacaagctgaccaaacgtatcccctgcggagacaggtaaca  1020
 S   S   Q   P   A   V   H   K   L   T   K   R   I   P   L   R   R   Q   V   T     340 gtttcggctgagtccagctcctccatgaactccaacacccgctggtgaggataacaaca  1080
 V   S   A   E   S   S   S   S   M   N   S   N   T   P   L   V   R   I   T   T     360
```

FIG. 108B

```
cgcctctcttcaacggcagacacccccatgctggcaggggtctccgagtatgaacttcca 1140
 R  L  S  S  T  A  D  T  P  M  L  A  G  V  S  E  Y  E  L  P   380 gaggacccaaaatggagtttccaagagataagctgacactgggcaagcccctggggagaa 1200
 E  D  P  K  W  E  F  P  R  D  K  L  T  L  G  K  P  L  G  E   400 ggttgctttgggcaagtggtcatggcggaagcagtgggaattgacaaagacaagcccaag 1260
 G  C  F  G  Q  V  V  M  A  E  A  V  G  I  D  K  D  K  P  K   420 gaggcggtcaccgtggccgtgaagatgttgaaagatgatgccacagagaaagacctttct 1320
 E  A  V  T  V  A  V  K  M  L  K  D  D  A  T  E  K  D  L  S   440 gatctggtgtcagagatggagatgatgaagatgattgggaaacacaagaatatcataaat 1380
 D  L  V  S  E  M  E  M  M  K  M  I  G  K  H  K  N  I  I  N   460 cttcttggagcctgcacacaggatgggcctctctatgtcatagttgagtatgcctctaaa 1440
 L  L  G  A  C  T  Q  D  G  P  L  Y  V  I  V  E  Y  A  S  K   480 ggcaacctccgagaatacctccgagcccggaggccacccgggatggagtactcctatgac 1500
 G  N  L  R  E  Y  L  R  A  R  R  P  P  G  M  E  Y  S  Y  D   500 attaaccgtgttcctgaggagcagatgaccttcaaggacttggtgtcatgcacctaccag 1560
 I  N  R  V  P  E  E  Q  M  T  F  K  D  L  V  S  C  T  Y  Q   520 ctggccagaggcatggagtacttggcttcccaaaaatgtattcatcgagatttagcagcc 1620
 L  A  R  G  M  E  Y  L  A  S  Q  K  C  I  H  R  D  L  A  A   540 agaaatgttttggtaacagaaaacaatgtgatgaaaatagcagactttggactcgccaga 1680
 R  N  V  L  V  T  E  N  N  V  M  K  I  A  D  F  G  L  A  R   560 gatatcaacaatatagactattacaaaaagaccaccaatgggcggcttccagtcaagtgg 1740
 D  I  N  N  I  D  Y  Y  K  K  T  T  N  G  R  L  P  V  K  W   580 atggctccagaagccctgtttgatagagtatacactcatcagagtgatgtctggtccttc 1800
 M  A  P  E  A  L  F  D  R  V  Y  T  H  Q  S  D  V  W  S  F   600 ggggtgttaatgtgggagatcttcactttagggggctcgccctacccagggattcccgtg 1860
 G  V  L  M  W  E  I  F  T  L  G  G  S  P  Y  P  G  I  P  V   620 gaggaactttttaagctgctgaaggaaggacacagaatggataagccagccaactgcacc 1920
 E  E  L  F  K  L  L  K  E  G  H  R  M  D  K  P  A  N  C  T   640 aacgaactgtacatgatgatgagggactgttggcatgcagtgccctcccagagaccaacg 1980
 N  E  L  Y  M  M  M  R  D  C  W  H  A  V  P  S  Q  R  P  T   660 ttcaagcagttggtagaagacttggatcgaattctcactctcacaaccaatgagggctca 2040
 F  K  Q  L  V  E  D  L  D  R  I  L  T  L  T  T  N  E  G  S   680 tccatgtccctttcacggtccaacagtcgtgagcacttgggaggtggaagcgaatctgat 2100
 S  M  S  L  S  R  S  N  S  R  E  H  L  G  G  G  S  E  S  D   700 aactggagagaccgaaatggaattggacctggaagtcatagtgaatttgcagcttctatt 2160
 N  W  R  D  R  N  G  I  G  P  G  S  H  S  E  F  A  A  S  I   720
```

FIG. 108C

```
ggcagccctaagcgtaaacaaaacaaatcaacggaacactatctcagcagtagcaattac 2220
 G   S   P   K   R   K   Q   N   K   S   T   E   H   Y   L   S   S   S   N   Y    740 atggactgcatttcctcgctgacaggaagcaatggctgtaacttaaatagctctttcaaa 2280
 M   D   C   I   S   S   L   T   G   S   N   G   C   N   L   N   S   S   F   K    760 ggttctgacctccctgagctcttcagcaaactgggcctgggcaaatacacagatgttttc 2340
 G   S   D   L   P   E   L   F   S   K   L   G   L   G   K   Y   T   D   V   F    780 cagcaacaagagatcgatcttcagacattcctcactctcacagatcaggatctgaaggag 2400
 Q   Q   Q   E   I   D   L   Q   T   F   L   T   L   T   D   Q   D   L   K   E    800 ctgggaataactacttttggtgccaggaggaaaatgctgcttgcaatttcagaactaaat 2460
 L   G   I   T   T   F   G   A   R   R   K   M   L   L   A   I   S   E   L   N    820 aaaaaccgaagaaagcttttgaatcgccaaatgcacgcacctctttcctggaaggtgga 2520
 K   N   R   R   K   L   F   E   S   P   N   A   R   T   S   F   L   E   G   G    840 gcgagtggaaggctaccccgtcagtatcactcagacattgctagtgtcagtggccgctgg 2580
 A   S   G   R   L   P   R   Q   Y   H   S   D   I   A   S   V   S   G   R   W    860 tag (SEQ ID NO: 119)
 -  (SEQ ID NO: 120)
```

FIG. 109A

```
atgcacaggaggagaagcaggagctgtcgggaagatcagaagccagtcatggatgaccag   60
 M  H  R  R  R  S  R  S  C  R  E  D  Q  K  P  V  M  D  D  Q    20 cgcgaccttatctccaacaatgagcaactgcccatgctgggccggcgccctggggccccg  120
 R  D  L  I  S  N  N  E  Q  L  P  M  L  G  R  R  P  G  A  P    40 gagagcaagtgcagccgcggagccctgtacacaggcttttccatcctggtgactctgctc  180
 E  S  K  C  S  R  G  A  L  Y  T  G  F  S  I  L  V  T  L  L    60 ctcgctggccaggccaccaccgcctacttcctgtaccagcagcagggccggctggacaaa  240
 L  A  G  Q  A  T  T  A  Y  F  L  Y  Q  Q  Q  G  R  L  D  K    80 ctgacagtcacctcccagaacctgcagctggagaacctgcgcatgaagcttcccaagcct  300
 L  T  V  T  S  Q  N  L  Q  L  E  N  L  R  M  K  L  P  K  P   100 cccaagcctgtgagcaagatgcgcatggccaccccgctgctgatgcaggcgctgcccatg  360
 P  K  P  V  S  K  M  R  M  A  T  P  L  L  M  Q  A  L  P  M   120 ggagccctgccccaggggcccatgcagaatgccaccaagtatggcaacatgacagaggac  420
 G  A  L  P  Q  G  P  M  Q  N  A  T  K  Y  G  N  M  T  E  D   140 catgtgatgcacctgctccagaatgctgaccccctgaaggtgtacccgccactgaagggg  480
 H  V  M  H  L  L  Q  N  A  D  P  L  K  V  Y  P  P  L  K  G   160 agcttcccggagaacctgagacaccttaagaacaccatggagaccatagactggaaggtc  540
 S  F  P  E  N  L  R  H  L  K  N  T  M  E  T  I  D  W  K  V   180 tttgagagctggatgcaccattggctcctgtttgaaatgagcaggcactccttggagcaa  600
 F  E  S  W  M  H  H  W  L  L  F  E  M  S  R  H  S  L  E  Q   200 aagcccactgacgctccaccgaaagctggagtcccaaataaaccaggcattcccaaatta  660
 K  P  T  D  A  P  P  K  A  G  V  P  N  K  P  G  I  P  K  L   220 ctagaagggagtaaaaattcaatacagtgggagaaagctgaagataatggatgtagaatt  720
 L  E  G  S  K  N  S  I  Q  W  E  K  A  E  D  N  G  C  R  I   240 acatactatatccttgagataagaaagagcacttcaaataatttacagaaccagaattta  780
 T  Y  Y  I  L  E  I  R  K  S  T  S  N  N  L  Q  N  Q  N  L   260 aggtggaagatgacatttaatggatcctgcagtagtgtttgcacatggaagtccaaaaac  840
 R  W  K  M  T  F  N  G  S  C  S  S  V  C  T  W  K  S  K  N   280 ctgaaaggaatatttcagttcagagtagtagctgcaaataatctagggtttggtgaatat  900
 L  K  G  I  F  Q  F  R  V  V  A  A  N  N  L  G  F  G  E  Y   300 agtggaatcagtgagaatattatattagttggagatgattttggataccagaaacaagt  960
 S  G  I  S  E  N  I  I  L  V  G  D  D  F  W  I  P  E  T  S   320 ttcatacttactattatagttggaatatttctggttgttacaatcccactgacctttgtc 1020
 F  I  L  T  I  I  V  G  I  F  L  V  V  T  I  P  L  T  F  V   340 tggcatagaagattaaagaatcaaaaaagtgccaaggaaggggtgacagtgcttataaac 1080
 W  H  R  R  L  K  N  Q  K  S  A  K  E  G  V  T  V  L  I  N   360
```

FIG. 109B

```
gaagacaaagagttggctgagctgcgaggtctggcagccggagtaggcctggctaatgcc 1140
 E   D   K   E   L   A   E   L   R   G   L   A   A   G   V   G   L   A   N   A    380 tgctatgcaatacatactcttccaacccaagaggagattgaaaatcttcctgccttccct 1200
 C   Y   A   I   H   T   L   P   T   Q   E   E   I   E   N   L   P   A   F   P    400 cgggaaaaactgactctgcgtctcttgctgggaagtggagccttttggagaagtgtatgaa 1260
 R   E   K   L   T   L   R   L   L   G   S   G   A   F   G   E   V   Y   E    420 ggaacagcagtggacatcttaggagttggaagtggagaaatcaaagtagcagtgaagact 1320
 G   T   A   V   D   I   L   G   V   G   S   G   E   I   K   V   A   V   K   T    440 ttgaagaagggttccacagaccaggagaagattgaattcctgaaggaggcacatctgatg 1380
 L   K   K   G   S   T   D   Q   E   K   I   E   F   L   K   E   A   H   L   M    460 agcaaatttaatcatcccaacattctgaagcagcttggagtttgtctgctgaatgaaccc 1440
 S   K   F   N   H   P   N   I   L   K   Q   L   G   V   C   L   L   N   E   P    480 caatacattatcctggaactgatggagggaggagaccttcttacttatttgcgtaaagcc 1500
 Q   Y   I   I   L   E   L   M   E   G   G   D   L   L   T   Y   L   R   K   A    500 cggatggcaacgttttatggtcctttactcaccttggttgaccttgtagacctgtgtgta 1560
 R   M   A   T   F   Y   G   P   L   L   T   L   V   D   L   V   D   L   C   V    520 gatatttcaaaaggctgtgtctacttggaacggatgcatttcattcacagggatctggca 1620
 D   I   S   K   G   C   V   Y   L   E   R   M   H   F   I   H   R   D   L   A    540 gctagaaattgccttgtttccgtgaaagactataccagtccacggatagtgaagattgga 1680
 A   R   N   C   L   V   S   V   K   D   Y   T   S   P   R   I   V   K   I   G    560 gactttggactcgccagagacatctataaaaatgattactatagaaagagaggggaaggc 1740
 D   F   G   L   A   R   D   I   Y   K   N   D   Y   Y   R   K   R   G   E   G    580 ctgctcccagttcggtggatggctccagaaagtttgatggatggaatcttcactactcaa 1800
 L   L   P   V   R   W   M   A   P   E   S   L   M   D   G   I   F   T   T   Q    600 tctgatgtatggtcttttggaattctgatttgggagattttaactcttggtcatcagcct 1860
 S   D   V   W   S   F   G   I   L   I   W   E   I   L   T   L   G   H   Q   P    620 tatccagctcattccaaccttgatgtgttaaactatgtgcaaacaggagggagactggag 1920
 Y   P   A   H   S   N   L   D   V   L   N   Y   V   Q   T   G   G   R   L   E    640 ccaccaagaaattgtcctgatgatctgtggaatttaatgacccagtgctgggctcaagaa 1980
 P   P   R   N   C   P   D   D   L   W   N   L   M   T   Q   C   W   A   Q   E    660 cccgaccaaagacctacttttcatagaattcaggaccaacttcagttattcagaaatttt 2040
 P   D   Q   R   P   T   F   H   R   I   Q   D   Q   L   Q   L   F   R   N   F    680 ttcttaaatagcatttataagtccagagatgaagcaaacaacagtggagtcataaatgaa 2100
 F   L   N   S   I   Y   K   S   R   D   E   A   N   N   S   G   V   I   N   E    700 agctttgaaggtgaagatggcgatgtgatttgtttgaattcagatgacattatgccagtt 2160
 S   F   E   G   E   D   G   D   V   I   C   L   N   S   D   D   I   M   P   V    720
```

FIG. 109C

```
gctttaatggaaacgaagaaccgagaagggttaaactatatggtacttgctacagaatgt 2220
 A  L  M  E  T  K  N  R  E  G  L  N  Y  M  V  L  A  T  E  C   740 ggccaaggtgaagaaaagtctgagggtcctctaggctcccaggaatctgaatcttgtggt 2280
 G  Q  G  E  E  K  S  E  G  P  L  G  S  Q  E  S  E  S  C  G   760 ctgaggaaagaagagaaggaaccacatgcagacaaagatttctgccaagaaaaacaagtg 2340
 L  R  K  E  E  K  E  P  H  A  D  K  D  F  C  Q  E  K  Q  V   780 gcttactgcccttctggcaagcctgaaggcctgaactatgcctgtctcactcacagtgga 2400
 A  Y  C  P  S  G  K  P  E  G  L  N  Y  A  C  L  T  H  S  G   800 tatggagatgggtctgattaa (SEQ ID NO: 121)
 Y  G  D  G  S  D  -  (SEQ ID NO: 122)
```

FIG. 110

```
CTGCCTGGGG AGCCCCCCCG CCCCACATCC TGCCCCGCAA AAGGCAGCTT    50
CACCAAAGTG GGGTATTTCC AGCCTTTGTA GCTTTCACTT CCACATCTAC   100
CAAGTGGGCG GAGTGGCCTT CTGTGGACGA ATCAGATTCC TCTCCAGCAC   150
CGACTTTAAG AGGCGAGCCG GGGGGTCAGG GTCCCAGATG CACAGGAGGA   200
GAAGCAGGAG CTGTCGGGAA GATCAGAAGC CAGTCATGGA TGACCAGCGC   250
GACCTTATCT CCAACAATGA GCAACTGCCC ATGCTGGGCC GGCGCCCTGG   300
GGCCCCGGAG AGCAAGTGCA GCCGCGGAGC CCTGTACACA GGCTTTTCCA   350
TCCTGGTGAC TCTGCTCCTC GCTGGCCAGG CCACCACCGC CTACTTCCTG   400
TACCAGCAGC AGGGCCGGCT GGACAAACTG ACAGTCACCT CCCAGAACCT   450
GCAGCTGGAG AACCTGCGCA TGAAGCTTCC CAAGCCTCCC AAGCCTGTGA   500
GCAAGATGCG CATGGCCACC CCGCTGCTGA TGCAGGCGCT GCCCATGGGA   550
GCCCTGCCCC AGGGGCCCAT GCAGAATGCC ACCAAGTATG CAACATGAC   600
AGAGGACCAT GTGATGCACC TGCTCCAGAA TGCTGACCCC CTGAAGGTGT   650
ACCCGCCACT GAAGGGGAGC TTCCCGGAGA ACCTGAGACA CCTTAAGAAC   700
ACCATGGAGA CCATAGACTG GAAGGTCTTT GAGAGCTGGA TGCACCATTG   750
GCTCCTGTTT GAAATGAGCA GGCACTCCTT GGAGCAAAAG CCCACTGACG   800
CTCCACCGAA AGAGTCACTG GAACTGGAGG ACCCGTCTTC TGGGCTGGGT   850
GTGACCAAGC AGGATCTGGG CCCAGTCCCC ATGTGAGAGC AGCAGAGGCG   900
GTCTTCAACA TCCTGCCAGC CCCACACAGC TACAGCTTTC TTGCTCCCTT   950
CAGCCCCCAG CCCCTCCCCC ATCTCCCACC CTGTACCTCA TCCCATGAGA  1000
CCCTGGTGCC TGGCTCTTTC GTCACCCTTG GACAAGACAA ACCAAGTCGG  1050
AACAGCAGAT AACAATGCAG CAAGGCCCTG CTGCCCAATC TCCATCTGTC  1100
AACAGGGGCG TGAGGTCCCA GGAAGTGGCC AAAAGCTAGA CAGATCCCCG  1150
TTCCTGACAT CACAGCAGCC TCCAACACAA GGCTCCAAGA CCTAGGCTCA  1200
TGGACGAGAT GGGAAGGCAC AGGGAGAAGG GATAACCCTA CACCCAGACC  1250
CCAGGCTGGA CATGCTGACT GTCCTCTCCC CTCCAGCCTT TGGCCTTGGC  1300
TTTTCTAGCC TATTTACCTG CAGGCTGAGC CACTCTCTTC CCTTTCCCCA  1350
GCATCACTCC CCAAGGAAGA GCCAATGTTT TCCACCCATA ATCCTTTCTG  1400
CCGACCCCTA GTTCCCTCTG CTCAGCCAAG CTTGTTATCA GCTTTCAGGG  1450
CCATGGTTCA CATTAGAATA AAAGGTAGTA ATTAGAACAa aaaaaaaaa  1500
aaaaaa (SEQ ID NO: 123)
```

FIG. 111

MHRRRSRSCREDQKPVMDDQRDLISNNEQLPMLGRRPGAPESKCSRGALYTGFSILVTLL
LAGQATTAYFLYQQQGRLDKLTVTSQNLQLENLRMKLPKPPKPVSKMRMATPLLMQALPM
GALPQGPMQNATKYGNMTEDHVMHLLQNADPLKVYPPLKGSFPENLRHLKNTMETIDWKV
FESWMHHWLLFEMSRHSLEQKPTDAPPKESLELEDPSSGLGVTKQDLGPVPM-
(SEQ ID NO: 124)

FIG. 112A

```
CAAGCTTTCA AGCATTCAAA GGTCTAAATG AAAAAGGCTA AGTATTATTT   50
CAAAAGGCAA GTATATCCTA ATATAGCAAA ACAAACAAAG CAAAATCCAT  100
CAGCTACTCC TCCAATTGAA GTGATGAAGC CCAAATAATT CATATAGCAA  150
AATGGAGAAA ATTAGACCGG CCATCTAAAA ATCTGCCATT GGTGAAGTGA  200
TGAAGAACAT TTACTGTCTT ATTCCGAAGC TTGTCAATTT TGCAACTCTT  250
GGCTGCCTAT GGATTTCTGT GGTGCAGTGT ACAGTTTTAA ATAGCTGCCT  300
AAAGTCGTGT GTAACTAATC TGGGCCAGCA GCTTGACCTT GGCACACCAC  350
ATAATCTGAG TGAACGTGT ATCCAAGGAT GTCACTTTTG GAACTCTGTA  400
GATCAGAAAA ACTGTGCTTT AAAGTTCGG GAGTCGTGTG AGGTTGGCTG  450
TAGCAGCGCG GAAGGTGCAT ATGAAGAGGA AGTACTGGAA AATGCAGACC  500
TACCAACTGC TCCCTTTGCT TCTTCCATTG GAAGCCACAA TATGACATTA  550
CGATGGAAAT CTGCAAACTT CTCTGGAGTA AAATACATCA TTCAGTGGAA  600
ATATGCACAA CTTCTGGGAA GCTGGACTTA TACTAAGACT GTGTCCAGAC  650
CGTCCTATGT GGTCAAGCCC CTGCACCCCT TCACTGAGTA CATTTTCCGA  700
GTGGTTTGGA TCTTCACAGC GCAGCTGCAG CTCTACTCCC CTCCAAGTCC  750
CAGTTACAGG ACTCATCCTC ATGGAGTTCC TGAAACTGCA CCTTTGATTA  800
GGAATATTGA GAGCTCAAGT CCCGACACTG TGGAAGTCAG CTGGGATCCA  850
CCTCAATTCC CAGGTGGACC TATTTGGGT TATAACTTAA GGCTGATCAG  900
CAAAAATCAA AAATTAGATG CAGGGACACA GAGAACCAGT TTCCAGTTTT  950
ACTCCACTTT ACCAAATACT ATCTACAGGT TTTCTATTGC AGCAGTAAAT 1000
GAAGTTGGTG AGGGTCCAGA AGCAGAATCT AGTATTACCA CTTCATCTTC 1050
AGCAGTTCAA CAAGAGGAAC AGTGGCTCTT TTTATCCAGA AAAACTTCTC 1100
TAAGAAAGAG ATCTTTAAAA CATTTAGTAG ATGAAGCACA TTGCCTTCGG 1150
TTGGATGCTA TATACCATAA TATTACAGGA ATATCTGTTG ATGTCCACCA 1200
GCAAATTGTT TATTTCTCTG AAGGAACTCT CATATGGGCG AAGAAGGCTG 1250
CCAACATGTC TGATGTATCT GACCTGAGAA TTTTTTACAG AGGTTCAGGA 1300
TTAATTTCTT CTATCTCCAT AGATTGGCTT TATCAAAGAA TGTATTTCAT 1350
CATGGATGAA CTGGTATGTG TCTGTGATTT AGAGAACTGC TCAAACATCG 1400
AGGAAATTAC TCCACCCTCT ATTAGTGCAC CTCAAAAAAT TGTGGCTGAT 1450
TCATACAATG GGTATGTCTT TTACCTCCTG AGAGATGGCA TTTATAGAGC 1500
AGACCTTCCT GTACCATCTG GCCGGTGTGC AGAAGCTGTG CGTATTGTGG 1550
AGAGTTGCAC GTTAAGGAC TTTGCAATCA AGCCACAAGC CAAGCGAATC 1600
ATTTACTTCA ATGACACTGC CCAAGTCTTC ATGTCAACAT TTCTGGATGG 1650
CTCTGCTTCC CATCTCATCC TACCTCGCAT CCCCTTTGCT GATGTGAAAA 1700
GTTTTGCTTG TGAAAACAAT GACTTCTTG TCACAGATGG CAAGGTCATT 1750
TTCCAACAGG ATGCTTTGTC TTTTAATGAA TTCATCGTGG GATGTGACCT 1800
GAGTCACATA GAAGAATTTG GGTTTGGTAA CTTGGTCATC TTTGGCTCAT 1850
CCTCCCAGCT GCACCCTCTG CCAGGCCGCC CGCAGGAGCT TCGGTGCTG 1900
TTTGGCTCTC ACCAGGCTCT TGTTCAATGG AAGCCTCCTG CCCTTGCCAT 1950
AGGAGCCAAT GTCATCCTGA TCAGTGATAT TATTGAACTC TTTGAATTAG 2000
GCCCTTCTGC CTGGCAGAAC TGGACCTATG AGGTGAAAGT ATCCACCCAA 2050
GACCCTCCTG AAGTCACTCA TATTTCTTG AACATAAGTG GAACCATGCT 2100
GAATGTACCT GAGCTGCAGA GTGCTATGAA ATACAAGGTT TCTGTGAGAG 2150
CAAGTTCTCC AAAGAGGCCA GGCCCTGGT CAGAGCCCTC AGTGGGTACT 2200
ACCCTGGTGC CAGCTAGTGA ACCACCATTT ATCATGGCTG TGAAAGAAGA 2250
TGGGCTTTGG AGTAAACCAT TAAATAGCTT TGGCCCAGGA GAGTTCTTAT 2300
CCTCTGATAT AGGAAATGTG TCAGACATGG ATTGGTATAA CAACAGCCTC 2350
TACTACAGTG ACACGAAAGG CGACGTTTTT GTGTGGCTGC TGAATGGGAC 2400
GGATATCTCA GAGAATTATC ACCTACCCAG CATTGCAGGA GCAGGGCTT 2450
TAGCTTTTGA GTGGCTGGGT CACTTTCTCT ACTGGGCTGG AAAGACATAT 2500
GTGATACAAA GGCAGTCTGT GTTGACGGGA CACACAGACA TTGTTACCCA 2550
CGTGAAGCTA TTGGTGAATG ACATGGTGGT GGATTCAGTT GGTGGATATC 2600
TCTACTGGAC CACACTCTAT TCAGTGGAAA GCACCAGACT AAATGGGGAA 2650
AGTTCCCTTG TACTACAGAC ACAGCCTTGG TTTTCTGGGA AAAAGGTAAT 2700
```

FIG. 112B

```
TGCTCTAACT TTAGACCTCA GTGATGGGCT CCTGTATTGG TTGGTTCAAG  2750
ACAGTCAATG TATTCACCTG TACACAGCTG TTCTTCGGGG ACAGAGCACT  2800
GGGGATACCA CCATCACAGA ATTTGCAGCC TGGAGTACTT CTGAAATTTC  2850
CCAGAATGCA CTGATGTACT ATAGTGGTCG GCTGTTCTGG ATCAATGGCT  2900
TTAGGATTAT CACAACTCAA GAAATAGGTC AGAAACCAG TGTCTCTGTT   2950
TTGGAACCAG CCAGATTTAA TCAGTTCACA ATTATTCAGA CATCCCTTAA  3000
GCCCCTGCCA GGGAACTTTT CCTTTACCCC TAAGGTTATT CCAGATTCTG  3050
TTCAAGAGTC TTCATTTAGG ATTGAAGGAA ATGCTTCAAG TTTTCAAATC  3100
CTGTGGAATG GTCCCCCTGC GGTAGACTGG GGTGTAGTTT CTACAGTGT   3150
AGAATTTAGT GCTCATTCTA AGTTCTTGGC TAGTGAACAA CACTCTTTAC  3200
CTGTATTTAC TGTGGAAGGA CTGGAACCTT ATGCCTTATT TAATCTTTCT  3250
GTCACTCCTT ATACCTACTG GGGAAAGGGC CCCAAAACAT CTCTGTCACT  3300
TCGAGCACCT GAAACAGTTC CATCAGCACC AGAGAACCCC AGAATATTTA  3350
TATTACCAAG TGGAAAATGC TGCAACAAGA ATGAAGTTGT GGTGGAATTT  3400
AGGTGGAACA AACCTAAGCA TGAAAATGGG GTGTTAACAA AATTTGAAAT  3450
TTTCTACAAT ATATCCAATC AAAGTATTAC AAACAAAACA TGTGAAGACT  3500
GGATTGCTGT CAATGTCACT CCCTCAGTGA TGTCTTTTCA ACTTGAAGGC  3550
ATGAGTCCCA GATGCTTTAT TGCCTTCCAG GTTAGGGCCT TTACATCTAA  3600
GGGGCCAGGA CCATATGCTG ACGTTGTAAA GTCTACAACA TCAGAAATCA  3650
ACCCATTTCC TCACCTCATA ACTCTTCTTG GTAACAAGAT AGTTTTTTA   3700
GATATGGATC AAAATCAAGT TGTGTGGACG TTTTCAGCAG AAAGAGTTAT  3750
CAGTGCCGTT TGCTACACAG CTGATAATGA GATGGGATAT TATGCTGAAG  3800
GGGACTCACT CTTTCTTCTG CACTTGCACA ATCGCTCTAG CTCTGAGCTT  3850
TTCCAAGATT CACTGGTTTT TGATATCACA GTTATTACAA TTGACTGGAT  3900
TTCAAGGCAC CTCTACTTTG CACTGAAAGA ATCACAAAAT GGAATGCAAG  3950
TATTTGATGT TGATCTTGAA CACAAGGTGA AATATCCCAG AGAGGTGAAG  4000
ATTCACAATA GGAATTCAAC AATAATTTCT TTTTCTGTAT ATCCTCTTTT  4050
AAGTCGCTTG TATTGGACAG AAGTTTCCAA TTTTGGCTAC CAGATGTTCT  4100
ACTACAGTAT TATCAGTCAC ACCTTGCACC GAATTCTGCA ACCCACAGCT  4150
ACAAACCAAC AAAACAAAAG GAATCAATGT TCTTGTAATG TGACTGAATT  4200
TGAGTTAAGT GGAGCAATGG CTATTGATAC CTCTAACCTA GAGAAACCAT  4250
TGATATACTT TGCCAAAGCA CAAGAGATCT GGGCAATGGA TCTGGAAGGC  4300
TGTCAGTGTT GGAGAGTTAT CACAGTACCT GCTATGCTCG CAGGAAAAAC  4350
CCTTGTTAGC TTAACTGTGG ATGGAGATCT TATATACTGG ATCATCACAG  4400
CAAAGGACAG CACACAGATT TATCAGGCAA AGAAAGGAAA TGGGGCCATC  4450
GTTTCCCAGG TGAAGGCCCT AAGGAGTAGG CATATCTTGG CTTACAGTTC  4500
AGTTATGCAG CCTTTTCCAG ATAAAGCGTT TCTGTCTCTA GCTTCAGACA  4550
CTGTGGAACC AACTATACTT AATGCCACTA ACACTAGCCT CACAATCAGA  4600
TTACCTCTGG CCAAGACAAA CCTCACATGG TATGGCATCA CCAGCCCTAC  4650
TCCAACATAC CTGGTTTATT ATGCAGAAGT TAATGACAGG AAAAACAGCT  4700
CTGACTTGAA ATATAGAATT CTGGAATTTC AGGACAGTAT AGCTCTTATT  4750
GAAGATTTAC AACCATTTTC AACATACATG ATACAGATAG CTGTAAAAAA  4800
TTATTATTCA GATCCTTTGG AACATTTACC ACCAGGAAAA GAGATTTGGG  4850
GAAAAACTAA AAATGGAGTA CCAGAGGCAG TGCAGCTCAT TAATACAACT  4900
GTGCGGTCAG ACACCAGCCT CATTATATCT TGGAGAGAAT CTCACAAGCC  4950
AAATGGACCT AAAGAATCAG TCCGTTATCA GTTGGCAATC TCACACCTGG  5000
CCCTAATTCC TGAAACTCCT CTAAGACAAA GTGAATTTCC AAATGGAAGG  5050
CTCACTCTCC TTGTTACTAG ACTGTCTGGT GGAAATATTT ATGTGTTAAA  5100
GGTTCTTGCC TGCCACTCTG AGGAAATGTG GTGTACAGAG AGTCATCCTG  5150
TCACTGTGGA AATGTTTAAC ACACCAGAGA AACCTTATTC CTTGGTTCCA  5200
GAGAACACTA GTTTGCAATT TAATTGGAAG GCTCCATTGA ATGTTAACCT  5250
CATCAGATTT TGGGTTGAGC TACAGAAGTG GAAATACAAT GAGTTTTACC  5300
ATGTTAAAAC TTCATGCAGC CAAGGTCCTG CTTATGTCTG TAATATCACA  5350
AATCTACAAC CTTATACTTC ATATAATGTC AGAGTAGTGG TGGTTTATAA  5400
```

FIG. 112C

```
GACGGGAGAA AATAGCACCT CACTTCCAGA AAGCTTTAAG ACAAAAGCTG  5450
GAGTCCCAAA TAAACCAGGC ATTCCCAAAT TACTAGAAGG GAGTAAAAAT  5500
TCAATACAGT GGGAGAAAGC TGAAGATAAT GGATGTAGAA TTACATACTA  5550
TATCCTTGAG ATAAGAAAGA GCACTTCAAA TAATTTACAG AACCAGAATT  5600
TAAGGTGGAA GATGACATTT AATGGATCCT GCAGTAGTGT TTGCACATGG  5650
AAGTCCAAAA ACCTGAAAGG AATATTTCAG TTCAGAGTAG TAGCTGCAAA  5700
TAATCTAGGG TTTGGTGAAT ATAGTGGAAT CAGTGAGAAT ATTATATTAG  5750
TTGGAGATGA TTTTTGGATA CCAGAAACAA GTTTCATACT TACTATTATA  5800
GTTGGAATAT TTCTGGTTGT TACAATCCCA CTGACCTTTG TCTGGCATAG  5850
AAGATTAAAG AATCAAAAAA GTGCCAAGGA AGGGGTGACA GTGCTTATAA  5900
ACGAAGACAA AGAGTTGGCT GAGCTGCGAG GTCTGGCAGC CGGAGTAGGC  5950
CTGGCTAATG CCTGCTATGC AATACATACT CTTCCAACCC AAGAGGAGAT  6000
TGAAAATCTT CCTGCCTTCC CTCGGGAAAA ACTGACTCTG CGTCTCTTGC  6050
TGGGAAGTGG AGCCTTTGGA GAAGTGTATG AAGGAACAGC AGTGGACATC  6100
TTAGGAGTTG GAAGTGGAGA AATCAAAGTA GCAGTGAAGA CTTTGAAGAA  6150
GGGTTCCACA GACCAGGAGA AGATTGAATT CCTGAAGGAG GCACATCTGA  6200
TGAGCAAATT TAATCATCCC AACATTCTGA AGCAGCTTGG AGTTTGTCTG  6250
CTGAATGAAC CCCAATACAT TATCCTGGAA CTGATGGAGG GAGGAGACCT  6300
TCTTACTTAT TTGCGTAAAG CCCGGATGGC AACGTTTAT GGTCCTTTAC  6350
TCACCTTGGT TGACCTTGTA GACCTGTGTG TAGATATTTC AAAAGGCTGT  6400
GTCTACTTGG AACGGATGCA TTTCATTCAC AGGATCTGG CAGCTAGAAA  6450
TTGCCTTGTT TCCGTGAAAG ACTATACCAG TCCACGGATA GTGAAGATTG  6500
GAGACTTTGG ACTCGCCAGA GACATCTATA AAAATGATTA CTATAGAAAG  6550
AGAGGGGAAG GCCTGCTCCC AGTTCGGTGG ATGGCTCCAG AAAGTTTGAT  6600
GGATGGAATC TTCACTACTC AATCTGATGT ATGGTCTTTT GGAATTCTGA  6650
TTTGGGAGAT TTTAACTCTT GGTCATCAGC CTTATCCAGC TCATTCCAAC  6700
CTTGATGTGT TAAACTATGT GCAAACAGGA GGGAGACTGG AGCCACCAAG  6750
AAATTGTCCT GATGATCTGT GGAATTTAAT GACCCAGTGC TGGGCTCAAG  6800
AACCCGACCA AAGACCTACT TTTCATAGAA TTCAGGACCA ACTTCAGTTA  6850
TTCAGAAATT TTTTCTTAAA TAGCATTTAT AAGTCCAGAG ATGAAGCAAA  6900
CAACAGTGGA GTCATAAATG AAAGCTTTGA AGGTGAAGAT GGCGATGTGA  6950
TTTGTTTGAA TTCAGATGAC ATTATGCCAG TTGCTTTAAT GGAAACGAAG  7000
AACCGAGAAG GGTTAAACTA TATGGTACTT GCTACAGAAT GTGGCCAAGG  7050
TGAAGAAAAG TCTGAGGGTC CTCTAGGCTC CCAGGAATCT GAATCTTGTG  7100
GTCTGAGGAA AGAAGAGAAG GAACCACATG CAGACAAAGA TTTCTGCCAA  7150
GAAAAACAAG TGGCTTACTG CCCTTCTGGC AAGCCTGAAG GCCTGAACTA  7200
TGCCTGTCTC ACTCACAGTG GATATGGAGA TGGGTCTGAT TAATAGCGTT  7250
GTTTGGGAAA TAGAGAGTTG AGATAAACAC TCTCATTCAG TAGTTACTGA  7300
AAGAAAACTC TGCTAGAATG ATAAATGTCA TGGTGGTCTA TAACTCCAAA  7350
TAAACAATGC AACGTTCC (SEQ ID NO: 125)
```

FIG. 113

```
MKNIYCLIPKLVNFATLGCLWISVVQCTVLNSCLKSCVTNLGQQLDLGTPHNLSEPCIQG
CHFWNSVDQKNCALKCRESCEVGCSSAEGAYEEEVLENADLPTAPFASSIGSHNMTLRWK
SANFSGVKYIIQWKYAQLLGSWTYTKTVSRPSYVVKPLHPFTEYIFRVVWIFTAQLQLYS
PPSPSYRTHPHGVPETAPLIRNIESSSPDTVEVSWDPPQFPGGPILGYNLRLISKNQKLD
AGTQRTSFQFYSTLPNTIYRFSIAAVNEVGEGPEAESSITTSSSAVQQEEQWLFLSRKTS
LRKRSLKHLVDEAHCLRLDAIYHNITGISVDVHQQIVYFSEGTLIWAKKAANMSDVSDLR
IFYRGSGLISSISIDWLYQRMYFIMDELVCVCDLENCSNIEEITPPSISAPQKIVADSYN
GYVFYLLRDGIYRADLPVPSGRCAEAVRIVESCTLKDFAIKPQAKRIIYFNDTAQVFMST
FLDGSASHLILPRIPFADVKSFACENNDFLVTDGKVIFQQDALSFNEFIVGCDLSHIEEF
GFGNLVIFGSSSQLHPLPGRPQELSVLFGSHQALVQWKPPALAIGANVILISDIIELFEL
GPSAWQNWTYEVKVSTQDPPEVTHIFLNISGTMLNVPELQSAMKYKVSVRASSPKRPGPW
SEPSVGTTLVPASEPPFIMAVKEDGLWSKPLNSFGPGEFLSSDIGNVSDMDWYNNSLYYS
DTKGDVFVWLLNGTDISENYHLPSIAGAGALAFEWLGHFLYWAGKTYVIQRQSVLTGHTD
IVTHVKLLVNDMVVDSVGGYLYWTTLYSVESTRLNGESSLVLQTQPWFSGKKVIALTLDL
SDGLLYWLVQDSQCIHLYTAVLRGQSTGDTTITEFAAWSTSEISQNALMYYSGRLFWING
FRIITTQEIGQKTSVSVLEPARFNQFTIIQTSLKPLPGNFSFTPKVIPDSVQESSFRIEG
NASSFQILWNGPPAVDWGVVFYSVEFSAHSKFLASEQHSLPVFTVEGLEPYALFNLSVTP
YTYWGKGPKTSLSLRAPETVPSAPENPRIFILPSGKCCNKNEVVVEFRWNKPKHENGVLT
KFEIFYNISNQSITNKTCEDWIAVNVTPSVMSFQLEGMSPRCFIAFQVRAFTSKGPGPYA
DVVKSTTSEINPFPHLITLLGNKIVFLDMDQNQVVWTFSAERVISAVCYTADNEMGYYAE
GDSLFLLHLHNRSSSELFQDSLVFDITVITIDWISRHLYFALKESQNGMQVFDVDLEHKV
KYPREVKIHNRNSTIISFSVYPLLSRLYWTEVSNFGYQMFYYSIISHTLHRILQPTATNQ
QNKRNQCSCNVTEFELSGAMAIDTSNLEKPLIYFAKAQEIWAMDLEGCQCWRVITVPAML
AGKTLVSLTVDGDLIYWIITAKDSTQIYQAKKGNGAIVSQVKALRSRHILAYSSVMQPFP
DKAFLSLASDTVEPTILNATNTSLTIRLPLAKTNLTWYGITSPTPTYLVYYAEVNDRKNS
SDLKYRILEFQDSIALIEDLQPFSTYMIQIAVKNYYSDPLEHLPPGKEIWGKTKNGVPEA
VQLINTTVRSDTSLIISWRESHKPNGPKESVRYQLAISHLALIPETPLRQSEFPNGRLTL
LVTRLSGGNIYVLKVLACHSEEMWCTESHPVTVEMFNTPEKPYSLVPENTSLQFNWKAPL
NVNLIRFWVELQKWKYNEFYHVKTSCSQGPAYVCNITNLQPYTSYNVRVVVVYKTGENST
SLPESFKTKAGVPNKPGIPKLLEGSKNSIQWEKAEDNGCRITYYILEIRKSTSNNLQNQN
LRWKMTFNGSCSSVCTWKSKNLKGIFQFRVVAANNLGFGEYSGISENIILVGDDFWIPET
SFILTIIVGIFLVVTIPLTFVWHRRLKNQKSAKEGVTVLINEDKELAELRGLAAGVGLAN
ACYAIHTLPTQEEIENLPAFPREKLTLRLLLGSGAFGEVYEGTAVDILGVGSGEIKVAVK
TLKKGSTDQEKIEFLKEAHLMSKFNHPNILKQLGVCLLNEPQYIILELMEGGDLLTYLRK
ARMATFYGPLLTLVDLVDLCVDISKGCVYLERMHFIHRDLAARNCLVSVKDYTSPRIVKI
GDFGLARDIYKNDYYRKRGEGLLPVRWMAPESLMDGIFTTQSDVWSFGILIWEILTLGHQ
PYPAHSNLDVLNYVQTGGRLEPPRNCPDDLWNLMTQCWAQEPDQRPTFHRIQDQLQLFRN
FFLNSIYKSRDEANNSGVINESFEGEDGDVICLNSDDIMPVALMETKNREGLNYMVLATE
CGQGEEKSEGPLGSQESESCGLRKEEKEPHADKDFCQEKQVAYCPSGKPEGLNYACLTHS
GYGDGSD- (SEQ ID NO: 126)
```

FUSION MOLECULES AND USES THEREOF

This application is the U.S. National Phase Application of 35 U.S.C. § 371 of International Application No. PCT/US2013/068604, filed Nov. 5, 2013, which claims the benefit of U.S. Provisional Application No. 61/763,442, filed Feb. 11, 2013 and U.S. Provisional Application No. 61/722,533, filed Nov. 5, 2012, the contents of each of which are incorporated herein by reference in their entirety.

SEQUENCE LISTING

The instant application contains a Sequence Listing which has been submitted in ASCII format via EFS-Web and is hereby incorporated by reference in its entirety. Said ASCII copy, created on Sep. 16, 2015, is named F2036-7044US_SL.txt and is 1,334,847 bytes in size.

BACKGROUND

Cancer represents the phenotypic end-point of multiple genetic lesions that endow cells with a full range of biological properties required for tumorigenesis. Indeed, a hallmark genomic feature of many cancers, including, for example, B cell cancer, lung cancer, breast cancer, ovarian cancer, pancreatic cancer, and colon cancer, is the presence of numerous complex chromosome structural aberrations, including translocations, intra-chromosomal inversions, point mutations, deletions, gene copy number changes, gene expression level changes, and germline mutations, among others.

The need still exists for identifying novel genetic lesions associated with cancer. Such genetic lesions can be an effective approach to develop compositions, methods and assays for evaluating and treating cancer patients.

SUMMARY

The invention is based, at least in part, on the discovery of novel rearrangement events that give rise to fusion molecules that includes a fragment of a first gene and a fragment of a second gene, e.g., a fusion that includes a 5'-exon and a 3'-exon summarized in FIGS. 1A-1H. The term "fusion" or "fusion molecule" is used generically herein, and includes any fusion molecule (e.g., gene, gene product (e.g., cDNA, mRNA, or polypeptide), and variant thereof) that includes a fragment of first gene and a fragment of second gene described herein, including, e.g., an FGFR3-TACC3, TRIM24-BRAF, CNTL-RAF1, and so on summarized in FIGS. 1A-1H. Expression of the fusion molecules was detected in cancer tissues, thus suggesting an association with neoplastic growth or cancer (including pre-malignant, or malignant and/or metastatic growth).

Accordingly, the invention provides, at least in part, the following: methods for identifying, assessing or detecting a fusion molecule as described herein; methods for identifying, assessing, evaluating, and/or treating a subject having a cancer, e.g., a cancer having a fusion molecule as described herein; isolated fusion nucleic acid molecules, nucleic acid constructs, host cells containing the nucleic acid molecules; purified fusion polypeptides and binding agents; detection reagents (e.g., probes, primers, antibodies, kits, capable, e.g., of specific detection of a fusion nucleic acid or protein); screening assays for identifying molecules that interact with, e.g., inhibit, the fusions, e.g., novel kinase inhibitors; as well as assays and kits for evaluating, identifying, assessing and/or treating a subject having a cancer, e.g., a cancer having a fusion. The compositions and methods identified herein can be used, for example, to identify new inhibitors; to evaluate, identify or select a subject, e.g., a patient, having a cancer; and to treat or prevent a cancer.

Each of these fusion molecules is described herein in more detail.

FGFR3-TACC3 Fusions

In one embodiment, a fusion includes an in-frame fusion of an exon of fibroblast growth factor receptor 3 (FGFR3), e.g., one more exons of FGFR3 (e.g., one or more of exons 1-18 of FGFR3) or a fragment thereof, and an exon of transforming, acidic coiled-coil containing protein 3 (TACC3), e.g., one or more exons of a TACC3 (e.g., one or more of exons 8-16 of TACC3) or a fragment thereof. For example, the FGFR3-TACC3 fusion can include an in-frame fusion within an intron of FGFR3 (e.g., intron 17) or a fragment thereof, with an intron of TACC3 (e.g., intron 7) or a fragment thereof. In one embodiment, the fusion of the FGFR3-TACC3 fusion comprises the nucleotide sequence of: chromosome 4 at one or more of nucleotide 1,808,755, 1,808,702 or 1,808,880 (plus or minus 10, 20, 30, 50, 60, 70, 80, 100 or more nucleotides) and chromosome 4 at one or more of nucleotide 1,373,289, 1,737,469, 1,739,469 (plus or minus 10, 20, 30, 50, 60, 70, 80, 100 or more nucleotides). In one embodiment, the FGFR3-TACC3 fusion is a duplication, e.g., a duplication of a portion of chromosome 4.

In certain embodiments, the FGFR3-TACC3 fusion is in a 5'-FGFR3 to 3'-TACC3 configuration (also referred to herein as "5'-FGFR3-TACC-3')." The term "fusion" or "fusion molecule" can refer to a polypeptide or a nucleic acid fusion, depending on the context. It may include a full-length sequence or a fragment thereof, e.g., a fusion junction (e.g., a fragment including a portion of FGFR3 and a portion of TAC3, e.g., a portion of the FGFR3-TACC3 fusion described herein). In one embodiment, the FGFR3-TACC3 fusion polypeptide includes the amino acid sequence shown in FIGS. 2A-2D (SEQ ID NO:2) or FIGS. 4 and 6 (SEQ ID NOs:4 and 6), or an amino acid sequence substantially identical thereto. In another embodiment, the FGFR3-TACC3 fusion nucleic acid includes the nucleotide sequence shown in FIGS. 2A-2D (SEQ ID NO:1) or FIGS. 3A-3B and 5A-5B (SEQ ID NOs:3 and 5), or a nucleotide sequence substantially identical thereto. In one embodiment, the FGFR3-TACC3 fusion polypeptide comprises sufficient FGFR3 and sufficient TACC3 sequence such that the 5' FGFR3-3' TACC3 fusion has kinase activity, e.g., has elevated activity, e.g., FGFR3 tyrosine kinase activity, as compared with wild type FGFR3, e.g., in a cell of a cancer referred to herein (a carcinoma, e.g., adenocarcinoma, e.g., lung adenocarcinoma, cervical adenocarcinoma, uterus endometrial carcinoma; a bladder urothelial carcinoma; a pancreatic ductal carcinoma; a kidney urothelial carcinoma; a brain astrycytoma, a brain glioblastoma; a cholangiosarcoma, e.g., a liver cholangiosarcoma). In one embodiment, the TACC3 sequence has a coiled-coil domain, e.g., it may dimerize with one or more partners.

In certain embodiments, the FGFR3-TACC3 fusion comprises one or more (or all of) exons 1-17 from FGFR3 and one or more (or all of) exons 8-16 from TACC3 (e.g., one or more of the exons shown in FIGS. 2A-2D or FIGS. 3A-3B and 5A-5B). In another embodiment, the FGFR3-TACC3 fusion comprises one or more (or all of) exons 1-18 of FGFR3 and one or more (or all of) exons 10-16 of TACC3. In certain embodiments, the FGFR3-TACC3 fusion comprises at least 1, 2, 3, 4, 5, 6, 7, 9, 10, 11, 12, 13, 14, 15, 16, 17, 18 or more exons from FGFR3 and at least 1, 2, 3, 4, 5, 6, 7, 8, or more exons from TACC3 (e.g., from the FGFR3 and TACC3 sequences shown in FIGS. 2A-2D (SEQ ID NO:1 and 2) or FIGS. 3A-3B, 4, 5A-5B and 6 (SEQ ID NOs:3-6).

In certain embodiments, the FGFR3-TACC3 fusion comprises exon 17 or a fragment thereof from FGFR3, and exon 8 or a fragment thereof from TACC3 (e.g., as shown in FIGS. 2A-2D (SEQ ID NOs:1 and 2)). In one embodiment, the FGFR3-TACC3 fusion comprises at least 5, 10, 15, 20, 30, 40, 50 or more amino acids from exon 17 of FGFR3 (e.g., from the amino acid sequence of FGFR3 preceding the fusion junction with TACC3, e.g., the FGFR3 sequence shown in FIGS. 2A-2D (SEQ ID NO:2) or FIG. 4 (SEQ ID NO:4)), and at least 5, 10, 15, 20, 30, 40, 50 or more amino acids from exon 8 of TACC3 (e.g., from the amino acid sequence of TACC3 following the fusion junction with FGFR3, e.g., the TACC3 sequence shown in FIGS. 2A-2D (SEQ ID NO:2) or FIG. 6 (SEQ ID NO:6)). In another embodiment, the FGFR3-TACC3 fusion comprises at least 6, 12, 15, 20, 25, 50, 75, 100 or more nucleotides from exon 17 of FGFR3 (e.g., from the nucleotide sequence of FGFR3 preceding the fusion junction with TACC3, e.g., the FGFR3 sequence shown in FIGS. 2A-2D (SEQ ID NO:1) or FIGS. 3A-3B (SEQ ID NO:3)), and at least 6, 12, 15, 20, 25, 50, 75, 100 or more nucleotides from exon 8 of TACC3 (e.g., from the nucleotide sequence of TACC3 following the fusion junction with FGFR3, e.g., the TACC3 sequence shown in FIGS. 2A-2D (SEQ ID NO:1) or FIGS. 5A-5B (SEQ ID NO:5)).

In certain embodiments, the FGFR3-TACC3 fusion comprises exon 18 or a fragment thereof from FGFR3, and exon 10 or a fragment thereof from TACC3 (e.g., as shown in FIGS. 3A-3B and 5A-5B (SEQ ID NOs:3 and 5)). In one embodiment, the FGFR3-TACC3 fusion comprises at least 5, 10, 15, 20 or more amino acids from exon 18 of FGFR3 (e.g., from the amino acid sequence of FGFR3 preceding the fusion junction with TACC3, e.g., the FGFR3 sequence shown in FIG. 4 (SEQ ID NO:4)), and at least 5, 10, 15, 20 or more amino acids from exon 10 of TACC3 (e.g., from the amino acid sequence of TACC3 following the fusion junction with FGFR3, e.g., the TACC3 sequence shown in FIG. 6 (SEQ ID NO:6)). In another embodiment, the FGFR3-TACC3 fusion comprises at least 6, 12, 15, 20, 25, 50, 75, 100 or more nucleotides from exon 18 of FGFR3 (e.g., from the nucleotide sequence of FGFR3 preceding the fusion junction with TACC3, e.g., the FGFR3 sequence shown in FIGS. 3A-3B (SEQ ID NO:3)), and at least 6, 12, 15, 20, 25, 50, 75, 100 or more nucleotides from exon 10 of TACC3 (e.g., from the nucleotide sequence of TACC3 following the fusion junction with FGFR3, e.g., the TACC3 sequence shown in FIGS. 5A-5B (SEQ ID NO:5)).

FGFR3-TACC3 Nucleic Acid Molecules

In one aspect, the invention features a nucleic acid molecule (e.g., an isolated or purified) nucleic acid molecule that includes a fragment of an FGFR3 gene and a fragment of a TACC3 gene. In one embodiment, the nucleotide sequence encodes a FGFR3-TACC3 fusion polypeptide that includes an FGFR3 tyrosine kinase domain or a functional fragment thereof. In another embodiment, the nucleotide sequence encodes a fragment of the FGFR3 polypeptide of SEQ ID NO:2 or 4, or a fragment thereof; or a sequence substantially identical thereto. In other embodiments, the nucleic acid molecule includes a fragment of the TACC3 gene encoding the amino acid sequence of SEQ ID NO:2 or 6, or a fragment thereof; or a sequence substantially identical thereto. In yet other embodiments, the nucleic acid molecule includes a nucleotide sequence encoding the amino acid sequence shown in FIGS. 2A-2D (e.g., SEQ ID NO:2) or a fragment thereof, or a sequence substantially identical thereto.

In one embodiment, the nucleic acid molecule includes a fusion, e.g., an in-frame fusion, between an intron of FGFR3 (e.g., intron 17, or a fragment thereof), and an intron of TACC3 (e.g., intron 7, or a fragment thereof). The FGFR3-TACC3 fusion can comprise a fusion of the nucleotide sequence of: chromosome 4 at one or more of nucleotide 1,808,755, 1,808,702 or 1,808,880 (plus or minus 10, 20, 30, 50, 60, 70, 80, 100 nucleotides) and chromosome 4 at one or more of nucleotide 1,373,289, 1,737,469, 1,739,469 (plus or minus 10, 20, 30, 50, 60, 70, 80, 100 nucleotides), or a fragment thereof. In one embodiment, the FGFR3-TACC3 fusion comprises a fusion of the nucleotide sequence of: chromosome 4 at one or more of nucleotide 1,808,755, 1,808,702 or 1,808,880 plus or minus 10, 20, 30, 40, 50, 100, 150, 200, 250, 300, 350, 400, 450, 500, 1000, 2000, or 3000 nucleotides and chromosome 4 at one or more of nucleotide 1,373,289, 1,737,469, 1,739,469 plus or minus 10, 20, 30, 40, 50, 100, 150, 200, 250, 300, 350, 400, 450, 500, 1000, 2000, or 3000 nucleotides, or a fragment thereof.

In another embodiment, the FGFR3-TACC3 fusion comprises a nucleotide sequence shown in FIGS. 2A-2D (SEQ ID NO: 1) or FIGS. 3A-3B (SEQ ID NO:3) and FIGS. 5A-5B (SEQ ID NO:5), or a fragment thereof. In one embodiment, the FGFR3-TACC3 fusion comprises a nucleotide sequence substantially identical to the nucleotide sequence shown in FIGS. 2A-2D (SEQ ID NO: 1) or FIGS. 3A-3B (SEQ ID NO:3) and FIGS. 5A-5B (SEQ ID NO:5), or a fragment thereof. In one embodiment, the FGFR3-TACC3 fusion comprises a nucleotide sequence at least 70%, at least 75%, at least 80%, at least 85%, at least 90%, at least 95%, at least 99%, at least 99.5 or greater, identical to the nucleotide sequence shown in FIGS. 2A-2D (SEQ ID NO: 1) or FIGS. 3A-3B (SEQ ID NO:3) and FIGS. 5A-5B (SEQ ID NO:5). In one embodiment, the FGFR3-TACC3 fusion comprises a nucleotide sequence containing at least 50, 100, 150, 200, 500, 1000, 1500, 2000, 2500, 3000, or more nucleotides of the nucleotide sequence shown in FIGS. 2A-2D (SEQ ID NO: 1) or FIGS. 3A-3B (SEQ ID NO:3) and FIGS. 5A-5B (SEQ ID NO:5). In one embodiment, the FGFR3-TACC3 fusion comprises a nucleotide sequence containing at least 50, 100, 150, 200, 500, 1000, 1500, 2000, 2500, 3000, or more contiguous nucleotides of the nucleotide sequence shown in FIGS. 2A-2D (SEQ ID NO: 1) or FIGS. 3A-3B (SEQ ID NO:3) and FIGS. 5A-5B (SEQ ID NO:5).

In another embodiment, the nucleic acid molecule includes a fusion, e.g., an in-frame fusion, of at least exon 17 of FGFR3 or a fragment thereof (e.g., one or more of exons 1-17 of FGFR3 or a fragment thereof), and at least exon 8 or a fragment thereof (e.g., one or more of exons 8-16 of TACC3 or a fragment thereof). In another embodiment, the nucleic acid molecule includes a fusion, e.g., an in-frame fusion, of at least exon 18 of FGFR3 or a fragment thereof (e.g., one or more of exons 1-18 of FGFR3 or a fragment thereof), and at least exon 10 or a fragment thereof (e.g., exons 10-16 of TACC3 or a fragment thereof). In one embodiment, the nucleic acid molecule includes the nucleotides sequence corresponding to exons 1-17 and 1-18, respectively, of a FGFR3 gene, (SEQ ID NO:1 or 3) or a fragment thereof, or a sequence substantially identical thereto. In another embodiment, the nucleic acid molecule includes the nucleotide sequence corresponding to exons 8-16 and 10-16, respectively, of TACC3 (SEQ ID NO:1 or 5) or a fragment thereof, or a sequence substantially identical thereto. In yet other embodiments, the nucleic acid molecule includes the nucleotide sequence shown in FIGS. 2A-2D (e.g., SEQ ID NO:1) or FIGS. 3A-3B (e.g., SEQ ID NO:3) and FIGS. 5A-5B (e.g., SEQ ID NO:5), or a fragment thereof, or a sequence substantially identical thereto.

In one embodiment, the nucleic acid molecule is complementary to at least a portion of a nucleotide sequence disclosed herein, e.g., is capable of hybridizing under a stringency condition described herein to SEQ ID NO:1 or SEQ ID NO:3 and/or SEQ ID NO:5, or a fragment thereof. In yet another embodiment, the nucleic acid molecule hybridizes to a nucleotide sequence that is complementary to at least a portion of a nucleotide sequence disclosed herein, e.g., is capable of hybridizing under a stringency condition to a nucleotide sequence complementary to SEQ ID NO:1 or SEQ ID NO:3 and/or SEQ ID NO:5, or a fragment thereof. The nucleotide sequence of a cDNA encoding an exemplary 5' FGFR3-3' TACC3 fusion is shown in SEQ ID NO:1 or a fragment of SEQ ID NO:3 and SEQ ID NO:5, and the predicted amino acid sequence is shown in SEQ ID NO:2 and a fragment of SEQ ID NO:4 and SEQ ID NO:6, respectively.

In an embodiment, the FGFR3-TACC3 nucleic acid molecule comprises sufficient FGFR3 and sufficient TACC3 sequence such that the encoded 5' FGFR3-3' TACC3 fusion has kinase activity, e.g., has elevated activity, e.g., FGFR3 kinase activity, as compared with wild type FGFR3, e.g., in a cell of a cancer referred to herein. In certain embodiments, the 5' FGFR3-3' TACC3 fusion comprises exons 1-17 for 1-18 from FGFR3 and exon 8-16 or 10-16 from TACC3. In certain embodiments, the FGFR3-TACC3 fusion comprises at least 1, 2, 3, 4, 5, 6, 7, 9, 10, 11, 12, 13, 14, 15, 16, 17, 18 or more exons from FGFR3 and at least 1, 2, 3, 4, 5, 6, 7, 9, 10, or more exons from TACC3. In certain embodiments, the FGFR3-TACC3 fusion comprises a fusion of exon 17 or exon 18 from FGFR3 and exon 8 or exon 10 from TACC3. In another embodiment, the FGFR3-TACC3 fusion comprises at least 1, 2, 3, 4, 5, 6, 7, 9, 10, 11, 12, 13, 14, 15, 16, 17, 18 exons from FGFR3; and at least 1, 2, 3, 4, 5, 6, 7, 9, 10 exons from TACC3 (e.g., the corresponding exons from SEQ ID NO:3 and SEQ ID NO:5).

In one embodiment, the nucleic acid molecule includes a nucleotide sequence that has an in-frame fusion of intron 17 or 18 of FGFR3 (e.g., NM_000142) with intron 7 or 9 of TACC3 (e.g., NM_006342). In another embodiment, the nucleic acid molecule includes a nucleotide sequence that includes a breakpoint. For example, the nucleic acid molecule includes a nucleotide sequence that includes the fusion junction between the FGFR3 gene and the TACC3 gene, e.g., the breakpoint between intron 17 or 18 of FGFR3 and intron 7 or 9 of TACC3. In other embodiments, the nucleic acid molecules includes a nucleotide sequence of one or more of nucleotide 1,808,755, 1,808,702 or 1,808,880 of chromosome 4 coupled to (e.g., directly or indirectly juxtaposed to) one or more of nucleotide 1,373,289, 1,737,469, 1,739,469 of chromosome 4. In one embodiment, the nucleic acid molecule includes the nucleotide sequence of: chromosome 4 at one or more of nucleotide 1,808,755, 1,808,702 or 1,808,880 plus or minus 10, 20, 30, 40 50, 60, 80, 100, 150 nucleotides and chromosome 4 at one or more of nucleotide 1,373,289, 1,737,469, 1,739,469 plus or minus 10, 20, 30, 40 50, 60, 80, 100, 150 nucleotides (corresponding to the breakpoint of a FGFR3-TACC3 fusion), or a fragment thereof, or a sequence substantially identical thereto. In one embodiment, the nucleic acid molecule is complementary to at least a portion of a nucleotide sequence disclosed herein, e.g., is capable of hybridizing under a stringency condition described herein to SEQ ID NO:1 or 3, and 5, or a fragment thereof. In yet other embodiment, the nucleic acid molecule hybridizes to a nucleotide sequence that is complementary to at least a portion of a nucleotide sequence disclosed herein, e.g., is capable of hybridizing under a stringency condition described herein to a nucleotide sequence complementary to SEQ ID NO:1 or 3, and 5, or a fragment thereof.

In another embodiment, the FGFR3-TACC3 fusion nucleic acid comprises at least 6, 12, 15, 20, 25, 50, 75, 100 or more nucleotides from exon 17 of FGFR3 (e.g., from the nucleotide sequence of FGFR3 preceding the fusion junction with TACC3, e.g., the FGFR3 sequence shown in FIGS. 2A-2D (SEQ ID NO:1) or FIGS. 3A-3B (SEQ ID NO:3)), and at least 6, 12, 15, 20, 25, 50, 75, 100 or more nucleotides from exon 8 of TACC3 (e.g., from the nucleotide sequence of TACC3 following the fusion junction with FGFR3, e.g., the TACC3 sequence shown in FIGS. 2A-2D (SEQ ID NO:1) or FIGS. 5A-5B (SEQ ID NO:5)).

In another embodiment, the FGFR3-TACC3 fusion nucleic acid comprises at least 6, 12, 15, 20, 25, 50 or more nucleotides from exon 18 of FGFR3 (e.g., from the nucleotide sequence of FGFR3 preceding the fusion junction with TACC3, e.g., the FGFR3 sequence shown in FIGS. 3A-3B (SEQ ID NO:3)), and at least 6, 12, 15, 20, 25, 50, 75, 100 or more nucleotides from exon 10 of TACC3 (e.g., from the nucleotide sequence of TACC3 following the fusion junction with FGFR3, e.g., the TACC3 sequence shown in FIGS. 5A-5B (SEQ ID NO:5))).

In other embodiments, the nucleic acid molecule includes a nucleotide sequence encoding a FGFR3-TACC3 fusion polypeptide that includes a fragment of a FGFR3 gene and a fragment of a TACC3 gene. In one embodiment, the nucleotide sequence encodes a FGFR3-TACC3 fusion polypeptide that includes e.g., an FGFR3 tyrosine kinase domain or a functional fragment thereof. In another embodiment, the nucleotide sequence encodes a fragment of the FGFR3 polypeptide of SEQ ID NO:2 or 4 or a fragment thereof, or a sequence substantially identical thereto. For example, the nucleic acid molecule can include a nucleotide sequence encoding an FGFR3 kinase domain of SEQ ID NO:2 or SEQ ID NO:4 or a fragment thereof. In yet other embodiments, the nucleic acid molecule includes a nucleotide sequence encoding the amino acid sequence shown in FIGS. 2A-2D (e.g., SEQ ID NO:2) or FIGS. 4 and 6 (e.g., SEQ ID NOs:4 and 6), or a fragment thereof, or a sequence substantially identical thereto. In one embodiment, the encoded FGFR3-TACC3 fusion polypeptide includes an FGFR3 tyrosine kinase domain or a functional fragment thereof.

In a related aspect, the invention features nucleic acid constructs that include the FGFR3-TACC3 nucleic acid molecules described herein. In certain embodiments, the nucleic acid molecules are operatively linked to a native or a heterologous regulatory sequence. Also included are vectors and host cells that include the FGFR3-TACC3 nucleic acid molecules described herein, e.g., vectors and host cells suitable for producing the nucleic acid molecules and polypeptides described herein.

In a related aspect, methods of producing the nucleic acid molecules and polypeptides described herein are also described.

In another aspect, the invention features nucleic acid molecules that reduce or inhibit the expression of a nucleic acid molecule that encodes a FGFR3-TACC3 fusion described herein. Examples of such nucleic acid molecules include, for example, antisense molecules, ribozymes, RNAi, triple helix molecules that hybridize to a nucleic acid encoding FGFR3-TACC3, or a transcription regulatory region of FGFR3-TACC3, and blocks or reduces mRNA expression of FGFR3-TACC3.

Nucleic Acid Detection and Capturing Reagents

The invention also features a nucleic acid molecule, e.g., nucleic acid fragment, suitable as probe, primer, bait or library member that includes, flanks, hybridizes to, which are useful for identifying, or are otherwise based on, the FGFR3-TACC3 fusions described herein. In certain embodiments, the probe, primer or bait molecule is an oligonucleotide that allows capture, detection or isolation of a FGFR3-TACC3 fusion nucleic acid molecule described herein. The oligonucleotide can comprise a nucleotide sequence substantially complementary to a fragment of the FGFR3-TACC3 fusion nucleic acid molecules described herein. The sequence identity between the nucleic acid fragment, e.g., the oligonucleotide, and the target FGFR3-TACC3 sequence need not be exact, so long as the sequences are sufficiently complementary to allow the capture, detection or isolation of the target sequence. In one embodiment, the nucleic acid fragment is a probe or primer that includes an oligonucleotide between about 5 and 25, e.g., between 10 and 20, or 10 and 15 nucleotides in length. In other embodiments, the nucleic acid fragment is a bait that includes an oligonucleotide between about 100 to 300 nucleotides, 130 and 230 nucleotides, or 150 and 200 nucleotides, in length.

In one embodiment, the nucleic acid fragment can be used to identify or capture, e.g., by hybridization, a FGFR3-TACC3 fusion. For example, the nucleic acid fragment can be a probe, a primer, or a bait, for use in identifying or capturing, e.g., by hybridization, a FGFR3-TACC3 fusion described herein. In one embodiment, the nucleic acid fragment can be useful for identifying or capturing a FGFR3-TACC3 breakpoint, e.g., the nucleotide sequence of: chromosome 4 at nucleotide 1,808,755 plus or minus 10, 20, 30, 40 50, 60, 80, 100, 150 nucleotides and chromosome 4 at nucleotide 1,373,289 plus or minus 10, 20, 30, 40 50, 60, 80, 100, 150 nucleotides.

In one embodiment, the nucleic acid fragment hybridizes to a nucleotide sequence within a chromosomal rearrangement that creates an in-frame fusion of intron 17 of FGFR3 with intron 7 of TACC3. In one embodiment, the nucleic acid fragment hybridizes to a nucleotide sequence in the region In other embodiments, the nucleic acid molecules includes a nucleotide sequence in the region of nucleotides 1,808,755 of chromosome 4 coupled to (e.g., juxtaposed to) nucleotides in the region of nucleotides 74,591,512 of chromosome 4. In other embodiments, the nucleic acid molecules includes a nucleotide sequence in the region of nucleotides 1,808,805-1,808,705 of chromosome 4 coupled to (e.g., juxtaposed to) nucleotides in the region of nucleotides 1,737,339-1,737,239 of chromosome 4. In one embodiment, the nucleic acid fragment hybridizes to a nucleotide sequence that includes a breakpoint, e.g., the nucleotide sequence of: chromosome 4 at nucleotide 1,808,755 plus or minus 10, 20, 30, 40 50, 60, 80, 100, 150 or more nucleotides and chromosome 4 at nucleotide 1,373,289 plus or minus 10, 20, 30, 40 50, 60, 80, 100, 150 or more nucleotides. For example, the nucleic acid fragment can hybridize to a nucleotide sequence that includes the fusion junction between the FGFR3 gene and the TACC3 gene, e.g., a nucleotide sequence that includes a portion of a nucleotide sequence within introns 17 of a FGFR3 gene and 7 of a TACC3 gene.

In another embodiment, the nucleic acid fragment hybridizes to a nucleotide sequence that comprises at least 6, 12, 15, 20, 25, 50, 75, 100, 150 or more nucleotides from exon 17 of FGFR3 (e.g., from the nucleotide sequence of FGFR3 preceding the fusion junction with TACC3, e.g., the FGFR3 sequence shown in FIGS. 2A-2D (SEQ ID NO:1) or FIG. 3 (SEQ ID NO:3), and at least 6, 12, 15, 20, 25, 50, 75, 100, 150 or more nucleotides from exon 8 of TACC3 (e.g., from the nucleotide sequence of TACC3 following the fusion junction with FGFR3, e.g., the TACC3 sequence shown in FIGS. 2A-2D (SEQ ID NO:1) or FIG. 5 (SEQ ID NO:5)).

In another embodiment, the nucleic acid fragment hybridizes to a nucleotide sequence that comprises at least 6, 12, 15, 20, 25, 50, 75, 100, 150 or more nucleotides from exon 18 of FGFR3 (e.g., from the nucleotide sequence of FGFR3 preceding the fusion junction with TACC3, e.g., the FGFR3 sequence shown in FIGS. 3A-3B (SEQ ID NO:3)), and at least 6, 12, 15, 20, 25, 50, 75, 100, 150 or more nucleotides from exon 10 of TACC3 (e.g., from the nucleotide sequence of TACC3 following the fusion junction with FGFR3, e.g., the TACC3 sequence shown in FIGS. 5A-5B (SEQ ID NO:5)).

The probes or primers described herein can be used, for example, for FISH detection or PCR amplification. In one exemplary embodiment where detection is based on PCR, amplification of the FGFR3-TACC3 fusion junction fusion junction can be performed using a primer or a primer pair, e.g., for amplifying a sequence flanking the fusion junctions described herein, e.g., the mutations or the junction of a chromosomal rearrangement described herein, e.g., FGFR3-TACC3.

In one embodiment, a pair of isolated oligonucleotide primers can amplify a region containing or adjacent to a position in the TACC3-FGFR3 fusion. For example, forward primers can be designed to hybridize to a nucleotide sequence within FGFR3 genomic or mRNA sequence (e.g., a nucleotide sequence within exon 17 or 18 of FGFR3 of SEQ ID NO:1 or 3), and the reverse primers can be designed to hybridize to a nucleotide sequence of TACC3 (e.g., a nucleotide sequence within exon 8 or 10 of TACC3, of SEQ ID NO:1 or 5).

In another embodiment, the nucleic acid fragments can be used to identify, e.g., by hybridization, a FGFR3-TACC3 fusion. In one embodiment, the nucleic acid fragment hybridizes to a nucleotide sequence that includes a fusion junction between the FGFR3 transcript and the TACC3 transcript.

In other embodiments, the nucleic acid fragment includes a bait that comprises a nucleotide sequence that hybridizes to a FGFR3-TACC3 fusion nucleic acid molecule described herein, and thereby allows the capture or isolation said nucleic acid molecule. In one embodiment, a bait is suitable for solution phase hybridization. In other embodiments, a bait includes a binding entity, e.g., an affinity tag, that allows capture and separation, e.g., by binding to a binding entity, of a hybrid formed by a bait and a nucleic acid hybridized to the bait.

In other embodiments, the nucleic acid fragment includes a library member comprising a FGFR3-TACC3 nucleic acid molecule described herein. In one embodiment, the library member includes a rearrangement that results in a FGFR3-TACC3 fusion described herein.

The nucleic acid fragment can be detectably labeled with, e.g., a radiolabel, a fluorescent label, a bioluminescent label, a chemiluminescent label, an enzyme label, a binding pair label, or can include an affinity tag; a tag, or identifier (e.g., an adaptor, barcode or other sequence identifier).

FGFR3-TACC3 Fusion Polypeptides

In another embodiment, the FGFR3-TACC3 fusion comprises an amino acid sequence shown in FIGS. 2A-2D (SEQ ID NO:2) or FIG. 4 (SEQ ID NO:4) and FIG. 6 (SEQ ID NO:6), or a fragment thereof. In one embodiment, the FGFR3-TACC3 fusion comprises an amino acid sequence substantially identical to the amino acid sequence shown in FIGS. 2A-2D (SEQ ID NO:2) or FIG. 4 (SEQ ID NO:4) and FIG. 6 (SEQ ID NO:6), or a fragment thereof. In one embodiment, the FGFR3-TACC3 fusion comprises an amino acid sequence at least 70%, at least 75%, at least 80%, at least 85%, at least 90%, at least 95%, at least 99%, at least 99.5 or greater, identical to the amino acid sequence shown in FIGS. 2A-2D (SEQ ID NO:2) or FIG. 4 (SEQ ID NO:4) and FIG. 6 (SEQ ID NO:6)). In one embodiment, the FGFR3-TACC3 fusion comprises a sequence containing at least 10, 20, 50, 100, 500, 600, 700, 800, 900, 1000, or more amino acids of the amino acid sequence shown in FIGS. 2A-2D (SEQ ID NO:2); or at least 5, 10, 20, 50, 100, 500, 600, 700, 800, 900, 1000, or more amino acids of the amino acid sequence shown in FIG. 4 (SEQ ID NO:4) and at least 5, 10, 20, 50, 100, 500, 600, 700, 800, 900, 1000, or more amino acids of the amino acid sequence shown in FIG. 6 (SEQ ID NO:6). In one embodiment, the FGFR3-TACC3 fusion comprises an amino acid sequence containing at least 10, 20, 50, 100, 500, 600, 700, 800, 900, 1000, or more contiguous amino acids of the amino acid sequence shown in FIGS. 2A-2D (SEQ ID NO:2); or at least 5, 10, 20, 50, 100, 500, 600, 700, 800, 900, 1000, or more contiguous amino acids of the amino acid sequence shown in FIG. 4 (SEQ ID NO:4) and at least 5, 10, 20, 50, 100, 500, 600, 700, 800, 900, 1000, or more contiguous amino acids of the amino acid sequence shown in FIG. 6 (SEQ ID NO:6). In one embodiment, the 5' FGFR3-3' TACC3 fusion polypeptide includes a FGFR3 receptor tyrosine kinase domain or a functional fragment thereof. In an embodiment, the 5'FGFR3-3'TACC3 fusion polypeptide comprises sufficient TACC3 and sufficient FGFR3 sequence such that it has kinase activity, e.g., has elevated activity, e.g., FGFR3 kinase activity, as compared with wild type FGFR3, e.g., in a cell of a cancer referred to herein.

In another aspect, the invention features a FGFR3-TACC3 fusion polypeptide (e.g., a purified FGFR3-TACC3 fusion polypeptide), a biologically active or antigenic fragment thereof, as well as reagents (e.g., antibody molecules that bind to a FGFR3-TACC3 fusion polypeptide), methods for modulating a FGFR3-TACC3 polypeptide activity and detection of a FGFR3-TACC3 polypeptide.

In one embodiment, the FGFR3-TACC3 fusion polypeptide has at least one biological activity, e.g., an FGFR3 kinase activity. In one embodiment, at least one biological activity of the FGFR3-TACC3 fusion polypeptide is reduced or inhibited by an anti-cancer drug, e.g., a kinase inhibitor (e.g., a multikinase inhibitor or an FGFR3-specific inhibitor). In one embodiment, at least one biological activity of the FGFR3-TACC3 fusion polypeptide is reduced or inhibited by an FGFR3 kinase inhibitor chosen from e.g., TAE-684 (also referred to herein as "NVP-TAE694"), PF02341066 (also referred to herein as "crizotinib" or "1066"), AF-802, LDK-378, ASP-3026, CEP-37440, CEP-28122, CEP-18050 and AP26113.

In yet other embodiments, the FGFR3-TACC3 fusion polypeptide is encoded by a nucleic acid molecule described herein. In one embodiment, the FGFR3-TACC3 fusion polypeptide is encoded by an in-frame fusion of intron 17 of FGFR3 with intron 7 of TACC3 (e.g., a sequence on chromosome 4). In another embodiment, the FGFR3-TACC3 fusion polypeptide includes an amino acid sequence encoded by a nucleotide sequence comprising a fusion junction between the FGFR3 transcript and the TACC3 transcript.

In certain embodiments, the FGFR3-TACC3 fusion polypeptide comprises one or more of encoded exons 1-17 or encoded exons 1-18 from FGFR3 and one or more of encoded exon 8-16 or 10-16 from TACC3. In certain embodiments, the FGFR3-TACC3 fusion polypeptide comprises at least 1, 2, 3, 4, 5, 6, 7, 9, 10, 11, 12, 13, 14, 15, 16, 17, 18 or more encoded exons from FGFR3 and at least 1, 2, 3, 4, 5, 6, 7, 9, 10, or more, encoded exons from TACC3. In certain embodiments, the FGFR3-TACC3 fusion polypeptide comprises a fusion of encoded exon 17 from FGFR3 and encoded exon 8 from TACC3 (or a fragment thereof). In other embodiments, the fusion comprises least 1, 2, 3, 4, 5, 6, 7, 9, 10, 11, 12, 13, 14, 15, 16, 17, 18 encoded exons from FGFR3; and at least 1, 2, 3, 4, 5, 6, 7, 9, 10 encoded exons from TACC3. In certain embodiments, the FGFR3-TACC3 fusion polypeptide comprises encoded exons 1-17 or 1-18 from FGFR3 and exon 8-16 or 10-16 from TACC3. In certain embodiments, the 5' FGFR3-3' TACC3 fusion polypeptide comprises a fusion junction of the sequence of exon 17 or 18 from FGFR3 and the sequence of exon 8 or 10 from TACC3 (e.g., as shown in SEQ ID NOs:2, 4 and 6).

In certain embodiments, the FGFR3-TACC3 fusion comprises the amino acid sequence corresponding to exon 17 or a fragment thereof from FGFR3, and the amino acid sequence corresponding to exon 8 or a fragment thereof from TACC3 (e.g., as shown in FIGS. 2A-2D (SEQ ID NO:2) or FIGS. 4 and 6 (SEQ ID NO:4 and 6, respectively)). In one embodiment, the FGFR3-TACC3 fusion comprises at least 5, 10, 15, 20 or more amino acids from exon 17 of FGFR3 (e.g., from the amino acid sequence of FGFR3 preceding the fusion junction with TACC3, e.g., the FGFR3 sequence shown in FIGS. 2A-2D (SEQ ID NO:2) or FIG. 4 (SEQ ID NO:4), and at least 5, 10, 15, 20 or more amino acids from exon 8 of TACC3 (e.g., from the amino acid sequence of TACC3 following the fusion junction with FGFR3, e.g., the TACC3 sequence shown in FIGS. 2A-2D (SEQ ID NO:2) or FIG. 6 (SEQ ID NO:6)).

In certain embodiments, the FGFR3-TACC3 fusion comprises the amino acid sequence corresponding to exon 18 or a fragment thereof from FGFR3, and the amino acid sequence corresponding to exon 10 or a fragment thereof from TACC3 (e.g., as shown in FIGS. 4 and 6 (SEQ ID NOs:4 and 6, respectively)). In one embodiment, the FGFR3-TACC3 fusion comprises at least 5, 10, 15, 20 or more amino acids from exon 18 of FGFR3 (e.g., from the amino acid sequence of FGFR3 preceding the fusion junction with TACC3, e.g., the FGFR3 sequence shown in FIG. 4 (SEQ ID NO:4)), and at least 5, 10, 15, 20 or more amino acids from exon 10 of TACC3 (e.g., from the amino acid sequence of TACC3 following the fusion junction with FGFR3, e.g., the TACC3 sequence shown in FIG. 6 (SEQ ID NO:6)).

In one embodiment, the FGFR3-TACC3 fusion polypeptide includes a FGFR3 tyrosine kinase domain or a functional fragment thereof. In a related aspect, the invention features FGFR3-TACC3 fusion polypeptide or fragments operatively linked to heterologous polypeptides to form fusion proteins.

In another embodiment, the FGFR3-TACC3 fusion polypeptide or fragment is a peptide, e.g., an immunogenic peptide or protein, that contains a fusion junction described herein. Such immunogenic peptides or proteins can be used to raise antibodies specific to the fusion protein. In other embodiments, such immunogenic peptides or proteins can be used for vaccine preparation. The vaccine preparation can include other components, e.g., an adjuvant.

In another aspect, the invention features antibody molecules that bind to a FGFR3-TACC3 fusion polypeptide or fragment described herein. In embodiments the antibody can distinguish wild type TACC3 (or FGFR3) from FGFR3-TACC3.

Detection Reagents and Detection of Mutations

In another aspect, the invention features a detection reagent, e.g., a purified or an isolated preparation thereof. Detection reagents can distinguish a nucleic acid, or protein sequence, having a breakpoint, e.g., a FGFR3-TACC3 breakpoint; from a reference sequence. In one embodiment, the detection reagent detects (e.g., specifically detects) a FGFR3-TACC3 fusion nucleic acid or a polypeptide (e.g., distinguishes a wild type TACC3 or another TACC3 fusion (or FGFR3) from a FGFR3-TACC3 nucleic acid (e.g., as described herein in FIGS. 2A-2D (SEQ ID NO:1) or FIGS. 3A-3B (SEQ ID NO:3) and FIGS. 5A-5B (SEQ ID NO:5); or a FGFR3-TACC3 polypeptide (e.g., as described herein in FIGS. 2A-2D (SEQ ID NO:2) or FIGS. 4 and 6 (SEQ ID NO:4 and 6, respectively). Detection reagents, e.g., nucleic acid-based detection reagents, can be used to identify mutations in a target nucleic acid, e.g., DNA, e.g., genomic DNA or cDNA, or RNA, e.g., in a sample, e.g., a sample of nucleic acid derived from a neoplastic or tumor cell, e.g., a melanocytic neoplasm, melanoma or metastatic cell. Detection reagents, e.g., antibody-based detection reagents, can be used to identify mutations in a target protein, e.g., in a sample, e.g., a sample of protein derived from, or produced by, a neoplastic or tumor cell, e.g., a melanocytic neoplasm, melanoma or metastatic cell.

Method of Treatment

FGFR3 encodes a tyrosine kinase cell surface receptor, and member of the fibroblast growth factor receptor family. The FGFR family plays an important role in cell differentiation, growth and angiogenesis (reviewed in Powers C J, McLeskey S W, Wellstein A (2000) Fibroblast growth factors, their receptors and signaling. Endocr Relat Cancer 7(3):165-97), and gain of function mutations in FGFRs have been reported in several cancer types (reviewed in Eswarakumar V P, Lax I, Schlessinger J (2005) Cellular signaling by fibroblast growth factor receptors. Cytokine Growth Factor Rev 16(2):139-49). There are few reports of FGFR3 mutations in endometrial carcinoma (COSMIC, PubMed, October 2012). The rearrangement in this tumor is expected to result in an in-frame fusion between exons 1-17 of FGFR3 (containing the kinase domain) and exons 10 to the C-terminus of TACC3 (containing the coiled coil TACC domain). Similar fusions between FGFR3 and TACC3 have recently been reported in a small percentage of glioblastomas. These fusions were shown preclinically to transform rat fibroblasts and to induce tumors in mice, and their oncogenic activity was dependent on both the FGFR3 kinase and TACC3 coiled coil domains (Singh D, Chan J M, Zoppoli P, et al. (2012) Transforming fusions of FGFR and TACC genes in human glioblastoma. Science 337(6099):1231-5). This fusion protein is therefore likely to be oncogenic. In this preclinical study, the FGFR3-TACC3 fusion protein was reported to induce aneuploidy, and treatment with an Fgfr inhibitor prevented aneuploidy and led to increased survival in mice with FGFR3-TACC3 tumors (Singh D, Chan J M, Zoppoli P, et al. (2012) Transforming fusions of FGFR and TACC genes in human glioblastoma. Science 337(6099):1231). Therefore, tumors with this FGFR3-TACC3 fusion may be sensitive to FGFR family inhibitors, and clinical trials of these agents, including pazopanib (FDA-approved for use in renal cell carcinoma and soft tissue sarcoma), are currently underway in solid tumors. In addition, the multikinase inhibitor sunitinib that also targets FLT3 has activity against multiple myeloma cells expressing activated FGFR.

FGFR3 rearrangements have not been reported in cervical cancer, although they are present in a subset of multiple myeloma cases, where they are associated with poor prognosis (Richelda R, Ronchetti D, Baldini L, et al. (1997) A novel chromosomal translocation t(4; 14)(p16.3;q32) in multiple myeloma involves the fibroblast growth-factor receptor 3 gene. Blood 90(10):4062-70, Avet-Loiseau H, Li J Y, Facon T, et al. (1998) High incidence of translocations t(11;14)(q13;q32) and t(4;14)(p16;q32) in patients with plasma cell malignancies. Cancer Res 58(24):5640-5, Keats J J, Reiman T, Maxwell C A, et al. (2003) In multiple myeloma, t(4;14)(p16;q32) is an adverse prognostic factor irrespective of FGFR3 expression. Blood 101(4):1520-9). The t(4:14) translocation in multiple myeloma has been associated with Fgfr3 protein expression in approximately 75% of cases that bear the translocation (Santra M, Zhan F, Tian E, et al. (2003) A subset of multiple myeloma harboring the t(4;14)(p16;q32) translocation lacks FGFR3 expression but maintains an IGH/MMSET fusion transcript. Blood 101(6):2374-6, Keats J J, Reiman T, Maxwell C A, et al. (2003) In multiple myeloma, t(4;14)(p16;q32) is an adverse prognostic factor irrespective of FGFR3 expression. Blood 101(4):1520-9), and the TACC3 gene, the putative fusion partner seen in this tumor, has been implicated as another potential contributing oncogenic factor in these translocations (Stewart et al., 2004; 15198734). The FGFR3-TACC3 fusion gene identified here is also increased in copy number. There are no reports of amplification of the intact FGFR3 gene in cervical cancer (The cBio Cancer Genomics Portal, http://www.cbioportal.org/, June 2012, PubMed, June 2012). It is possible that either FGFR3 or TACC3 or both could contribute to oncogenic activity in this tumor. Tumors with Fgfr3 activation may be sensitive to FGFR family inhibitors. The multi-tyrosine kinase inhibitor pazopanib, which inhibits Fgfr family kinases including Fgfr3, has been approved for use in renal cell carcinoma, and is the subject of clinical trials in cervical cancer.

FGFR3 rearrangements have not been reported in lung cancer, although they are present in a subset of multiple myeloma cases, where they are associated with poor prognosis (Richelda R, Ronchetti D, Baldini L, et al. (1997) A novel chromosomal translocation t(4; 14)(p16.3;q32) in multiple myeloma involves the fibroblast growth-factor receptor 3 gene. Blood 90(10):4062-70, Avet-Loiseau H, Li J Y, Facon T, et al. (1998) High incidence of translocations t(11;14)(q13;q32) and t(4;14)(p16;q32) in patients with plasma cell malignancies. Cancer Res 58(24):5640-5, Keats J J, Reiman T, Maxwell C A, et al. (2003) In multiple myeloma, t(4;14)(p16;q32) is an adverse prognostic factor irrespective of FGFR3 expression. Blood 101(4):1520-9). The t(4:14) translocation in melanoma has been associated with Fgfr3 protein expression in approximately 75% of cases that bear the translocation (Santra M, Zhan F, Tian E, et al. (2003) A subset of multiple myeloma harboring the t(4;14)(p16;q32) translocation lacks FGFR3 expression but maintains an IGH/MMSET fusion transcript. Blood 101(6): 2374-6, Keats J J, Reiman T, Maxwell C A, et al. (2003) In multiple myeloma, t(4;14)(p16;q32) is an adverse prognostic factor irrespective of FGFR3 expression. Blood 101(4): 1520-9), and the TACC3 gene, the putative fusion partner seen in this tumor, has been implicated as another potential contributing oncogenic factor in these translocations (Stewart J P, Thompson A, Santra M, et al. (2004) Correlation of TACC3, FGFR3, MMSET and p21 expression with the t(4;14)(p16.3;q32) in multiple myeloma. Br J Haematol 126(1):72-6). It is possible that either FGFR3 or TACC3 could be responsible for oncogenic activity in this tumor. Tumors with FGFR3 activation may be sensitive to FGFR family inhibitors, and clinical trials of these agents are currently underway in solid tumors, including lung cancer.

Rearrangements involving FGFR3, located on chromosome 4, have been reported in multiple myeloma, primarily involving the IGH locus on chromosome 14 (Richelda R, Ronchetti D, Baldini L, et al. (1997) A novel chromosomal translocation t(4; 14)(p16.3;q32) in multiple myeloma involves the fibroblast growth-factor receptor 3 gene. Blood 90(10):4062-70, Avet-Loiseau H, Li J Y, Facon T, et al. (1998) High incidence of translocations t(11;14)(q13;q32) and t(4;14)(p16;q32) in patients with plasma cell malignancies. Cancer Res 58(24):5640-5). These 4;14 translocations have been associated with increased expression of Fgfr3 protein (Richelda R, Ronchetti D, Baldini L, et al. (1997) A novel chromosomal translocation t(4; 14)(p16.3;q32) in multiple myeloma involves the fibroblast growth-factor receptor 3 gene. Blood 90(10):4062-70) and poor prognosis (Keats J J, Reiman T, Maxwell C A, et al. (2003) In multiple myeloma, t(4;14)(p16;q32) is an adverse prognostic factor irrespective of FGFR3 expression. Blood 101(4):1520-9). However, a few studies demonstrated that Fgfr3 is overexpressed in only 75% of cases with 4;14 translocations, although the prognosis for cases bearing these translocations is still poor (Santra M, Zhan F, Tian E, et al. (2003) A subset of multiple myeloma harboring the t(4;14)(p16;q32) translocation lacks FGFR3 expression but maintains an IGH/MMSET fusion transcript. Blood 101(6):2374-6, Keats J J, Reiman T, Maxwell C A, et al. (2003) In multiple myeloma, t(4;14)(p16;q32) is an adverse prognostic factor irrespective of FGFR3 expression. Blood 101(4):1520-9). A recent study suggests that the protein TACC3 (Transforming Acidic Coiled Coil-Containing protein 3), located near the breakpoint region on chromosome 4, may be implicated (Stewart J P, Thompson A, Santra M, et al. (2004) Correlation of TACC3, FGFR3, MMSET and p21 expression with the t(4;14)(p16.3;q32) in multiple myeloma. Br J Haematol 126(1):72-6). TACC3 is located telomeric to FGFR3 and has been found to be upregulated in some types of cancer; studies have shown that it is involved in cell growth and differentiation. In multiple myelomas containing the 4:14 translocation, TACC3 expression has been shown to be increased (Stewart J P, Thompson A, Santra M, et al. (2004) Correlation of TACC3, FGFR3, MMSET and p21 expression with the t(4;14)(p16.3;q32) in multiple myeloma. Br J Haematol 126(1):72-6).

The rearrangement seen in lung adenocarcinoma, containing an in-frame fusion of FGFR3 and TACC3, has not been previously reported. Based on previous studies, it is possible that either FGFR3 or TACC3 could be responsible for oncogenic activity in this tumor. FGFR3 rearrangement has not been reported in lung cancer (PubMed, June 2012), and FGFR3 mutation is rare in lung cancer, reported in 2/575 lung cancers analyzed in COSMIC (Catalog Of Somatic Mutations In Cancer, a database of known somatic mutations in human cancers, June 2012). Amplification of FGFR3 in lung cancer is also rare, reported in 1/172 cases in the Cancer Genome Atlas project (The cBio Cancer Genomics Portal, http://www.cbioportal.org/, June 2012). A recent study suggests that FGFR2 and FGFR3 expression may be induced in some lung cancers by treatment with Egfr TKIs, leading to TKI resistance in those cancers (Ware K E, Marshall M E, Heasley L R, et al. (2010) Rapidly acquired resistance to EGFR tyrosine kinase inhibitors in NSCLC cell lines through de-repression of FGFR2 and FGFR3 expression. PLoS ONE 5(11):e14117).

Multiple small molecule FGFR inhibitors are under clinical investigation and in clinical trials (Turner N, Grose R (2010) Fibroblast growth factor signalling: from development to cancer. Nat Rev Cancer 10(2):116-29). A Phase 1 trial is testing the efficacy of the FGFR inhibitor BGJ398 in solid tumors with FGFR alterations, including FGFR3 mutation. The dual VEGFR/FGFR inhibitor brivanib (PKC412/BMS-582664) is in Phase 2 trials for solid tumors, including NSCLC (Chen J, Lee B H, Williams I R, et al. (2005) FGFR3 as a therapeutic target of the small molecule inhibitor PKC412 in hematopoietic malignancies. Oncogene 24(56):8259-67, Socinski M A (2011) Multitargeted receptor tyrosine kinase inhibition: an antiangiogenic strategy in non-small cell lung cancer. Cancer Treat Rev 37(8):611-7). In a Phase 2 trial of the pan-kinase (VEGFR/PDGFR/FGFR) inhibitor BIBF 1120 in NSCLC patients, one patient had a partial response, and about half of all patients achieved stable disease (Reck M, Kaiser R, Eschbach C, et al. (2011) A phase II double-blind study to investigate efficacy and safety of two doses of the triple angiokinase inhibitor BIBF 1120 in patients with relapsed advanced non-small-cell lung cancer. Ann Oncol 22(6):1374-81). Phase 3 trials have been initiated to study BIBF 1120 in combination with docetaxel or pemetrexed, in second-line therapy for NSCLC patients (Socinski M A (2011) Multitargeted receptor tyrosine kinase inhibition: an antiangiogenic strategy in non-small cell lung cancer. Cancer Treat Rev 37(8):611-7). In a Phase 2 trial of pazopanib, another pan-kinase (VEGFR/PDGFR/FGFR) inhibitor, in early stage NSCLC patients, 86% (30/35) experienced a reduction in tumor volume, and 3 patients achieved partial response (Altorki N, Lane M E, Bauer T, et al. (2010) Phase II proof-of-concept study of pazopanib monotherapy in treatment-naive patients with stage I/II resectable non-small-cell lung cancer. J Clin Oncol 28(19):3131-7).

Additional FGFR inhibitors are under preclinical investigation. Of note, the multi-kinase inhibitor ponatinib (AP24534), under investigation in chronic myelogenous leukemia based on its ability to inhibit BCR-ABL, was recently shown to have substantial activity against all four Fgfr kinases (Gozgit J M, Wong M J, Moran L, et al. (2012) Ponatinib (AP24534), a multitargeted pan-FGFR inhibitor with activity in multiple FGFR-amplified or mutated cancer models. Mol Cancer Ther 11(3):690-9). This is an area of active investigation.

Pazopanib is a multi-tyrosine kinase inhibitor which targets Vegfr, Pdgfr, Fgfr, Ret, and c-Kit. Pazopanib has been approved for use in renal cell carcinoma and soft tissue sarcomas. A fusion resulting in the activation of Fgfr3, or amplification of Fgfr3, may predict sensitivity to pazopanib. A Phase 2 study comparing pazopanib to lapatinib therapy in advanced cervical cancer reported improved PFS and OS for the pazopanib arm (Monk B J, Mas Lopez L, Zarba J J, et al. (2010) Phase II, open-label study of pazopanib or lapatinib monotherapy compared with pazopanib plus lapatinib combination therapy in patients with advanced and recurrent cervical cancer. J Clin Oncol 28(22):3562-9). Studies of pazopanib are continuing in cervical cancer and other solid tumors.

Accordingly, in another aspect, a method of inhibiting, reducing, or treating a hyperproliferative disorder, e.g., a neoplasm (including benign, pre-malignant or malignant (e.g., a cancer), in a subject is provided. The method includes administering to the subject a preselected therapeutic agent, e.g., an anti-cancer agent (e.g., a kinase inhibitor), as a single agent, or in combination, in an amount sufficient to reduce, inhibit or treat the activity or expression of FGFR3-TACC3 (e.g., a FGFR3-TACC3 fusion described herein), thereby inhibiting, reducing, or treating the hyperproliferative disorder in the subject.

In one embodiment, the subject treated has a FGFR3-TACC3 fusion; e.g., the subject has a tumor or cancer harboring a FGFR3-TACC3 fusion. In other embodiments, the subject has been previously identified as having a FGFR3-TACC3 fusion. In yet other embodiments, the subject has been previously identified as being likely or unlikely to respond to treatment with a protein kinase inhibitor, e.g., a subject that has previously participated in a clinical trial. In other embodiments, the subject has been previously identified as being likely or unlikely to respond to treatment with a protein kinase inhibitor, based on the presence of the FGFR3-TACC3 fusion. In one embodiment, the subject is a mammal, e.g., a human. In one embodiment, the subject has, or at risk of having a cancer at any stage of disease. In other embodiments, the subject is a patient, e.g., a cancer patient.

In certain embodiments, the neoplasm or neoplastic cell is a benign, pre-malignant, malignant (cancer) or metastasis. In certain embodiments, the cancer is a solid tumor, a soft tissue tumor, or a metastatic lesion. In one embodiment, the cancer is chosen from a lung cancer, a cervical cancer, a uterus cancer, or an adenocarcinoma. In one embodiment, the cancer is a lung adenocarcinoma. In one embodiment, the cancer is a cervical adenocarcinoma. In one embodiment, the cancer is a uterus endometrial adenocarcinoma. In other embodiment, the lung cancer is chosen from one or more of the following: non-small cell lung cancer (NSCLC), small cell lung cancer (SCLC), squamous cell carcinoma (SCC), adenocarcinoma of the lung, bronchogenic carcinoma, or a combination thereof. In one embodiment, the lung cancer is NSCLC or SCC. In one embodiment, the cancer is chosen from a lung cancer, a pancreatic cancer, melanoma, a colorectal cancer, an esophageal-gastric cancer, a thyroid cancer, or an adenocarcinoma. In one embodiment the cancer is a carcinoma, e.g., a bladder urithelial carcinoma, a cervical carcinoma, a cervical squamous cell carcinoma, a kidney carcinoma, a kidney urothelial carcinoma, a pancreatic ductal carcinoma, a primary urothelial carcinoma, a lung carcinoma, a uteral endometrial carcinoma. In certain embodiments the cancer is a skin cancer, e.g., a skin melanoma. In certain embodiments the cancer is a brain cancer, e.g., a brain astrocytoma, a brain glioblastoma. In certain embodiments, the cancer is a cholangiosarcoma. In certain embodiments, the cancer is a liver cholangiosarcoma.

In one embodiment, the anti-cancer agent is a kinase inhibitor. For example, the kinase inhibitor is a multi-kinase inhibitor or a FGFR3-specific inhibitor. In one embodiment, the kinase inhibitor is a FGFR3 inhibitor including, but not limited to, TKI258; AP24534; AZD4547; FP-1039; XL9999; brivanib (BMS-528664); BIBF-1120; pazopanib (votrient), dovitinib, or BGJ398 (NVP-BGJ398). In certain embodiments, the FGFR3 inhibitor is an FGFR3 inhibitor described herein.

TRIM24-BRAF Fusions

In one embodiment, a fusion includes an in-frame fusion of an exon of tripartite motif containing 24 (TRIM24), e.g., one more exons of TRIM24 (e.g., one or more of exons 1-9 of TRIM24) or a fragment thereof, and an exon of v-raf murine sarcoma viral oncogene homolog B1 (BRAF), e.g., one or more exons of a BRAF (e.g., one or more of exons 9-18 of BRAF) or a fragment thereof. For example, the TRIM24-BRAF fusion can include an in-frame fusion within an intron of TRIM24 (e.g., intron 9) or a fragment thereof, with an intron of BRAF (e.g., intron 8) or a fragment thereof. In one embodiment, the fusion of the TRIM24-BRAF fusion comprises the nucleotide sequence of: chromosome 7 at one or more of nucleotide 140,490,180 or 140,489,369 (plus or minus 10, 20, 30, 50, 60, 70, 80, 100 or more nucleotides) and chromosome 7 at one or more of nucleotide 138,245,669 or 138,241,731 (plus or minus 10, 20, 30, 50, 60, 70, 80, 100 or more nucleotides). In one embodiment, the TRIM24-BRAF fusion is an inversion, e.g., an inversion of a portion of chromosome 7.

In certain embodiments, the TRIM24-BRAF fusion is in a 5'-TRIM24 to 3'-BRAF configuration (also referred to herein as "5'-TRIM24-BRAF-3')." The term "fusion" or "fusion molecule" can refer to a polypeptide or a nucleic acid fusion, depending on the context. It may include a full-length sequence of a fusion or a fragment thereof, e.g., a fusion junction (e.g., a fragment including a portion of TRIM24 and a portion of BRAF, e.g., a portion of the TRIM24-BRAF fusion described herein). In one embodiment, the TRIM24-BRAF fusion polypeptide includes a fragment of the amino acid sequence shown in FIG. 8 (SEQ ID NO:8) and a fragment of the amino acid sequence shown in FIG. 10 (SEQ ID NO:10), or an amino acid sequence substantially identical thereto. In another embodiment, the TRIM24-BRAF fusion nucleic acid includes a fragment of the nucleotide sequence shown in FIGS. 7A-7B (SEQ ID NO:7) and a fragment of the nucleotide sequence shown in FIGS. 9A-9B (SEQ ID NO:9), or a nucleotide sequence substantially identical thereto. In one embodiment, the TRIM24-BRAF fusion polypeptide comprises sufficient TRIM24 and sufficient BRAF sequence such that the 5' TRIM24-3' BRAF fusion has kinase activity, e.g., has elevated activity, e.g., BRAF tyrosine kinase activity, as compared with wild type BRAF, e.g., in a cell of a cancer referred to herein (e.g., glioblastoma, e.g., brain glioblastoma, and melanoma).

In certain embodiments, the TRIM24-BRAF fusion comprises one or more (or all of) exons 1-9 from TRIM24 and one or more (or all of) exons 9-18 from BRAF (e.g., one or more of the exons shown in FIGS. 7A-7B (SEQ ID NO:7) and FIGS. 9A-9B (SEQ ID NO:9). In another embodiment, the TRIM24-BRAF fusion comprises one or more (or all of) exons 1-9 of TRIM24 and one or more (or all of) exons 9-18 of BRAF. In certain embodiments, the TRIM24-BRAF fusion comprises at least 1, 2, 3, 4, 5, 6, 7, 9 or more exons (and encoded exons) from TRIM24 and at least 1, 2, 3, 4, 5, 6, 7, 8, 9 or more exons (and encoded exons) from BRAF (e.g., from the TRIM24 and BRAF sequences shown in FIGS. 7A-7B and FIG. 8, respectively (SEQ ID NO:7 and 8) and FIGS. 9A-9B and FIG. 10, respectively (SEQ ID NOs:9 and 10).

In certain embodiments, the TRIM24-BRAF fusion comprises exon 9 or a fragment thereof from TRIM24, and exon 9 or a fragment thereof from BRAF (e.g., as shown in FIGS. 7A-7B (SEQ ID NO:7) and FIGS. 9A-9B (SEQ ID NO:9)). In one embodiment, the TRIM24-BRAF fusion comprises at least 5, 10, 15, 20, 30, 40, 50 or more amino acids corresponding to (e.g., encoded by) exon 9 of TRIM24 (e.g., from the amino acid sequence of TRIM24 as shown in FIG. 8 (SEQ ID NO:8) (e.g., from the amino acid sequence of TRIM24 preceding the fusion junction with BRAF, and at least 5, 10, 15, 20, 30, 40, 50 or more amino acids corresponding to (e.g., encoded by) exon 9 of BRAF (e.g., from the amino acid sequence of BRAF as shown in FIG. 10 (SEQ ID NO:10)). In another embodiment, the TRIM24-BRAF fusion comprises at least 6, 12, 15, 20, 25, 50, 75, 100 or more nucleotides from exon 9 of TRIM24 (e.g., from the nucleotide sequence of TRIM24 as shown in FIGS. 7A-7B (SEQ ID NO:7) (e.g., from the nucleotide sequence of TRIM24 preceding the fusion junction with BRAF); and at least 6, 12, 15, 20, 25, 50, 75, 100 or more nucleotides from exon 9 of BRAF (e.g., from the nucleotide sequence of BRAF as shown in FIGS. 9A-9B (SEQ ID NO:9)).

TRIM24-BRAF Nucleic Acid Molecules

In one aspect, the invention features a nucleic acid molecule (e.g., an isolated or purified) nucleic acid molecule that includes a fragment of a TRIM24 gene and a fragment of a BRAF gene. In one embodiment, the nucleotide sequence encodes a TRIM24-BRAF fusion polypeptide that includes a BRAF tyrosine kinase domain or a functional fragment thereof. In another embodiment, the nucleotide sequence encodes a fragment of the BRAF polypeptide including the amino acid sequence of SEQ ID NO:10 or a fragment thereof, or a sequence substantially identical thereto. In other embodiments, the nucleic acid molecule includes a fragment of the BRAF gene encoding the amino acid sequence of SEQ ID NO:8 or a fragment thereof, or a sequence substantially identical thereto. In yet other embodiments, the nucleic acid molecule includes a nucleotide sequence encoding the amino acid sequence shown in FIG. 8 (e.g., SEQ ID NO:8), or a fragment thereof, and the amino acid sequence shown in FIG. 10 (e.g., SEQ ID NO:10) or a fragment thereof, or a sequence substantially identical thereto.

In one embodiment, the nucleic acid molecule includes a fusion, e.g., an in-frame fusion, between an intron of TRIM24 (e.g., intron 9, or a fragment thereof), and an intron of BRAF (e.g., intron 8, or a fragment thereof). The TRIM24-BRAF fusion can comprise a fusion of the nucleotide sequence of: chromosome 7 at one or more of nucleotide 140,490,180 or 140,489,369 (plus or minus 10, 20, 30, 50, 60, 70, 80, 100 nucleotides) and chromosome 7 at one or more of nucleotide 138,245,669 or 138,241,731 (plus or minus 10, 20, 30, 50, 60, 70, 80, 100 nucleotides), or a fragment thereof. In one embodiment, the TRIM24-BRAF fusion comprises a fusion of the nucleotide sequence of: chromosome 7 at one or more of nucleotide 140,490,180 or 140,489,369 (plus or minus 10, 20, 30, 50, 60, 70, 80, 100 nucleotides) and chromosome 7 at one or more of nucleotide 138,245,669 or 138,241,731 (plus or minus 10, 20, 30, 50, 60, 70, 80, 100 nucleotides), or a fragment thereof.

In another embodiment, the TRIM24-BRAF fusion comprises a nucleotide sequence (e.g., a fragment of a nucleotide sequence) shown in FIGS. 7A-7B (SEQ ID NO: 7) and a nucleotide sequence (e.g., a fragment of a nucleotide sequence) shown in FIGS. 9A-9B (SEQ ID NO:9), or a fragment of the fusion. In one embodiment, the TRIM24-BRAF fusion comprises a nucleotide sequence substantially identical to the nucleotide sequence (e.g., a fragment of a nucleotide sequence) shown in FIGS. 7A-7B (SEQ ID NO: 7) and the nucleotide sequence (e.g., a fragment of a nucleotide sequence) shown FIGS. 9A-9B (SEQ ID NO:9), or a fragment of the fusion. In one embodiment, the TRIM24-BRAF fusion comprises a nucleotide sequence at least 70%, at least 75%, at least 80%, at least 85%, at least 90%, at least 95%, at least 99%, at least 99.5 or greater, identical to the nucleotide sequence (e.g., a fragment of a nucleotide sequence) shown in FIGS. 7A-7B (SEQ ID NO: 7) and to the nucleotide sequence (e.g., a fragment of a nucleotide sequence) shown in FIGS. 9A-9C (SEQ ID NO:9). In one embodiment, the TRIM24-BRAF fusion comprises a nucleotide sequence containing at least 25, 50, 100, 150, 200, 500, 1000, 1500, 2000, 2500, 3000, or more nucleotides of the nucleotide sequence shown in FIGS. 7A-7B (SEQ ID NO: 7) and a nucleotide sequence containing at least 25, 50, 100, 150, 200, 500, 1000, 1500, 2000, 2500, 3000, or more nucleotides of the nucleotide sequence shown in FIGS. 9A-9B (SEQ ID NO:9). In one embodiment, the TRIM24-BRAF fusion comprises a nucleotide sequence containing at least 25, 50, 100, 150, 200, 500, 1000, 1500, 2000, 2500, 3000, or more contiguous nucleotides of the nucleotide sequence shown in FIGS. 7A-7B (SEQ ID NO: 7) and a nucleotide sequence containing at least 25, 50, 100, 150, 200, 500, 1000, 1500, 2000, 2500, 3000, or more nucleotides of the nucleotide sequence shown in FIGS. 9A-9B (SEQ ID NO:9).

In another embodiment, the nucleic acid molecule includes a fusion, e.g., an in-frame fusion, of at least exon 9 of TRIM24 or a fragment thereof (e.g., one or more of exons 1-9 of TRIM24 or a fragment thereof), and at least exon 9 or a fragment thereof (e.g., one or more of exons 9-18 of BRAF or a fragment thereof). In yet other embodiments, the nucleic acid molecule includes a fragment the nucleotide sequence shown in FIGS. 7A-7B (SEQ ID NO: 7) and a fragment of the nucleotide sequence shown in FIGS. 9A-9B (SEQ ID NO:9) or a fragment of the fusion, or a sequence substantially identical thereto.

In one embodiment, the nucleic acid molecule is complementary to at least a portion of a nucleotide sequence disclosed herein, e.g., is capable of hybridizing under a stringency condition described herein to SEQ ID NO:7 and/or SEQ ID NO:9, or a fragment thereof. In yet another embodiment, the nucleic acid molecule hybridizes to a nucleotide sequence that is complementary to at least a portion of a nucleotide sequence disclosed herein, e.g., is capable of hybridizing under a stringency condition to a nucleotide sequence complementary to SEQ ID NO:7 and/or SEQ ID NO:9, or a fragment thereof. The nucleotide sequence of a cDNA encoding an exemplary 5' TRIM24-3' BRAF fusion is shown in at least exon 9 (e.g., exons 1-9) of SEQ ID NO:7 and at least exon 9 (e.g., exons 9-18) of SEQ ID NO:9, and the predicted amino acid sequence is shown in the corresponding encoded exons of SEQ ID NO:8 and the corresponding encoded exons of SEQ ID NO:10, respectively.

In an embodiment the TRIM24-BRAF nucleic acid molecule comprises sufficient TRIM24 and sufficient BRAF sequence such that the encoded 5' TRIM24-3' BRAF fusion has kinase activity, e.g., has elevated activity, e.g., BRAF kinase activity, as compared with wild type BRAF, e.g., in a cell of a cancer referred to herein. In certain embodiments, the 5' TRIM24-3' BRAF fusion comprises exons 1-9 from TRIM24 and exon 9-18 from BRAF. In certain embodiments, the TRIM24-BRAF fusion comprises at least 1, 2, 3, 4, 5, 6, 7, 9, or more exons from TRIM24 and at least 1, 2, 3, 4, 5, 6, 7, 9, or more, exons from BRAF. In certain embodiments, the TRIM24-BRAF fusion comprises a fusion of exon 9 from TRIM24 and exon 9 from BRAF. In another embodiment, the TRIM24-BRAF fusion comprises at least 1, 2, 3, 4, 5, 6, 7, 9 exons from TRIM24; and at least 1, 2, 3, 4, 5, 6, 7, 9 exons from BRAF. The nucleotide and amino acid sequences for TRIM 24 are shown in FIGS. 7A-7B (SEQ ID NO:7) and FIG. 8 (SEQ ID NO:8), and for BRAF are shown in FIGS. 9A-9B (SEQ ID NO:9) and FIG. 10 (SEQ ID NO:10).

In one embodiment, the nucleic acid molecule includes a nucleotide sequence that has an in-frame fusion of intron 9 of TRIM24 (e.g., NM_003852) with intron 9 of BRAF (e.g., NM_004333). In another embodiment, the nucleic acid molecule includes a nucleotide sequence that includes a breakpoint. For example, the nucleic acid molecule includes a nucleotide sequence that includes the fusion junction between the TRIM24 gene and the BRAF gene, e.g., the breakpoint between intron 9 of TRIM24 and intron 8 of BRAF. In other embodiments, the nucleic acid molecules includes a nucleotide sequence of one or more of nucleotide 140,490,180 or 140,489,369 of chromosome 7 coupled to (e.g., directly or indirectly juxtaposed to) one or more of nucleotide 138,245,669 or 138,241,731 of chromosome 7. In one embodiment, the nucleic acid molecule includes the nucleotide sequence of: chromosome 4 at one or more of nucleotide 140,490,180 or 140,489,369 plus or minus 10, 20, 30, 40 50, 60, 80, 100, 150 nucleotides and chromosome 4 at one or more of nucleotide 138,245,669 or 138,241,731 plus or minus 10, 20, 30, 40 50, 60, 80, 100, 150 nucleotides (corresponding to the breakpoint of a TRIM24-BRAF fusion), or a fragment thereof, or a sequence substantially identical thereto. In one embodiment, the nucleic acid molecule is complementary to at least a portion of a nucleotide sequence disclosed herein, e.g., is capable of hybridizing under a stringency condition described herein to SEQ ID NO:7 and/or SEQ ID NO:9 or a fragment thereof. In yet other embodiment, the nucleic acid molecule hybridizes to a nucleotide sequence that is complementary to at least a portion of a nucleotide sequence disclosed herein, e.g., is capable of hybridizing under a stringency condition described herein to a nucleotide sequence complementary to SEQ ID NO:7 or 9 or a fragment thereof.

In another embodiment, the TRIM24-BRAF fusion nucleic acid comprises at least 6, 12, 15, 20, 25, 50, 75, 100 or more nucleotides from exon 9 of TRIM24 (e.g., from the nucleotide sequence of TRIM24 preceding the fusion junction with BRAF, e.g., of the TRIM24 sequence shown in FIGS. 7A-7B (SEQ ID NO:7)), and at least 6, 12, 15, 20, 25, 50, 75, 100 or more nucleotides from exon 8 of BRAF (e.g., from the nucleotide sequence of BRAF following the fusion junction with TRIM24, e.g., of the BRAF sequence shown in FIGS. 9A-9B (SEQ ID NO:9)).

In other embodiments, the nucleic acid molecule includes a nucleotide sequence encoding a TRIM24-BRAF fusion polypeptide that includes a fragment of a TRIM24 gene and a fragment of an BRAF gene. In one embodiment, the nucleotide sequence encodes a TRIM24-BRAF fusion polypeptide that includes e.g., a BRAF tyrosine kinase domain or a functional fragment thereof. In yet other embodiments, the nucleic acid molecule includes a nucleotide sequence encoding the amino acid sequence (e.g., a fragment of the amino acid sequence) shown in FIG. 8 (e.g., SEQ ID NO:8) and a nucleotide sequence encoding the amino acid sequence (e.g., a fragment of the amino acid sequence) shown in FIG. 10 (e.g., SEQ ID NO:10), or a fragment of the fusion, or a sequence substantially identical thereto. In one embodiment, the encoded TRIM24-BRAF fusion polypeptide includes a BRAF tyrosine kinase domain or a functional fragment thereof.

In a related aspect, the invention features nucleic acid constructs that include the TRIM24-BRAF nucleic acid molecules described herein. In certain embodiments, the nucleic acid molecules are operatively linked to a native or a heterologous regulatory sequence. Also included are vectors and host cells that include the TRIM24-BRAF nucleic acid molecules described herein, e.g., vectors and host cells suitable for producing the nucleic acid molecules and polypeptides described herein.

In a related aspect, methods of producing the nucleic acid molecules and polypeptides described herein are also described.

In another aspect, the invention features nucleic acid molecules that reduce or inhibit the expression of a nucleic acid molecule that encodes a TRIM24-BRAF fusion described herein. Examples of such nucleic acid molecules include, for example, antisense molecules, ribozymes, RNAi, triple helix molecules that hybridize to a nucleic acid encoding TRIM24-BRAF, or a transcription regulatory region of TRIM24-BRAF, and blocks or reduces mRNA expression of TRIM24-BRAF.

Nucleic Acid Detection and Capturing Reagents

The invention also features a nucleic acid molecule, e.g., nucleic acid fragment, suitable as probe, primer, bait or library member that includes, flanks, hybridizes to, which are useful for identifying, or are otherwise based on, the TRIM24-BRAF fusions described herein. In certain embodiments, the probe, primer or bait molecule is an oligonucleotide that allows capture, detection or isolation of a TRIM24-BRAF fusion nucleic acid molecule described herein. The oligonucleotide can comprise a nucleotide sequence substantially complementary to a fragment of the TRIM24-BRAF fusion nucleic acid molecules described herein. The sequence identity between the nucleic acid fragment, e.g., the oligonucleotide, and the target TRIM24-BRAF sequence need not be exact, so long as the sequences are sufficiently complementary to allow the capture, detection or isolation of the target sequence. In one embodiment, the nucleic acid fragment is a probe or primer that includes an oligonucleotide between about 5 and 25, e.g., between 10 and 20, or 10 and 15 nucleotides in length. In other embodiments, the nucleic acid fragment is a bait that includes an oligonucleotide between about 100 to 300 nucleotides, 130 and 230 nucleotides, or 150 and 200 nucleotides, in length.

In one embodiment, the nucleic acid fragment can be used to identify or capture, e.g., by hybridization, a TRIM24-BRAF fusion. For example, the nucleic acid fragment can be a probe, a primer, or a bait, for use in identifying or capturing, e.g., by hybridization, a TRIM24-BRAF fusion described herein. In one embodiment, the nucleic acid fragment can be useful for identifying or capturing a TRIM24-BRAF breakpoint, e.g., the nucleotide sequence of: chromosome 7 at nucleotide 140,490,180 or 140,489,369 plus or minus 10, 20, 30, 40 50, 60, 80, 100, 150 nucleotides and chromosome 7 at nucleotide 138,245,669 or 138,241, 731 plus or minus 10, 20, 30, 40 50, 60, 80, 100, 150 nucleotides.

In one embodiment, the nucleic acid fragment hybridizes to a nucleotide sequence within a chromosomal rearrangement that creates an in-frame fusion of intron 9 of TRIM24 with intron 8 of BRAF. In one embodiment, the nucleic acid fragment hybridizes to a nucleotide sequence in the region In other embodiments, the nucleic acid molecules includes a nucleotide sequence in the region of nucleotides 140,490, 180 or 140,489,369 of chromosome 7 coupled to (e.g., juxtaposed to) nucleotides in the region of nucleotides 138,245,669 or 138,241,731 of chromosome 7. In one embodiment, the nucleic acid fragment hybridizes to a nucleotide sequence that includes a breakpoint, e.g., the nucleotide sequence of: chromosome 7 at nucleotide 140, 490,180 or 140,489,369 plus or minus 10, 20, 30, 40 50, 60, 80, 100, 150 or more nucleotides and chromosome 7 at nucleotide 138,245,669 or 138,241,731 plus or minus 10, 20, 30, 40 50, 60, 80, 100, 150 or more nucleotides. For example, the nucleic acid fragment can hybridize to a nucleotide sequence that includes the fusion junction between the TRIM24 gene and the BRAF gene, e.g., a nucleotide sequence that includes a portion of a nucleotide sequence within introns 9 of a TRIM24 gene and 8 of a BRAF gene.

In another embodiment, the nucleic acid fragment hybridizes to a nucleotide sequence that comprises at least 6, 12, 15, 20, 25, 50, 75, 100, 150 or more nucleotides from exon 9 of TRIM24 (e.g., from the nucleotide sequence of TRIM24 preceding the fusion junction with BRAF, e.g., of the TRIM24 sequence shown in FIGS. 7A-7B (SEQ ID NO:7)), and at least 6, 12, 15, 20, 25, 50, 75, 100, 150 or more nucleotides from exon 9 of BRAF (e.g., from the nucleotide sequence of BRAF following the fusion junction with TRIM24, e.g., of the BRAF sequence shown in FIGS. 9A-9B (SEQ ID NO:9)).

The probes or primers described herein can be used, for example, for FISH detection or PCR amplification. In one exemplary embodiment where detection is based on PCR, amplification of the TRIM24-BRAF fusion junction fusion junction can be performed using a primer or a primer pair, e.g., for amplifying a sequence flanking the fusion junctions described herein, e.g., the mutations or the junction of a chromosomal rearrangement described herein, e.g., TRIM24-BRAF.

In one embodiment, a pair of isolated oligonucleotide primers can amplify a region containing or adjacent to a position in the TRIM24-BRAF fusion. For example, forward primers can be designed to hybridize to a nucleotide sequence within TRIM24 genomic or mRNA sequence (e.g., a nucleotide sequence within exon 9 of TRIM24 of SEQ ID NO:7), and the reverse primers can be designed to hybridize to a nucleotide sequence of BRAF (e.g., a nucleotide sequence within exon 9 of BRAF, of SEQ ID NO:9).

In another embodiment, the nucleic acid fragments can be used to identify, e.g., by hybridization, a TRIM24-BRAF fusion. In one embodiment, the nucleic acid fragment hybridizes to a nucleotide sequence that includes a fusion junction between the TRIM24 transcript and the BRAF transcript.

In other embodiments, the nucleic acid fragment includes a bait that comprises a nucleotide sequence that hybridizes to a TRIM24-BRAF fusion nucleic acid molecule described herein, and thereby allows the capture or isolation said nucleic acid molecule. In one embodiment, a bait is suitable for solution phase hybridization. In other embodiments, a bait includes a binding entity, e.g., an affinity tag, that allows capture and separation, e.g., by binding to a binding entity, of a hybrid formed by a bait and a nucleic acid hybridized to the bait.

In other embodiments, the nucleic acid fragment includes a library member comprising a TRIM24-BRAF nucleic acid molecule described herein. In one embodiment, the library member includes a rearrangement that results in a TRIM24-BRAF fusion described herein.

The nucleic acid fragment can be detectably labeled with, e.g., a radiolabel, a fluorescent label, a bioluminescent label, a chemiluminescent label, an enzyme label, a binding pair label, or can include an affinity tag; a tag, or identifier (e.g., an adaptor, barcode or other sequence identifier).

TRIM24-BRAF Fusion Polypeptides

In another embodiment, the TRIM24-BRAF fusion comprises an amino acid sequence (e.g., a fragment of the amino acid sequence) shown in FIG. 8 (SEQ ID NO:8) and an amino acid sequence (e.g., a fragment of the amino acid sequence) shown in FIG. 10 (SEQ ID NO:10), or a fragment of the fusion. In one embodiment, the TRIM24-BRAF fusion comprises an amino acid sequence substantially identical to the amino acid sequence (e.g., a fragment of the amino acid sequence) shown in FIG. 8 (SEQ ID NO:8) and the amino acid sequence (e.g., a fragment of the amino acid sequence) shown in FIG. 10 (SEQ ID NO:10), or a fragment thereof. In one embodiment, the TRIM24-BRAF fusion comprises an amino acid sequence at least 70%, at least 75%, at least 80%, at least 85%, at least 90%, at least 95%, at least 99%, at least 99.5 or greater, identical to the amino acid sequence (e.g., a fragment of the amino acid sequence) shown in FIG. 8 (SEQ ID NO:8) and the amino acid sequence (e.g., a fragment of the amino acid sequence) shown in FIG. 10 (SEQ ID NO:10). In one embodiment, the TRIM24-BRAF fusion comprises a sequence containing at least 10, 20, 50, 100, 500, 600, 700, 800, 900, 1000, or more amino acids of the amino acid sequence shown in FIG. 8 (SEQ ID NO:8) and FIG. 10 (SEQ ID NO:10). In one embodiment, the TRIM24-BRAF fusion comprises an amino acid sequence containing at least 5, 10, 20, 50, 100, 500, 600, 700, 800, 900, 1000, or more contiguous amino acids of the amino acid sequence shown in FIG. 8 (SEQ ID NO:8) and at least 5, 10, 20, 50, 100, 500, 600, 700, 800, 900, 1000, or more contiguous amino acids of the amino acid sequence shown in FIG. 10 (SEQ ID NO:10). In one embodiment, the 5' TRIM24-3' BRAF fusion polypeptide includes a BRAF receptor tyrosine kinase domain or a functional fragment thereof. In an embodiment, the 5'TRIM24-3'BRAF fusion polypeptide comprises sufficient BRAF and sufficient TRIM24 sequence such that it has kinase activity, e.g., has elevated activity, e.g., BRAF kinase activity, as compared with wild type BRAF, e.g., in a cell of a cancer referred to herein.

In another aspect, the invention features a TRIM24-BRAF fusion polypeptide (e.g., a purified TRIM24-BRAF fusion polypeptide), a biologically active or antigenic fragment thereof, as well as reagents (e.g., antibody molecules that bind to a TRIM24-BRAF fusion polypeptide), methods for modulating a TRIM24-BRAF polypeptide activity and detection of a TRIM24-BRAF polypeptide.

In one embodiment, the TRIM24-BRAF fusion polypeptide has at least one biological activity, e.g., a BRAF kinase activity. In one embodiment, at least one biological activity of the TRIM24-BRAF fusion polypeptide is reduced or inhibited by an anti-cancer drug, e.g., a kinase inhibitor (e.g., a multikinase inhibitor or a BRAF-specific inhibitor). In one embodiment, at least one biological activity of the TRIM24-BRAF fusion polypeptide is reduced or inhibited by an BRAF kinase inhibitor chosen from e.g., vemurafenib (also known as RG7204; or PLX4032; or Zelboraf); GDC-0879; PLX-4702; AZ628; dabrafenib (GSK2118346A); or Sorafenib Tosylate.

In yet other embodiments, the TRIM24-BRAF fusion polypeptide is encoded by a nucleic acid molecule described herein. In one embodiment, the TRIM24-BRAF fusion polypeptide is encoded by an in-frame fusion of intron 9 of TRIM24 with intron 8 of BRAF (e.g., a sequence on chromosome 7). In another embodiment, the TRIM24-BRAF fusion polypeptide includes an amino acid sequence encoded by a nucleotide sequence comprising a fusion junction between the TRIM24 transcript and the BRAF transcript.

In certain embodiments, the TRIM24-BRAF fusion polypeptide comprises one or more of encoded exons 1-9 from TRIM24 and one or more of encoded exon 9-18 from BRAF. In certain embodiments, the TRIM24-BRAF fusion polypeptide comprises at least 1, 2, 3, 4, 5, 6, 7, 9 or more encoded exons from TRIM24 and at least 1, 2, 3, 4, 5, 6, 7, 9 or more, encoded exons from BRAF. In certain embodiments, the TRIM24-BRAF fusion polypeptide comprises a fusion of encoded exon 9 from TRIM24 and encoded exon 9 from BRAF (or a fragment thereof). In other embodiments, the fusion comprises least 1, 2, 3, 4, 5, 6, 7, 9 encoded exons from TRIM24; and at least 1, 2, 3, 4, 5, 6, 7, 9 encoded exons from BRAF. In certain embodiments, the TRIM24-BRAF fusion polypeptide comprises encoded exons 1-9 from TRIM24 and exon 9-18 from BRAF. In certain embodiments, the 5' TRIM24-3' BRAF fusion polypeptide comprises a fusion junction of the sequence of exon 9 from TRIM24 and the sequence of exon 9 from BRAF.

In certain embodiments, the TRIM24-BRAF fusion comprises the amino acid sequence corresponding to exon 9 or a fragment thereof from TRIM24, and the amino acid sequence corresponding to exon 9 or a fragment thereof from BRAF (e.g., as shown in FIG. 8 (SEQ ID NO:8) and FIG. 10 (SEQ ID NO:10)). In one embodiment, the TRIM24-BRAF fusion comprises at least 5, 10, 15, 20 or more amino acids from exon 9 of TRIM24 (e.g., from the amino acid sequence of TRIM24 preceding the fusion junction with BRAF, e.g., of the TRIM24 sequence shown in FIG. 8 (SEQ ID NO:8)), and at least 5, 10, 15, 20 or more amino acids from exon 8 of BRAF (e.g., from the amino acid sequence of BRAF following the fusion junction with TRIM24, e.g., of the BRAF sequence shown in FIG. 10 (SEQ ID NO:10)).

In one embodiment, the TRIM24-BRAF fusion polypeptide includes a BRAF tyrosine kinase domain or a functional fragment thereof. In a related aspect, the invention features TRIM24-BRAF fusion polypeptide or fragments operatively linked to heterologous polypeptides to form fusion proteins.

In another embodiment, the TRIM24-BRAF fusion polypeptide or fragment is a peptide, e.g., an immunogenic peptide or protein, that contains a fusion junction described herein. Such immunogenic peptides or proteins can be used to raise antibodies specific to the fusion protein. In other embodiments, such immunogenic peptides or proteins can be used for vaccine preparation. The vaccine preparation can include other components, e.g., an adjuvant.

In another aspect, the invention features antibody molecules that bind to a TRIM24-BRAF fusion polypeptide or fragment described herein. In embodiments, the antibody can distinguish wild type BRAF (or TRIM24) from TRIM24-BRAF.

Detection Reagents and Detection of Mutations

In another aspect, the invention features a detection reagent, e.g., a purified or an isolated preparation thereof. Detection reagents can distinguish a nucleic acid, or protein sequence, having a breakpoint, e.g., a TRIM24-BRAF breakpoint; from a reference sequence. In one embodiment, the detection reagent detects (e.g., specifically detects) a TRIM24-BRAF fusion nucleic acid or a polypeptide (e.g., distinguishes a wild type BRAF or another BRAF fusion (or TRIM24) from a TRIM24-BRAF nucleic acid (e.g., as described herein in FIGS. 7A-7B (SEQ ID NO:7) or FIGS. 9A-9B (SEQ ID NO:9); or a TRIM24-BRAF polypeptide (e.g., as described herein in FIG. 8 (SEQ ID NO:8) or FIG. 10 (SEQ ID NO:10).

Detection reagents, e.g., nucleic acid-based detection reagents, can be used to identify mutations in a target nucleic acid, e.g., DNA, e.g., genomic DNA or cDNA, or RNA, e.g., in a sample, e.g., a sample of nucleic acid derived from a neoplastic or tumor cell, e.g., a melanocytic neoplasm, melanoma or metastatic cell. Detection reagents, e.g., antibody-based detection reagents, can be used to identify mutations in a target protein, e.g., in a sample, e.g., a sample of protein derived from, or produced by, a neoplastic or tumor cell, e.g., a melanocytic neoplasm, melanoma or metastatic cell.

Method of Treatment

TRIM24-BRAF fusion has not been previously described in human cancers, but may be homologous to a murine oncogene. TRIM24 encodes a member of the tripartite motif superfamily of transcription factor cofactors. TRIM24 interacts with, and inhibits, the transcriptional activity of the retinoic acid receptor (Herquel B, Ouararhni K, Khetchoumian K, et al. (2011) Transcription cofactors TRIM24, TRIM28, and TRIM33 associate to form regulatory complexes that suppress murine hepatocellular carcinoma. Proc Natl Acad Sci USA 108(20):8212-7). TRIM24-BRAF fusion has not been previously described in human tumors. A similar, possibly homologous, TRIM24-BRAF fusion encodes the murine oncoprotein T18. It is associated with murine hepatocellular carcinoma, and has been shown to act by dominant negative inhibition of wild-type TRIM24. This leads to an increase in retinoic acid mediated transcription of pro-mitotic target genes (Zhong S, Delva L, Rachez C, et al. (1999) A RA-dependent, tumour-growth suppressive transcription complex is the target of the PML-RARalpha and T18 oncoproteins. Nat Genet 23(3):287-95; Herquel B, Ouararhni K, Khetchoumian K, et al. (2011) Transcription cofactors TRIM24, TRIM28, and TRIM33 associate to form regulatory complexes that suppress murine hepatocellular carcinoma. Proc Natl Acad Sci USA 108(20):8212-7). TRIM24-BRAF has not been previously described in any human cancers. BRAF activation through mutation, notably at the residue V600, has been established as a driver of several cancers, most prominently metastatic melanoma.

BRAF encodes the signaling protein Braf which is downstream of Ras and activates the MAPK pathway. Braf signaling is involved in the processes of cell division and differentiation. BRAF mutations have been variously reported in 43-67% of malignant melanomas; the V600E mutation accounts for approximately 90% of these BRAF mutations (COSMIC, August 2012, Davies H, Bignell G R, Cox C, et al. (2002) Mutations of the BRAF gene in human cancer. Nature 417(6892):949-54). The BRAF rearrangement seen in this tumor fuses the N-terminus of TRIM24 to BRAF, with a breakpoint in intron 8 of BRAF, corresponding to amino acid 380 of 766. The portion of Braf prior to the breakpoint contains the Ras binding domain (156-227) and zinc-finger region (235-280), while the downstream portion contains the kinase domain (457-717) (www.uniprot.org). The TRIM24-BRAF fusion has not been previously described in human cancers, but may be homologous to a murine oncogene (Zhong S, Delva L, Rachez C, et al. (1999) A RA-dependent, tumour-growth suppressive transcription complex is the target of the PML-RARalpha and T18 oncoproteins. Nat Genet 23(3):287-95; Le Douarin B, Zechel C, Gamier J M, et al. (1995) The N-terminal part of TIF1, a putative mediator of the ligand-dependent activation function (AF-2) of nuclear receptors, is fused to B-raf in the oncogenic protein T18. EMBO J 14(9):2020-33). BRAF mutations have been linked to tumorigenesis, however, reports describing the link between BRAF mutation and prognosis in melanoma patients have been mixed (El-Osta H, Falchook G, Tsimberidou A, et al. (2011) BRAF mutations in advanced cancers: clinical characteristics and outcomes. PLoS ONE 6(10):e25806, Capper D, Berghoff A S, Magerle M, et al. (2012) Immunohistochemical testing of BRAF V600E status in 1,120 tumor tissue samples of patients with brain metastases. Acta Neuropathol 123(2): 223-33, Si L, Kong Y, Xu X, et al. (2012) Prevalence of BRAF V600E mutation in Chinese melanoma patients: large scale analysis of BRAF and NRAS mutations in a 432-case cohort. Eur J Cancer 48(1):94-100, Akslen L A, Angelini S, Straume O, et al. (2005) BRAF and NRAS mutations are frequent in nodular melanoma but are not associated with tumor cell proliferation or patient survival. J Invest Dermatol 125(2):312-7); (Hatzivassiliou G, Song K, Yen I, et al. (2010) RAF inhibitors prime wild-type RAF to activate the MAPK pathway and enhance growth. Nature 464(7287): 431-5, Wan P T, Garnett M J, Roe S M, et al. (2004) Mechanism of activation of the RAF-ERK signaling pathway by oncogenic mutations of B-RAF. Cell 116(6):855-67). Additional drug candidates targeting Braf, including sorafenib, and/or the downstream MAPK pathway are under clinical investigation, and a recent study in melanoma patient with BRAF V600 mutations reported that the combination of dabrafenib (a BRAF inhibitor) with trametenib (a MEK inhibitor) resulted in a significant increase in progression-free survival compared to treatment with dabrafenib alone (Flaherty K T, Robert C, Hersey P, et al. (2012) Improved survival with MEK inhibition in BRAF-mutated melanoma. N Engl J Med 367(2):107-14).

Accordingly, in another aspect, a method of inhibiting, reducing, or treating a hyperproliferative disorder, e.g., a neoplasm (including benign, pre-malignant or malignant (e.g., a cancer), in a subject is provided. The method includes administering to the subject a preselected therapeutic agent, e.g., an anti-cancer agent (e.g., a kinase inhibitor), as a single agent, or in combination, in an amount sufficient to reduce, inhibit or treat the activity or expression of TRIM24-BRAF (e.g., a TRIM24-BRAF fusion described herein), thereby inhibiting, reducing, or treating the hyperproliferative disorder in the subject.

In one embodiment, the subject treated has a TRIM24-BRAF fusion; e.g., the subject has a tumor or cancer harboring a TRIM24-BRAF fusion. In other embodiments, the subject has been previously identified as having a TRIM24-BRAF fusion. In yet other embodiments, the subject has been previously identified as being likely or unlikely to respond to treatment with a protein kinase inhibitor, e.g., a subject that has previously participated in a clinical trial. In other embodiments, the subject has been previously identified as being likely or unlikely to respond to treatment with a protein kinase inhibitor, based on the presence of the TRIM24-BRAF fusion. In one embodiment, the subject is a mammal, e.g., a human. In one embodiment, the subject has, or at risk of having a cancer at any stage of disease. In other embodiments, the subject is a patient, e.g., a cancer patient.

In certain embodiments, the neoplasm or neoplastic cell is a benign, pre-malignant, malignant (cancer) or metastasis. In certain embodiments, the cancer is a solid tumor, a soft tissue tumor, or a metastatic lesion. In one embodiment the cancer is a glioblastoma. In one embodiment, the cancer is a melanoma. In one embodiment, the cancer is chosen from a lung cancer, a cervical cancer, a uterus cancer, or an adenocarcinoma. In one embodiment, the cancer is a lung adenocarcinoma. In one embodiment, the cancer is a cervical adenocarcinoma. In one embodiment, the cancer is a uterus endometrial adenocarcinoma. In other embodiment, the lung cancer is chosen from one or more of the following: non-small cell lung cancer (NSCLC), small cell lung cancer (SCLC), squamous cell carcinoma (SCC), adenocarcinoma of the lung, bronchogenic carcinoma, or a combination thereof. In one embodiment, the lung cancer is NSCLC or SCC. In one embodiment, the cancer is chosen from a lung cancer, a pancreatic cancer, melanoma, a colorectal cancer, an esophageal-gastric cancer, a thyroid cancer, or an adeno- carcinoma. In certain embosiments, the cancer is a brain glioblastoma. In certain embodiments, the cancer is a hepatocellular carcinoma. In certain embodiments, the cancer is a metatstaic melanoma.

In one embodiment, the anti-cancer agent is a kinase inhibitor. For example, the kinase inhibitor is a multi-kinase inhibitor or a BRAF-specific inhibitor. In one embodiment, the kinase inhibitor is an BRAF inhibitor including, but not limited to, vemurafenib (also known as RG7204; or PLX4032; or Zelboraf); Bortezomib; MEK162; LGX818; GDC-0879; PLX-4702; AZ628; dabrafenib (GSK2118346A); or Sorafenib Tosylate. In certain embodiments, the BRAF inhibitor is a BRAF inhibitor described herein.

CNTLN-RAF1 Fusions

In one embodiment, a fusion includes an in-frame fusion of an exon of centlein centrosomal protein (CNTLN), e.g., one more exons of CNTLN (e.g., one or more of exons 1-5 of CNTLN) or a fragment thereof, and an exon of v-raf-1 murine leukemia viral oncogene homolog 1 (RAF1), e.g., one or more exons of a RAF1 (e.g., one or more of exons 8-17 of RAF1) or a fragment thereof. For example, the CNTLN-RAF1 fusion can include an in-frame fusion within an intron of CNTLN (e.g., intron 5) or a fragment thereof, with an intron of RAF1 (e.g., intron 7) or a fragment thereof. In one embodiment, the fusion of the CNTLN-RAF1 fusion comprises the nucleotide sequence of: chromosome 3 at one or more of nucleotide 12,643,880 (plus or minus 10, 20, 30, 50, 60, 70, 80, 100 or more nucleotides) and chromosome 9 at one or more of nucleotide 17,238,200 (plus or minus 10, 20, 30, 50, 60, 70, 80, 100 or more nucleotides). In one embodiment, the CNTLN-RAF1 fusion is a translocation, e.g., a translocation of a portion of chromosome 3 and a portion of chromosome 9.

In certain embodiments, the CNTLN-RAF1 fusion is in a 5'-CNTLN to 3'-RAF1 configuration (also referred to herein as "5'-CNTLN-RAF1-3')." The term "fusion" or "fusion molecule" can refer to a polypeptide or a nucleic acid fusion, depending on the context. It may include a full-length sequence of a fusion or a fragment thereof, e.g., a fusion junction (e.g., a fragment including a portion of CNTLN and a portion of RAF1, e.g., a portion of the CNTLN-RAF1 fusion described herein). In one embodiment, the CNTLN-RAF1 fusion polypeptide includes a fragment of the amino acid sequence shown in FIG. 12 (SEQ ID NO:12) and a fragment of the amino acid sequence shown in FIG. 14 (SEQ ID NO:14), or an amino acid sequence substantially identical thereto. In another embodiment, the CNTLN-RAF1 fusion nucleic acid includes a fragment of the nucleotide sequence shown in FIGS. 11A-11C (SEQ ID NO:11) and a fragment of the nucleotide sequence shown in FIGS. 13A-13B (SEQ ID NO:13), or a nucleotide sequence substantially identical thereto. In one embodiment, the CNTLN-RAF1 fusion polypeptide comprises sufficient CNTLN and sufficient RAF1 sequence such that the 5' CNTLN-3' RAF1 fusion has kinase activity, e.g., has elevated activity, e.g., RAF1 tyrosine kinase activity, as compared with wild type RAF1, e.g., in a cell of a cancer referred to herein (e.g., carcinoma, e.g., spindle cell carcinoma).

In certain embodiments, the CNTLN-RAF1 fusion comprises one or more (or all of) exons 1-5 from CNTLN and one or more (or all of) exons 8-17 of RAF1 (e.g., one or more of the exons shown in FIGS. 11A-11C (SEQ ID NO:11) and FIGS. 13A-13C (SEQ ID NO:13). In another embodiment, the CNTLN-RAF1 fusion comprises one or more (or all of) exons 1-5 of CNTLN and one or more (or all of) exons 8-17 of RAF1. In certain embodiments, the CNTLN-RAF1 fusion comprises at least 1, 2, 3, 4, 5 or more exons (or corresponding amino acid sequence) from CNTLN and at least 1, 2, 3, 4, 5, 6, 7, 8, 9, or more exons (or corresponding amino acid sequence) from RAF1 (e.g., from the CNTLN and RAF1 sequences shown in FIGS. 11A-11C and FIG. 12 (SEQ ID NO:11 and 12) and FIGS. 13A-13B and FIG. 14 (SEQ ID NOs:13 and 14).

In certain embodiments, the CNTLN-RAF1 fusion comprises exon 5 or a fragment thereof from CNTLN, and exon 8 or a fragment thereof from RAF1 (e.g., as shown in FIGS. 11A-11C (SEQ ID NO:11) and FIGS. 13A-13B (SEQ ID NO:13)). In one embodiment, the CNTLN-RAF1 fusion comprises at least 5, 10, 15, 20, 30, 40, 50 or more amino acids corresponding to (e.g., encoded by) exon 5 of CNTLN (e.g., from the amino acid sequence of CNTLN as shown in FIG. 12 (SEQ ID NO:12) (e.g., from the amino acid sequence of CNTLN preceding the fusion junction with RAF1, and at least 5, 10, 15, 20, 30, 40, 50 or more amino acids corresponding to (e.g., encoded by) exon 8 of RAF1 (e.g., from the amino acid sequence of RAF1 as shown in FIG. 14 (SEQ ID NO:14)). In another embodiment, the CNTLN-RAF1 fusion comprises at least 6, 12, 15, 20, 25, 50, 75, 100 or more nucleotides from exon 5 of CNTLN (e.g., from the nucleotide sequence of CNTLN as shown in FIGS. 11A-11C (SEQ ID NO:11) (e.g., from the nucleotide sequence of CNTLN preceding the fusion junction with RAF1); and at least 6, 12, 15, 20, 25, 50, 75, 100 or more nucleotides from exon 8 of RAF1 (e.g., from the nucleotide sequence of RAF1 as shown in FIGS. 13A-13B (SEQ ID NO:13)).

CNTLN-RAF1 Nucleic Acid Molecules

In one aspect, the invention features a nucleic acid molecule (e.g., an isolated or purified) nucleic acid molecule that includes a fragment of a CNTLN gene and a fragment of a RAF1 gene. In one embodiment, the nucleotide sequence encodes a CNTLN-RAF1 fusion polypeptide that includes a RAF1 tyrosine kinase domain or a functional fragment thereof. In another embodiment, the nucleotide sequence encodes a fragment of the RAF1 polypeptide including the amino acid sequence of SEQ ID NO:14 or a fragment thereof, or a sequence substantially identical thereto. In other embodiments, the nucleic acid molecule includes a fragment of the CNTLN gene encoding the amino acid sequence of SEQ ID NO:12 or a fragment thereof, or a sequence substantially identical thereto. In yet other embodiments, the nucleic acid molecule includes a nucleotide sequence encoding the amino acid sequence shown in FIG. 12 (SEQ ID NO:12), or a fragment thereof, and the amino acid sequence shown in FIG. 14 (SEQ ID NO:14) or a fragment thereof, or a sequence substantially identical thereto.

In one embodiment, the nucleic acid molecule includes a fusion, e.g., an in-frame fusion, between an intron of CNTLN (e.g., intron 5, or a fragment thereof), and an intron of RAF1 (e.g., intron 7, or a fragment thereof). The CNTLN-RAF1 fusion can comprise a fusion of the nucleotide sequence of: chromosome 3 at one or more of nucleotide 12,643,880 (plus or minus 10, 20, 30, 50, 60, 70, 80, 100 nucleotides) and chromosome 9 at one or more of nucleotide 17,238,200 (plus or minus 10, 20, 30, 50, 60, 70, 80, 100 nucleotides), or a fragment thereof. In one embodiment, the CNTLN-RAF1 fusion comprises a fusion of the nucleotide sequence of: chromosome 3 at one or more of nucleotide 12,643,880 (plus or minus 10, 20, 30, 50, 60, 70, 80, 100 nucleotides) and chromosome 9 at one or more of nucleotide 17,238,200 (plus or minus 10, 20, 30, 50, 60, 70, 80, 100 nucleotides), or a fragment thereof.

In another embodiment, the CNTLN-RAF1 fusion comprises a nucleotide sequence (e.g., a fragment of a nucleotide sequence) shown in FIGS. 11A-11C (SEQ ID NO:11) and a nucleotide sequence (e.g., a fragment of a nucleotide sequence) shown in FIGS. 13A-13B (SEQ ID NO:13), or a fragment of the fusion. In one embodiment, the CNTLN-RAF1 fusion comprises a nucleotide sequence substantially identical to the nucleotide sequence (e.g., a fragment of a nucleotide sequence) shown in FIGS. 11A-11C (SEQ ID NO:11) and the nucleotide sequence (e.g., a fragment of a nucleotide sequence) shown FIGS. 13A-13B (SEQ ID NO:13), or a fragment of the fusion. In one embodiment, the CNTLN-RAF1 fusion comprises a nucleotide sequence at least 70%, at least 75%, at least 80%, at least 85%, at least 90%, at least 95%, at least 99%, at least 99.5 or greater, identical to the nucleotide sequence (e.g., a fragment of a nucleotide sequence) shown in FIGS. 11A-11C (SEQ ID NO:11) and to the nucleotide sequence (e.g., a fragment of a nucleotide sequence) shown in FIGS. 13A-13B (SEQ ID NO:13). In one embodiment, the CNTLN-RAF1 fusion comprises a nucleotide sequence containing at least 25, 50, 100, 150, 200, 500, 1000, 1500, 2000, 2500, 3000, or more nucleotides of the nucleotide sequence shown in FIGS. 11A-11C (SEQ ID NO:11) and a nucleotide sequence containing at least 25, 50, 100, 150, 200, 500, 1000, 1500, 2000, 2500, 3000, or more nucleotides of the nucleotide sequence shown in FIGS. 13A-13B (SEQ ID NO:13). In one embodiment, the CNTLN-RAF1 fusion comprises a nucleotide sequence containing at least 25, 50, 100, 150, 200, 500, 1000, 1500, 2000, 2500, 3000, or more contiguous nucleotides of the nucleotide sequence shown in FIGS. 11A-11C (SEQ ID NO:11) and a nucleotide sequence containing at least 25, 50, 100, 150, 200, 500, 1000, 1500, 2000, 2500, 3000, or more nucleotides of the nucleotide sequence shown in FIGS. 13A-13B (SEQ ID NO:13).

In another embodiment, the nucleic acid molecule includes a fusion, e.g., an in-frame fusion, of at least exon 5 of CNTLN or a fragment thereof (e.g., one or more of exons 1-5 of CNTLN or a fragment thereof), and at least exon 8 or a fragment thereof (e.g., one or more of exons 8-17 of RAF1 or a fragment thereof). In yet other embodiments, the nucleic acid molecule includes a fragment the nucleotide sequence shown in FIGS. 11A-11C (SEQ ID NO:11) and a fragment of the nucleotide sequence shown in FIGS. 13A-13B (SEQ ID NO:13) or a fragment of the fusion, or a sequence substantially identical thereto.

In one embodiment, the nucleic acid molecule is complementary to at least a portion of a nucleotide sequence disclosed herein, e.g., is capable of hybridizing under a stringency condition described herein to SEQ ID NO:11 and/or SEQ ID NO:13, or a fragment thereof. In yet another embodiment, the nucleic acid molecule hybridizes to a nucleotide sequence that is complementary to at least a portion of a nucleotide sequence disclosed herein, e.g., is capable of hybridizing under a stringency condition to a nucleotide sequence complementary to SEQ ID NO:11 and/or SEQ ID NO:13, or a fragment thereof. The nucleotide sequence of a cDNA encoding an exemplary 5' CNTLN-3' RAF1 fusion is shown in at least exon 5 (e.g., exons 1-5) of SEQ ID NO:11 and at least exon 8 (e.g., exons 8-17) of SEQ ID NO:13, and the predicted amino acid sequence is shown in the corresponding encoded exons of SEQ ID NO:12 and the corresponding encoded exons of SEQ ID NO:14, respectively.

In an embodiment the CNTLN-RAF1nucleic acid molecule comprises sufficient CNTLN and sufficient RAF1 sequence such that the encoded 5' CNTLN-3' RAF1 fusion has kinase activity, e.g., has elevated activity, e.g., RAF1 kinase activity, as compared with wild type RAF1, e.g., in a cell of a cancer referred to herein. In certain embodiments, the 5' CNTLN-3' RAF1 fusion comprises exons 1-5 from CNTLN and exons 8-17 from RAF1. In certain embodiments, the CNTLN-RAF1 fusion comprises at least 1, 2, 3, 4, 5 or more exons from CNTLN and at least 1, 2, 3, 4, 5, 6, 7, 9, or more, exons from RAF1. In certain embodiments, the CNTLN-RAF1 fusion comprises a fusion of exon 5 from CNTLN and exon 8 from RAF1. In another embodiment, the CNTLN-RAF1 fusion comprises at least 1, 2, 3, 4, 5 exons from CNTLN; and at least 1, 2, 3, 4, 5, 6, 7, 9 exons from RAF1.

In one embodiment, the nucleic acid molecule includes a nucleotide sequence that has an in-frame fusion of intron 5 of CNTLN (e.g., NM_017738) with intron 7 of RAF1 (e.g., NM_002880). In another embodiment, the nucleic acid molecule includes a nucleotide sequence that includes a breakpoint. For example, the nucleic acid molecule includes a nucleotide sequence that includes the fusion junction between the CNTLN gene and the RAF1 gene, e.g., the breakpoint between intron 5 of CNTLN and intron 7 of RAF1. In other embodiments, the nucleic acid molecules includes a nucleotide sequence of one or more of nucleotide 12,643,880 of chromosome 3 coupled to (e.g., directly or indirectly juxtaposed to) one or more of nucleotide 17,238, 200 of chromosome 9. In one embodiment, the nucleic acid molecule includes the nucleotide sequence of: chromosome 3 at one or more of nucleotide 12,643,880 plus or minus 10, 20, 30, 40 50, 60, 80, 100, 150 nucleotides and chromosome 9 at one or more of nucleotide 17,238,200 plus or minus 10, 20, 30, 40 50, 60, 80, 100, 150 nucleotides (corresponding to the breakpoint of a CNTLN-RAF1 fusion), or a fragment thereof, or a sequence substantially identical thereto. In one embodiment, the nucleic acid molecule is complementary to at least a portion of a nucleotide sequence disclosed herein, e.g., is capable of hybridizing under a stringency condition described herein to SEQ ID NO:11 and/or SEQ ID NO:13 or a fragment thereof. In yet other embodiment, the nucleic acid molecule hybridizes to a nucleotide sequence that is complementary to at least a portion of a nucleotide sequence disclosed herein, e.g., is capable of hybridizing under a stringency condition described herein to a nucleotide sequence complementary to SEQ ID NO:11 or 13 or a fragment thereof.

In another embodiment, the CNTLN-RAF1 fusion nucleic acid comprises at least 6, 12, 15, 20, 25, 50, 75, 100 or more nucleotides from exon 5 of CNTLN (e.g., from the nucleotide sequence of CNTLN preceding the fusion junction with RAF1, e.g., of the CNTLN sequence shown in FIGS. 11A-11C (SEQ ID NO:11)), and at least 6, 12, 15, 20, 25, 50, 75, 100 or more nucleotides from exon 8 of RAF1 (e.g., from the nucleotide sequence of RAF1 following the fusion junction with CNTLN, e.g., of the RAF1 sequence shown in FIGS. 13A-13C (SEQ ID NO:13)).

In other embodiments, the nucleic acid molecule includes a nucleotide sequence encoding a CNTLN-RAF1 fusion polypeptide that includes a fragment of a CNTLN gene and a fragment of an RAF1 gene. In one embodiment, the nucleotide sequence encodes a CNTLN-RAF1 fusion polypeptide that includes e.g., an RAF1 tyrosine kinase domain or a functional fragment thereof. In yet other embodiments, the nucleic acid molecule includes a nucleotide sequence encoding the amino acid sequence (e.g., a fragment of the amino acid sequence) shown in FIG. 12 (e.g., SEQ ID NO:12) and a nucleotide sequence encoding the amino acid sequence (e.g., a fragment of the amino acid sequence) shown in FIG. 14 (e.g., SEQ ID NO:14), or a fragment of the fusion, or a sequence substantially identical thereto. In one embodiment, the encoded CNTLN-RAF1 fusion polypeptide includes an RAF1 tyrosine kinase domain or a functional fragment thereof.

In a related aspect, the invention features nucleic acid constructs that include the CNTLN-RAF1 nucleic acid molecules described herein. In certain embodiments, the nucleic acid molecules are operatively linked to a native or a heterologous regulatory sequence. Also included are vectors and host cells that include the CNTLN-RAF1 nucleic acid molecules described herein, e.g., vectors and host cells suitable for producing the nucleic acid molecules and polypeptides described herein.

In a related aspect, methods of producing the nucleic acid molecules and polypeptides described herein are also described.

In another aspect, the invention features nucleic acid molecules that reduce or inhibit the expression of a nucleic acid molecule that encodes a CNTLN-RAF1 fusion described herein. Examples of such nucleic acid molecules include, for example, antisense molecules, ribozymes, RNAi, triple helix molecules that hybridize to a nucleic acid encoding CNTLN-RAF1, or a transcription regulatory region of CNTLN-RAF1, and blocks or reduces mRNA expression of CNTLN-RAF1.

Nucleic Acid Detection and Capturing Reagents

The invention also features a nucleic acid molecule, e.g., nucleic acid fragment, suitable as probe, primer, bait or library member that includes, flanks, hybridizes to, which are useful for identifying, or are otherwise based on, the CNTLN-RAF1 fusions described herein. In certain embodiments, the probe, primer or bait molecule is an oligonucleotide that allows capture, detection or isolation of a CNTLN-RAF1 fusion nucleic acid molecule described herein. The oligonucleotide can comprise a nucleotide sequence substantially complementary to a fragment of the CNTLN-RAF1 fusion nucleic acid molecules described herein. The sequence identity between the nucleic acid fragment, e.g., the oligonucleotide, and the target CNTLN-RAF1 sequence need not be exact, so long as the sequences are sufficiently complementary to allow the capture, detection or isolation of the target sequence. In one embodiment, the nucleic acid fragment is a probe or primer that includes an oligonucleotide between about 5 and 25, e.g., between 10 and 20, or 10 and 15 nucleotides in length. In other embodiments, the nucleic acid fragment is a bait that includes an oligonucleotide between about 100 to 300 nucleotides, 130 and 230 nucleotides, or 150 and 200 nucleotides, in length.

In one embodiment, the nucleic acid fragment can be used to identify or capture, e.g., by hybridization, a CNTLN-RAF1 fusion. For example, the nucleic acid fragment can be a probe, a primer, or a bait, for use in identifying or capturing, e.g., by hybridization, a CNTLN-RAF1 fusion described herein. In one embodiment, the nucleic acid fragment can be useful for identifying or capturing a CNTLN-RAF1 breakpoint, e.g., the nucleotide sequence of: chromosome 3 at nucleotide 12,643,880 plus or minus 10, 20, 30, 40, 50, 60, 80, 100, 150 nucleotides and chromosome 9 at nucleotide 17,238,200 plus or minus 10, 20, 30, 40 50, 60, 80, 100, 150 nucleotides.

In one embodiment, the nucleic acid fragment hybridizes to a nucleotide sequence within a chromosomal rearrangement that creates an in-frame fusion of intron 5 of CNTLN with intron 7 of RAF1. In one embodiment, the nucleic acid fragment hybridizes to a nucleotide sequence in the region In other embodiments, the nucleic acid molecules includes a nucleotide sequence in the region of nucleotides 12,643,880 of chromosome 3 coupled to (e.g., juxtaposed to) nucleotides in the region of nucleotides 17,238,200 of chromosome 9. In one embodiment, the nucleic acid fragment hybridizes to a nucleotide sequence that includes a breakpoint, e.g., the nucleotide sequence of: chromosome 3 at nucleotide 12,643,880 plus or minus 10, 20, 30, 40 50, 60, 80, 100, 150 or more nucleotides and chromosome 9 at nucleotide 17,238,200 plus or minus 10, 20, 30, 40 50, 60, 80, 100, 150 or more nucleotides. For example, the nucleic acid fragment can hybridize to a nucleotide sequence that includes the fusion junction between the CNTLN gene and the RAF1 gene, e.g., a nucleotide sequence that includes a portion of a nucleotide sequence within intron 5 of a CNTLN gene and 7 of a RAF1 gene.

In another embodiment, the nucleic acid fragment hybridizes to a nucleotide sequence that comprises at least 6, 12, 15, 20, 25, 50, 75, 100, 150 or more nucleotides from exon 5 of CNTLN (e.g., from the nucleotide sequence of CNTLN preceding the fusion junction with RAF1, e.g., of the CNTLN sequence shown in FIGS. 11A-11C (SEQ ID NO:11)), and at least 6, 12, 15, 20, 25, 50, 75, 100, 150 or more nucleotides from exon 8 of RAF1 (e.g., from the nucleotide sequence of RAF1 following the fusion junction with CNTLN, e.g., of the RAF1 sequence shown in FIGS. 13A-13B (SEQ ID NO:13)).

The probes or primers described herein can be used, for example, for FISH detection or PCR amplification. In one exemplary embodiment where detection is based on PCR, amplification of the CNTLN-RAF1 fusion junction fusion junction can be performed using a primer or a primer pair, e.g., for amplifying a sequence flanking the fusion junctions described herein, e.g., the mutations or the junction of a chromosomal rearrangement described herein, e.g., CNTLN-RAF1.

In one embodiment, a pair of isolated oligonucleotide primers can amplify a region containing or adjacent to a position in the CNTLN-RAF1 fusion. For example, forward primers can be designed to hybridize to a nucleotide sequence within CNTLN genomic or mRNA sequence (e.g., a nucleotide sequence within exon 5 of CNTLN of SEQ ID NO:11), and the reverse primers can be designed to hybridize to a nucleotide sequence of RAF1 (e.g., a nucleotide sequence within exon 8 of RAF1, of SEQ ID NO:13).

In another embodiment, the nucleic acid fragments can be used to identify, e.g., by hybridization, a CNTLN-RAF1 fusion. In one embodiment, the nucleic acid fragment hybridizes to a nucleotide sequence that includes a fusion junction between the CNTLN transcript and the RAF1 transcript.

In other embodiments, the nucleic acid fragment includes a bait that comprises a nucleotide sequence that hybridizes to a CNTLN-RAF1 fusion nucleic acid molecule described herein, and thereby allows the capture or isolation said nucleic acid molecule. In one embodiment, a bait is suitable for solution phase hybridization. In other embodiments, a bait includes a binding entity, e.g., an affinity tag, that allows capture and separation, e.g., by binding to a binding entity, of a hybrid formed by a bait and a nucleic acid hybridized to the bait.

In other embodiments, the nucleic acid fragment includes a library member comprising a CNTLN-RAF1 nucleic acid molecule described herein. In one embodiment, the library member includes a rearrangement that results in a CNTLN-RAF1 fusion described herein.

The nucleic acid fragment can be detectably labeled with, e.g., a radiolabel, a fluorescent label, a bioluminescent label, a chemiluminescent label, an enzyme label, a binding pair label, or can include an affinity tag; a tag, or identifier (e.g., an adaptor, barcode or other sequence identifier).

CNTLN-RAF1 Fusion Polypeptides

In another embodiment, the CNTLN-RAF1 fusion comprises an amino acid sequence (e.g., a fragment of the amino acid sequence) shown in FIGS. 12A-12C (SEQ ID NO:12) and an amino acid sequence (e.g., a fragment of the amino acid sequence) shown in FIG. 14 (SEQ ID NO:14), or a fragment of the fusion. In one embodiment, the CNTLN-RAF1 fusion comprises an amino acid sequence substantially identical to the amino acid sequence (e.g., a fragment of the amino acid sequence) shown in FIG. 12 (SEQ ID NO:12) and the amino acid sequence (e.g., a fragment of the amino acid sequence) shown in FIG. 14 (SEQ ID NO:14), or a fragment thereof. In one embodiment, the CNTLN-RAF1 fusion comprises an amino acid sequence at least 70%, at least 75%, at least 80%, at least 85%, at least 90%, at least 95%, at least 99%, at least 99.5 or greater, identical to the amino acid sequence (e.g., a fragment of the amino acid sequence) shown in FIG. 12 (SEQ ID NO:12) and the amino acid sequence (e.g., a fragment of the amino acid sequence) shown in FIG. 14 (SEQ ID NO:14). In one embodiment, the CNTLN-RAF1 fusion comprises a sequence containing at least 10, 20, 50, 100, 500, 600, 700, 800, 900, 1000, or more amino acids of the amino acid sequence shown in FIG. 12 (SEQ ID NO:12) and FIG. 14 (SEQ ID NO:14). In one embodiment, the CNTLN-RAF1 fusion comprises an amino acid sequence containing at least 5, 10, 20, 50, 100, 500, 600, 700, 800, 900, 1000, or more contiguous amino acids of the amino acid sequence shown in FIG. 12 (SEQ ID NO:12) and at least 5, 10, 20, 50, 100, 500, 600, 700, 800, 900, 1000, or more contiguous amino acids of the amino acid sequence shown in FIG. 14 (SEQ ID NO:14). In one embodiment, the 5' CNTLN-3' RAF1 fusion polypeptide includes a RAF1 receptor tyrosine kinase domain or a functional fragment thereof. In an embodiment, the 5'CNTLN-3'RAF1 fusion polypeptide comprises sufficient RAF1 and sufficient CNTLN sequence such that it has kinase activity, e.g., has elevated activity, e.g., RAF1 kinase activity, as compared with wild type RAF1, e.g., in a cell of a cancer referred to herein.

In another aspect, the invention features a CNTLN-RAF1 fusion polypeptide (e.g., a purified CNTLN-RAF1 fusion polypeptide), a biologically active or antigenic fragment thereof, as well as reagents (e.g., antibody molecules that bind to a CNTLN-RAF1 fusion polypeptide), methods for modulating a CNTLN-RAF1 polypeptide activity and detection of a CNTLN-RAF1 polypeptide.

In one embodiment, the CNTLN-RAF1 fusion polypeptide has at least one biological activity, e.g., an RAF1 kinase activity. In one embodiment, at least one biological activity of the CNTLN-RAF1 fusion polypeptide is reduced or inhibited by an anti-cancer drug, e.g., a kinase inhibitor (e.g., a multikinase inhibitor or an RAF1-specific inhibitor). In one embodiment, at least one biological activity of the CNTLN-RAF1 fusion polypeptide is reduced or inhibited by an RAF1 kinase inhibitor chosen from e.g., sorafenib (nexavar); PLX-4720; or regorafenib (BAY 73-4506).

In yet other embodiments, the CNTLN-RAF1 fusion polypeptide is encoded by a nucleic acid molecule described herein. In one embodiment, the CNTLN-RAF1 fusion polypeptide is encoded by an in-frame fusion of intron 5 of CNTLN with intron 7 of RAF1 (e.g., a sequence on chromosome 3 or a sequence on chromosome 9). In another embodiment, the CNTLN-RAF1 fusion polypeptide includes an amino acid sequence encoded by a nucleotide sequence comprising a fusion junction between the CNTLN transcript and the RAF1 transcript.

In certain embodiments, the CNTLN-RAF1 fusion polypeptide comprises one or more of encoded exons 1-5 from CNTLN and one or more of encoded exons 8-17 of RAF1. In certain embodiments, the CNTLN-RAF1 fusion polypeptide comprises at least 1, 2, 3, 4, 5 or more encoded exons from CNTLN and at least 1, 2, 3, 4, 5, 6, 7, 9 or more, encoded exons from RAF1. In certain embodiments, the CNTLN-RAF1 fusion polypeptide comprises a fusion of encoded exon 5 from CNTLN and encoded exon 8 from RAF1 (or a fragment thereof). In other embodiments, the fusion comprises least 1, 2, 3, 4, 5 encoded exons from CNTLN; and at least 1, 2, 3, 4, 5, 6, 7, 9 encoded exons from RAF1. In certain embodiments, the CNTLN-RAF1 fusion polypeptide comprises encoded exons 1-5 from CNTLN and exons 8-17 of RAF1. In certain embodiments, the 5' CNTLN-3' RAF1 fusion polypeptide comprises a fusion junction of the sequence of exon 5 from CNTLN and the sequence of exon 8 from RAF1.

In certain embodiments, the CNTLN-RAF1 fusion comprises the amino acid sequence corresponding to exon 5 or a fragment thereof from CNTLN, and the amino acid sequence corresponding to exon 8 or a fragment thereof from RAF1 (e.g., as shown in FIG. 12 (SEQ ID NO:12) and FIG. 14 (SEQ ID NO:14)). In one embodiment, the CNTLN-RAF1 fusion comprises at least 5, 10, 15, 20 or more amino acids from exon 5 of CNTLN (e.g., from the amino acid sequence of CNTLN preceding the fusion junction with RAF1, e.g., of the CNTLN sequence shown in FIG. 12 (SEQ ID NO:12)), and at least 5, 10, 15, 20 or more amino acids from exon 8 of RAF1 (e.g., from the amino acid sequence of RAF1 following the fusion junction with CNTLN, e.g., of the RAF1 sequence shown in FIG. 14 (SEQ ID NO:14)).

In one embodiment, the CNTLN-RAF1 fusion polypeptide includes a RAF1 tyrosine kinase domain or a functional fragment thereof. In a related aspect, the invention features CNTLN-RAF1 fusion polypeptide or fragments operatively linked to heterologous polypeptides to form fusion proteins.

In another embodiment, the CNTLN-RAF1 fusion polypeptide or fragment is a peptide, e.g., an immunogenic peptide or protein, that contains a fusion junction described herein. Such immunogenic peptides or proteins can be used to raise antibodies specific to the fusion protein. In other embodiments, such immunogenic peptides or proteins can be used for vaccine preparation. The vaccine preparation can include other components, e.g., an adjuvant.

In another aspect, the invention features antibody molecules that bind to a CNTLN-RAF1 fusion polypeptide or fragment described herein. In embodiments, the antibody can distinguish wild type RAF1 (or CNTLN) from CNTLN-RAF1.

Detection Reagents and Detection of Mutations

In another aspect, the invention features a detection reagent, e.g., a purified or an isolated preparation thereof. Detection reagents can distinguish a nucleic acid, or protein sequence, having a breakpoint, e.g., a CNTLN-RAF1 breakpoint; from a reference sequence. In one embodiment, the detection reagent detects (e.g., specifically detects) a CNTLN-RAF1 fusion nucleic acid or a polypeptide (e.g., distinguishes a wild type RAF1 or another RAF1 fusion (or CNTLN) from a CNTLN-RAF1 nucleic acid (e.g., as described herein in FIGS. 11A-11C (SEQ ID NO:11) or FIGS. 13A-13B (SEQ ID NO:13); or a CNTLN-RAF1 polypeptide (e.g., as described herein in FIG. 12 (SEQ ID NO:12) or FIG. 14 (SEQ ID NO:14).

Detection reagents, e.g., nucleic acid-based detection reagents, can be used to identify mutations in a target nucleic acid, e.g., DNA, e.g., genomic DNA or cDNA, or RNA, e.g., in a sample, e.g., a sample of nucleic acid derived from a neoplastic or tumor cell, e.g., a melanocytic neoplasm, melanoma or metastatic cell. Detection reagents, e.g., antibody-based detection reagents, can be used to identify mutations in a target protein, e.g., in a sample, e.g., a sample of protein derived from, or produced by, a neoplastic or tumor cell, e.g., a melanocytic neoplasm, melanoma or metastatic cell.

Method of Treatment

RAF1 encodes c-Raf, a member of the Raf family of signaling kinases (Gollob J A, Wilhelm S, Carter C, et al. (2006) Role of Raf kinase in cancer: therapeutic potential of targeting the Raf/MEK/ERK signal transduction pathway. Semin Oncol 33(4):392-406). These kinases are downstream of RAS and activate the MEK-ERK signaling pathway that promotes cell proliferation and survival (Maurer G, Tarkowski B, Baccarini M (2011) Raf kinases in cancer-roles and therapeutic opportunities. Oncogene 30(32):3477-88). Based on similarity to another RAF1 fusion protein, SRGAP3-RAF1 (Jones D T, Kocialkowski S, Liu L, et al. (2009) Oncogenic RAF1 rearrangement and a novel BRAF mutation as alternatives to KIAA1549:BRAF fusion in activating the MAPK pathway in pilocytic astrocytoma. Oncogene 28(20):2119-23), the CNTLN-RAF1 rearrangement reported herein is expected to result in an activated Raf1 kinase (also known as Craf). RAF1 alterations have not been reported in soft tissue tumors (COSMIC, September 2012). Sorafenib is a Raf1/Craf inhibitor that is FDA-approved in other tumor types, and evidence suggests that some Raf1 fusions may be sensitive to Sorafenib (Palanisamy N, Ateeq B, Kalyana-Sundaram S, et al. (2010) Rearrangements of the RAF kinase pathway in prostate cancer, gastric cancer and melanoma. Nat Med 16(7):793-8). Other Raf1/Craf inhibitors are currently in clinical development. In addition, activation of Raf1 kinase leads to the downstream activation of Mek. Trials of Mek inhibitors may be relevant for tumors with constitutive Raf1 activation.

Accordingly, in another aspect, a method of inhibiting, reducing, or treating a hyperproliferative disorder, e.g., a neoplasm (including benign, pre-malignant or malignant (e.g., a cancer), in a subject is provided. The method includes administering to the subject a preselected therapeutic agent, e.g., an anti-cancer agent (e.g., a kinase inhibitor), as a single agent, or in combination, in an amount sufficient to reduce, inhibit or treat the activity or expression of CNTLN-RAF1 (e.g., a CNTLN-RAF1 fusion described herein), thereby inhibiting, reducing, or treating the hyperproliferative disorder in the subject.

In one embodiment, the subject treated has a CNTLN-RAF1 fusion; e.g., the subject has a tumor or cancer harboring a CNTLN-RAF1 fusion. In other embodiments, the subject has been previously identified as having a CNTLN-RAF1 fusion. In yet other embodiments, the subject has been previously identified as being likely or unlikely to respond to treatment with a protein kinase inhibitor, e.g., a subject that has previously participated in a clinical trial. In other embodiments, the subject has been previously identified as being likely or unlikely to respond to treatment with a protein kinase inhibitor, based on the presence of the CNTLN-RAF1 fusion. In one embodiment, the subject is a mammal, e.g., a human. In one embodiment, the subject has, or at risk of having a cancer at any stage of disease. In other embodiments, the subject is a patient, e.g., a cancer patient.

In certain embodiments, the neoplasm or neoplastic cell is a benign, pre-malignant, malignant (cancer) or metastasis. In certain embodiments, the cancer is a solid tumor, a soft tissue tumor, or a metastatic lesion.

In one embodiment, the neoplasm or neoplastic cell is a benign, pre-malignant, malignant (cancer) or metastasis. In certain embodiments, the cancer is a solid tumor, a soft tissue tumor, or a metastatic lesion. In one embodiment, the cancer is a sarcoma. In one embodiment, the cancer is a spindle cell sarcoma. In one embodiment, the cancer is chosen from a lung cancer, a pancreatic cancer, melanoma, a colorectal cancer, an esophageal-gastric cancer, a thyroid cancer, or an adenocarcinoma. In one embodiment, the cancer is an adenocarcinoma. In one embodiment, the cancer is a lung adenocarcinoma. In other embodiment, the lung cancer is chosen from one or more of the following: non-small cell lung cancer (NSCLC), small cell lung cancer (SCLC), squamous cell carcinoma (SCC), adenocarcinoma of the lung, bronchogenic carcinoma, or a combination thereof. In one embodiment, the lung cancer is NSCLC or SCC.

In one embodiment, the anti-cancer agent is a kinase inhibitor. For example, the kinase inhibitor is a multi-kinase inhibitor or a RAF1-specific inhibitor. In one embodiment, the kinase inhibitor is a RAF1 inhibitor including, but not limited to, GDC-0973, GDC-0941, sorafenib (nexavar); PLX-4720; XL281, LGX818, U0126; or regorafenib (BAY 73-4506). In certain embodiments, the RAF1 inhibitor is a MEK inhibitor. In certain embodiments, the MEK inhibitor is a MEK inhibitor described herein. In certain embodiments, the RAF1 inhibitor is a RAF1 inhibitor described herein.

TRIM33-RAF1 Fusions

In one embodiment, a fusion includes an in-frame fusion of an exon of tripartite motif containing 33 protein (TRIM33), e.g., one more exons of TRIM33 (e.g., one or more of exons 1-9 of TRIM33) or a fragment thereof, and an exon of v-raf-1 murine leukemia viral oncogene homolog 1 (RAF1), e.g., one or more exons of a RAF1 (e.g., one or more of exons 10-17 of RAF1) or a fragment thereof. For example, the TRIM33-RAF1 fusion can include an in-frame fusion within an intron of TRIM33 (e.g., intron 9) or a fragment thereof, with an intron of RAF1 (e.g., intron 9) or a fragment thereof. In one embodiment, the fusion of the TRIM33-RAF1 fusion comprises the nucleotide sequence of: chromosome 3 at one or more of nucleotide 12,641,441 (plus or minus 10, 20, 30, 50, 60, 70, 80, 100 or more nucleotides) and chromosome 1 at one or more of nucleotide 114,967,300 (plus or minus 10, 20, 30, 50, 60, 70, 80, 100 or more nucleotides). In one embodiment, the TRIM33-RAF1 fusion is a translocation, e.g., a translocation of a portion of chromosome 3 and a portion of chromosome 1.

In certain embodiments, the TRIM33-RAF1 fusion is in a 5'-TRIM33 to 3'-RAF1 configuration (also referred to herein as "5'-TRIM33-RAF1-3')." The term "fusion" or "fusion molecule" can refer to a polypeptide or a nucleic acid fusion, depending on the context. It may include a full-length sequence of a fusion or a fragment thereof, e.g., a fusion junction (e.g., a fragment including a portion of TRIM33 and a portion of RAF1, e.g., a portion of the TRIM33-RAF1 fusion described herein). In one embodiment, the TRIM33-RAF1 fusion polypeptide includes a fragment of the amino acid sequence shown in FIG. 16 (SEQ ID NO:16) and a fragment of the amino acid sequence shown in FIG. 14 (SEQ ID NO:14), or an amino acid sequence substantially identical thereto. In another embodiment, the TRIM33-RAF1 fusion nucleic acid includes a fragment of the nucleotide sequence shown in FIGS. 15A-15D (SEQ ID NO:15) and a fragment of the nucleotide sequence shown in FIGS. 13A-13B (SEQ ID NO:13), or a nucleotide sequence substantially identical thereto. In one embodiment, the TRIM33-RAF1 fusion polypeptide comprises sufficient TRIM33 and sufficient RAF1 sequence such that the 5' TRIM33-3' RAF1 fusion has kinase activity, e.g., has elevated activity, e.g., RAF1 tyrosine kinase activity, as compared with wild type RAF1, e.g., in a cell of a cancer referred to herein (e.g., carcinoma, e.g., fibrosarcoma, e.g., ameloblastic fibrosarcoma).

In certain embodiments, the TRIM33-RAF1 fusion comprises one or more (or all of) exons 1-9 from TRIM33 and one or more (or all of) exons 10-17 of RAF1 (e.g., one or more of the exons shown in FIGS. 15A-15C (SEQ ID NO:15) and FIGS. 13A-13C (SEQ ID NO:13). In another embodiment, the TRIM33-RAF1 fusion comprises one or more (or all of) exons 1-9 of TRIM33 and one or more (or all of) exons 10-17 of RAF1. In certain embodiments, the TRIM33-RAF1 fusion comprises at least 1, 2, 3, 4, 5, 6, 7, 8, 9, or more exons (or encoded exons) from TRIM33 and at least 1, 2, 3, 4, 5, 6, 7, 8, 9 or more exons (or encoded exons) from RAF1 (e.g., from the TRIM33 and RAF1 sequences shown in FIGS. 15A-15D and FIG. 16 (SEQ ID NO:15 and 16) and FIGS. 13A-13B and FIG. 14 (SEQ ID NOs:13 and 14).

In certain embodiments, the TRIM33-RAF1 fusion comprises exon 9 or a fragment thereof from TRIM33, and exon 10 or a fragment thereof from RAF1 (e.g., as shown in FIGS. 15A-15D (SEQ ID NO:15) and FIGS. 13A-13B (SEQ ID NO:13)). In one embodiment, the TRIM33-RAF1 fusion comprises at least 5, 10, 15, 20, 30, 40, 50 or more amino acids encoded from exon 9 of TRIM33 (e.g., from the amino acid sequence of TRIM33 as shown in FIG. 16 (SEQ ID NO:16) (e.g., from the amino acid sequence of TRIM33 preceding the fusion junction with RAF1, and at least 5, 10, 15, 20, 30, 40, 50 or more amino acids encoded from exon 10 of RAF1 (e.g., from the amino acid sequence of RAF1 as shown in FIG. 14 (SEQ ID NO:14)). In another embodiment, the TRIM33-RAF1 fusion comprises at least 6, 12, 15, 20, 25, 50, 75, 100 or more nucleotides from exon 9 of TRIM33 (e.g., from the nucleotide sequence of TRIM33 as shown in FIGS. 15A-15D (SEQ ID NO:15) (e.g., from the nucleotide sequence of TRIM33 preceding the fusion junction with RAF1); and at least 6, 12, 15, 20, 25, 50, 75, 100 or more nucleotides from exon 10 of RAF1 (e.g., from the nucleotide sequence of RAF1 as shown in FIGS. 13A-13B (SEQ ID NO:13)).

TRIM33-RAF1 Nucleic Acid Molecules

In one aspect, the invention features a nucleic acid molecule (e.g., an isolated or purified) nucleic acid molecule that includes a fragment of a TRIM33 gene and a fragment of a RAF1 gene. In one embodiment, the nucleotide sequence encodes a TRIM33-RAF1 fusion polypeptide that includes a RAF1 tyrosine kinase domain or a functional fragment thereof. In another embodiment, the nucleotide sequence encodes a fragment of the RAF1 polypeptide including the amino acid sequence of SEQ ID NO:14 or a fragment thereof, or a sequence substantially identical thereto. In other embodiments, the nucleic acid molecule includes a fragment of the TRIM33 gene encoding the amino acid sequence of SEQ ID NO:16 or a fragment thereof, or a sequence substantially identical thereto. In yet other embodiments, the nucleic acid molecule includes a nucleotide sequence encoding the amino acid sequence shown in FIG. 16 (SEQ ID NO:16), or a fragment thereof, and the amino acid sequence shown in FIG. 14 (SEQ ID NO:14) or a fragment thereof, or a sequence substantially identical thereto.

In one embodiment, the nucleic acid molecule includes a fusion, e.g., an in-frame fusion, between an intron of TRIM33 (e.g., intron 9, or a fragment thereof), and an intron of RAF1 (e.g., intron 9, or a fragment thereof). The TRIM33-RAF1 fusion can comprise a fusion of the nucleotide sequence of: chromosome 3 at one or more of nucleotide 12,641,441 (plus or minus 10, 20, 30, 50, 60, 70, 80, 100 nucleotides) and chromosome 1 at one or more of nucleotide 114,967,300 (plus or minus 10, 20, 30, 50, 60, 70, 80, 100 nucleotides), or a fragment thereof. In one embodiment, the TRIM33-RAF1 fusion comprises a fusion of the nucleotide sequence of: chromosome 3 at one or more of nucleotide 12,641,441 (plus or minus 10, 20, 30, 50, 60, 70, 80, 100 nucleotides) and chromosome 1 at one or more of nucleotide 114,967,300 (plus or minus 10, 20, 30, 50, 60, 70, 80, 100 nucleotides), or a fragment thereof.

In another embodiment, the TRIM33-RAF1 fusion comprises a nucleotide sequence (e.g., a fragment of a nucleotide sequence) shown in FIGS. 15A-15C (SEQ ID NO:15) and a nucleotide sequence (e.g., a fragment of a nucleotide sequence) shown in FIGS. 13A-13B (SEQ ID NO:13), or a fragment of the fusion. In one embodiment, the TRIM33-RAF1 fusion comprises a nucleotide sequence substantially identical to the nucleotide sequence (e.g., a fragment of a nucleotide sequence) shown in FIGS. 15A-15D (SEQ ID NO:15) and the nucleotide sequence (e.g., a fragment of a nucleotide sequence) shown FIGS. 13A-13B (SEQ ID NO:13), or a fragment of the fusion. In one embodiment, the TRIM33-RAF1 fusion comprises a nucleotide sequence at least 70%, at least 75%, at least 80%, at least 85%, at least 90%, at least 95%, at least 99%, at least 99.5 or greater, identical to the nucleotide sequence (e.g., a fragment of a nucleotide sequence) shown in FIGS. 15A-15D (SEQ ID NO:15) and to the nucleotide sequence (e.g., a fragment of a nucleotide sequence) shown in FIGS. 13A-13B (SEQ ID NO:13). In one embodiment, the TRIM33-RAF1 fusion comprises a nucleotide sequence containing at least 25, 50, 100, 150, 200, 500, 1000, 1500, 2000, 2500, 3000, or more nucleotides of the nucleotide sequence shown in FIGS. 15A-15D (SEQ ID NO:15) and a nucleotide sequence containing at least 25, 50, 100, 150, 200, 500, 1000, 1500, 2000, 2500, 3000, or more nucleotides of the nucleotide sequence shown in FIGS. 13A-13B (SEQ ID NO:13). In one embodiment, the TRIM33-RAF1 fusion comprises a nucleotide sequence containing at least 25, 50, 100, 150, 200, 500, 1000, 1500, 2000, 2500, 3000, or more contiguous nucleotides of the nucleotide sequence shown in FIGS. 15A-15D (SEQ ID NO:15) and a nucleotide sequence containing at least 25, 50, 100, 150, 200, 500, 1000, 1500, 2000, 2500, 3000, or more nucleotides of the nucleotide sequence shown in FIGS. 13A-13B (SEQ ID NO:13).

In another embodiment, the nucleic acid molecule includes a fusion, e.g., an in-frame fusion, of at least exon 9 of TRIM33 or a fragment thereof (e.g., one or more of exons 1-9 of TRIM33 or a fragment thereof), and at least exon 10 or a fragment thereof (e.g., one or more of exons 10-17 of RAF1 or a fragment thereof). In yet other embodiments, the nucleic acid molecule includes a fragment the nucleotide sequence shown in FIGS. 15A-15D (SEQ ID NO:15) and a fragment of the nucleotide sequence shown in FIGS. 13A-13B (SEQ ID NO:13) or a fragment of the fusion, or a sequence substantially identical thereto.

In one embodiment, the nucleic acid molecule is complementary to at least a portion of a nucleotide sequence disclosed herein, e.g., is capable of hybridizing under a stringency condition described herein to SEQ ID NO:15 and/or SEQ ID NO:13, or a fragment thereof. In yet another embodiment, the nucleic acid molecule hybridizes to a nucleotide sequence that is complementary to at least a portion of a nucleotide sequence disclosed herein, e.g., is capable of hybridizing under a stringency condition to a nucleotide sequence complementary to SEQ ID NO:15 and/or SEQ ID NO:13, or a fragment thereof. The nucleotide sequence of a cDNA encoding an exemplary 5' TRIM33-3' RAF1 fusion is shown in at least exon 9 (e.g., exons 1-9) of SEQ ID NO:15 and at least exon 10 (e.g., exons 10-17) of SEQ ID NO:13, and the predicted amino acid sequence is shown in the corresponding encoded exons of SEQ ID NO:16 and the corresponding encoded exons of SEQ ID NO:14, respectively.

In an embodiment the TRIM33-RAFlnucleic acid molecule comprises sufficient TRIM33 and sufficient RAF1 sequence such that the encoded 5' TRIM33-3' RAF1 fusion has kinase activity, e.g., has elevated activity, e.g., RAF1 kinase activity, as compared with wild type RAF1, e.g., in a cell of a cancer referred to herein. In certain embodiments, the 5' TRIM33-3' RAF1 fusion comprises exons 1-9 from TRIM33 and exons 10-17 from RAF1. In certain embodiments, the TRIM33-RAF1 fusion comprises at least 1, 2, 3, 4, 5, 6, 7, 8, 9 or more exons from TRIM33 and at least 1, 2, 3, 4, 5, 6, 7, 9, or more, exons from RAF1. In certain embodiments, the TRIM33-RAF1 fusion comprises a fusion of exon 9 from TRIM33 and exon 10 from RAF1. In another embodiment, the TRIM33-RAF1 fusion comprises at least 1, 2, 3, 4, 5, 6, 7, 8, 9 exons from TRIM33; and at least 1, 2, 3, 4, 5, 6, 7, 9 exons from RAF1.

In one embodiment, the nucleic acid molecule includes a nucleotide sequence that has an in-frame fusion of intron 9 of TRIM33 (e.g., NM_015906) with intron 9 of RAF1 (e.g., NM_002880). In another embodiment, the nucleic acid molecule includes a nucleotide sequence that includes a breakpoint. For example, the nucleic acid molecule includes a nucleotide sequence that includes the fusion junction between the TRIM33 gene and the RAF1 gene, e.g., the breakpoint between intron 9 of TRIM33 and intron 9 of RAF1. In other embodiments, the nucleic acid molecules includes a nucleotide sequence of one or more of nucleotide 12,641,441 of chromosome 3 coupled to (e.g., directly or indirectly juxtaposed to) one or more of nucleotide 114,967, 300 of chromosome 1. In one embodiment, the nucleic acid molecule includes the nucleotide sequence of: chromosome 3 at one or more of nucleotide 12,641,441 plus or minus 10, 20, 30, 40 50, 60, 80, 100, 150 nucleotides and chromosome 1 at one or more of nucleotide 114,967,300 plus or minus 10, 20, 30, 40 50, 60, 80, 100, 150 nucleotides (corresponding to the breakpoint of a TRIM33-RAF1 fusion), or a fragment thereof, or a sequence substantially identical thereto.

In one embodiment, the nucleic acid molecule is complementary to at least a portion of a nucleotide sequence disclosed herein, e.g., is capable of hybridizing under a stringency condition described herein to SEQ ID NO:15 and/or SEQ ID NO:13 or a fragment thereof. In yet other embodiment, the nucleic acid molecule hybridizes to a nucleotide sequence that is complementary to at least a portion of a nucleotide sequence disclosed herein, e.g., is capable of hybridizing under a stringency condition described herein to a nucleotide sequence complementary to SEQ ID NO:15 or 13 or a fragment thereof.

In another embodiment, the TRIM33-RAF1 fusion nucleic acid comprises at least 6, 12, 15, 20, 25, 50, 75, 100 or more nucleotides from exon 9 of TRIM33 (e.g., from the nucleotide sequence of TRIM33 preceding the fusion junction with RAF1, e.g., of the TRIM33 sequence shown in FIGS. 15A-15D (SEQ ID NO:15)), and at least 6, 12, 15, 20, 25, 50, 75, 100 or more nucleotides from exon 10 of RAF1 (e.g., from the nucleotide sequence of RAF1 following the fusion junction with TRIM33, e.g., of the RAF1 sequence shown in FIGS. 13A-13B (SEQ ID NO:13)).

In other embodiments, the nucleic acid molecule includes a nucleotide sequence encoding a TRIM33-RAF1 fusion polypeptide that includes a fragment of a TRIM33 gene and a fragment of an RAF1 gene. In one embodiment, the nucleotide sequence encodes a TRIM33-RAF1 fusion polypeptide that includes e.g., an RAF1 tyrosine kinase domain or a functional fragment thereof. In yet other embodiments, the nucleic acid molecule includes a nucleotide sequence encoding the amino acid sequence (e.g., a fragment of the amino acid sequence) shown in FIG. 16 (e.g., SEQ ID NO:16) and a nucleotide sequence encoding the amino acid sequence (e.g., a fragment of the amino acid sequence) shown in FIG. 14 (e.g., SEQ ID NO:14), or a fragment of the fusion, or a sequence substantially identical thereto. In one embodiment, the encoded TRIM33-RAF1 fusion polypeptide includes an RAF1 tyrosine kinase domain or a functional fragment thereof.

In a related aspect, the invention features nucleic acid constructs that include the TRIM33-RAF lnucleic acid molecules described herein. In certain embodiments, the nucleic acid molecules are operatively linked to a native or a heterologous regulatory sequence. Also included are vectors and host cells that include the TRIM33-RAF1 nucleic acid molecules described herein, e.g., vectors and host cells suitable for producing the nucleic acid molecules and polypeptides described herein.

In a related aspect, methods of producing the nucleic acid molecules and polypeptides described herein are also described.

In another aspect, the invention features nucleic acid molecules that reduce or inhibit the expression of a nucleic acid molecule that encodes a TRIM33-RAF1 fusion described herein. Examples of such nucleic acid molecules include, for example, antisense molecules, ribozymes, RNAi, triple helix molecules that hybridize to a nucleic acid encoding TRIM33-RAF1, or a transcription regulatory region of TRIM33-RAF1, and blocks or reduces mRNA expression of TRIM33-RAF1.

Nucleic Acid Detection and Capturing Reagents

The invention also features a nucleic acid molecule, e.g., nucleic acid fragment, suitable as probe, primer, bait or library member that includes, flanks, hybridizes to, which are useful for identifying, or are otherwise based on, the TRIM33-RAF1 fusions described herein. In certain embodiments, the probe, primer or bait molecule is an oligonucleotide that allows capture, detection or isolation of a TRIM33-RAF1 fusion nucleic acid molecule described herein. The oligonucleotide can comprise a nucleotide sequence substantially complementary to a fragment of the TRIM33-RAF1 fusion nucleic acid molecules described herein. The sequence identity between the nucleic acid fragment, e.g., the oligonucleotide, and the target TRIM33-RAF1 sequence need not be exact, so long as the sequences are sufficiently complementary to allow the capture, detection or isolation of the target sequence. In one embodiment, the nucleic acid fragment is a probe or primer that includes an oligonucleotide between about 5 and 25, e.g., between 10 and 20, or 10 and 15 nucleotides in length. In other embodiments, the nucleic acid fragment is a bait that includes an oligonucleotide between about 100 to 300 nucleotides, 130 and 230 nucleotides, or 150 and 200 nucleotides, in length.

In one embodiment, the nucleic acid fragment can be used to identify or capture, e.g., by hybridization, a TRIM33-RAF1 fusion. For example, the nucleic acid fragment can be a probe, a primer, or a bait, for use in identifying or capturing, e.g., by hybridization, a TRIM33-RAFT fusion described herein. In one embodiment, the nucleic acid fragment can be useful for identifying or capturing a TRIM33-RAF1 breakpoint, e.g., the nucleotide sequence of: chromosome 3 at nucleotide 12,641,441 plus or minus 10, 20, 30, 40, 50, 60, 80, 100, 150 nucleotides and chromosome 1 at nucleotide 114,967,300 plus or minus 10, 20, 30, 40 50, 60, 80, 100, 150 nucleotides.

In one embodiment, the nucleic acid fragment hybridizes to a nucleotide sequence within a chromosomal rearrangement that creates an in-frame fusion of intron 9 of TRIM33 with intron 9 of RAF1. In one embodiment, the nucleic acid fragment hybridizes to a nucleotide sequence in the region In other embodiments, the nucleic acid molecules includes a nucleotide sequence in the region of nucleotides 12,641, 441 of chromosome 3 coupled to (e.g., juxtaposed to) nucleotides in the region of nucleotides 114,967,300 of chromosome 1. In one embodiment, the nucleic acid fragment hybridizes to a nucleotide sequence that includes a breakpoint, e.g., the nucleotide sequence of: chromosome 3 at nucleotide 12,641,441 plus or minus 10, 20, 30, 40 50, 60, 80, 100, 150 or more nucleotides and chromosome 1 at nucleotide 114,967,300 plus or minus 10, 20, 30, 40 50, 60, 80, 100, 150 or more nucleotides. For example, the nucleic acid fragment can hybridize to a nucleotide sequence that includes the fusion junction between the TRIM33 gene and the RAF1 gene, e.g., a nucleotide sequence that includes a portion of a nucleotide sequence within intron 9 of a TRIM33 gene and 9 of a RAF1 gene.

In another embodiment, the nucleic acid fragment hybridizes to a nucleotide sequence that comprises at least 6, 12, 15, 20, 25, 50, 75, 100, 150 or more nucleotides from exon 9 of TRIM33 (e.g., from the nucleotide sequence of TRIM33 preceding the fusion junction with RAF1, e.g., of the TRIM33 sequence shown in FIGS. 15A-15D (SEQ ID NO:15)), and at least 6, 12, 15, 20, 25, 50, 75, 100, 150 or more nucleotides from exon 10 of RAF1 (e.g., from the nucleotide sequence of RAF1 following the fusion junction with TRIM33, e.g., of the RAF1 sequence shown in FIGS. 13A-13B (SEQ ID NO:13)).

The probes or primers described herein can be used, for example, for FISH detection or PCR amplification. In one exemplary embodiment where detection is based on PCR, amplification of the TRIM33-RAF1 fusion junction fusion junction can be performed using a primer or a primer pair, e.g., for amplifying a sequence flanking the fusion junctions described herein, e.g., the mutations or the junction of a chromosomal rearrangement described herein, e.g., TRIM33-RAF1.

In one embodiment, a pair of isolated oligonucleotide primers can amplify a region containing or adjacent to a position in the TRIM33-RAF1 fusion. For example, forward primers can be designed to hybridize to a nucleotide sequence within TRIM33 genomic or mRNA sequence (e.g., a nucleotide sequence within exon 9 of TRIM33 of SEQ ID NO:15), and the reverse primers can be designed to hybridize to a nucleotide sequence of RAF1 (e.g., a nucleotide sequence within exon 10 of RAF1, of SEQ ID NO:13).

In another embodiment, the nucleic acid fragments can be used to identify, e.g., by hybridization, a TRIM33-RAF1 fusion. In one embodiment, the nucleic acid fragment hybridizes to a nucleotide sequence that includes a fusion junction between the TRIM33 transcript and the RAF1 transcript.

In other embodiments, the nucleic acid fragment includes a bait that comprises a nucleotide sequence that hybridizes to a TRIM33-RAF1 fusion nucleic acid molecule described herein, and thereby allows the capture or isolation said nucleic acid molecule. In one embodiment, a bait is suitable for solution phase hybridization. In other embodiments, a bait includes a binding entity, e.g., an affinity tag, that allows capture and separation, e.g., by binding to a binding entity, of a hybrid formed by a bait and a nucleic acid hybridized to the bait.

In other embodiments, the nucleic acid fragment includes a library member comprising a TRIM33-RAF1nucleic acid molecule described herein. In one embodiment, the library member includes a rearrangement that results in a TRIM33-RAF1 fusion described herein.

The nucleic acid fragment can be detectably labeled with, e.g., a radiolabel, a fluorescent label, a bioluminescent label, a chemiluminescent label, an enzyme label, a binding pair label, or can include an affinity tag; a tag, or identifier (e.g., an adaptor, barcode or other sequence identifier).

TRIM33-RAF1 Fusion Polypeptides

In another embodiment, the TRIM33-RAF1 fusion comprises an amino acid sequence (e.g., a fragment of the amino acid sequence) shown in FIG. 16 (SEQ ID NO:16) and an amino acid sequence (e.g., a fragment of the amino acid sequence) shown in FIG. 14 (SEQ ID NO:14), or a fragment of the fusion. In one embodiment, the TRIM33-RAF1 fusion comprises an amino acid sequence substantially identical to the amino acid sequence (e.g., a fragment of the amino acid sequence) shown in FIG. 16 (SEQ ID NO:16) and the amino acid sequence (e.g., a fragment of the amino acid sequence) shown in FIG. 14 (SEQ ID NO:14), or a fragment thereof. In one embodiment, the TRIM33-RAF1 fusion comprises an amino acid sequence at least 70%, at least 75%, at least 80%, at least 85%, at least 90%, at least 95%, at least 99%, at least 99.5 or greater, identical to the amino acid sequence (e.g., a fragment of the amino acid sequence) shown in FIG. 16 (SEQ ID NO:16) and the amino acid sequence (e.g., a fragment of the amino acid sequence) shown in FIG. 14 (SEQ ID NO:14). In one embodiment, the TRIM33-RAF1 fusion comprises a sequence containing at least 10, 20, 50, 100, 500, 600, 700, 800, 900, 1000, or more amino acids of the amino acid sequence shown in FIG. 16 (SEQ ID NO:16) and FIG. 14 (SEQ ID NO:14). In one embodiment, the TRIM33-RAF1 fusion comprises an amino acid sequence containing at least 5, 10, 20, 50, 100, 500, 600, 700, 800, 900, 1000, or more contiguous amino acids of the amino acid sequence shown in FIG. 16 (SEQ ID NO:16) and at least 5, 10, 20, 50, 100, 500, 600, 700, 800, 900, 1000, or more contiguous amino acids of the amino acid sequence shown in FIG. 14 (SEQ ID NO:14). In one embodiment, the 5' TRIM33-3' RAF1 fusion polypeptide includes a RAF1 receptor tyrosine kinase domain or a functional fragment thereof. In an embodiment, the 5'TRIM33-3'RAF1 fusion polypeptide comprises sufficient RAF1 and sufficient TRIM33 sequence such that it has kinase activity, e.g., has elevated activity, e.g., RAF1 kinase activity, as compared with wild type RAF1, e.g., in a cell of a cancer referred to herein.

In another aspect, the invention features a TRIM33-RAF1 fusion polypeptide (e.g., a purified TRIM33-RAF1 fusion polypeptide), a biologically active or antigenic fragment thereof, as well as reagents (e.g., antibody molecules that bind to a TRIM33-RAF1 fusion polypeptide), methods for modulating a TRIM33-RAF1 polypeptide activity and detection of a TRIM33-RAF1 polypeptide.

In one embodiment, the TRIM33-RAF1 fusion polypeptide has at least one biological activity, e.g., an RAF1 kinase activity. In one embodiment, at least one biological activity of the TRIM33-RAF1 fusion polypeptide is reduced or inhibited by an anti-cancer drug, e.g., a kinase inhibitor (e.g., a multikinase inhibitor or an RAF1-specific inhibitor). In one embodiment, at least one biological activity of the TRIM33-RAF1 fusion polypeptide is reduced or inhibited by an RAF1 kinase inhibitor chosen from e.g., sorafenib (nexavar); PLX-4720; or regorafenib (BAY 73-4506).

In yet other embodiments, the TRIM33-RAF1 fusion polypeptide is encoded by a nucleic acid molecule described herein. In one embodiment, the TRIM33-RAF1 fusion polypeptide is encoded by an in-frame fusion of intron 9 of TRIM33 with intron 9 of RAF1 (e.g., a sequence on chromosome 3 or a sequence on chromosome 1). In another embodiment, the TRIM33-RAF1 fusion polypeptide includes an amino acid sequence encoded by a nucleotide sequence comprising a fusion junction between the TRIM33 transcript and the RAF1 transcript.

In certain embodiments, the TRIM33-RAF1 fusion polypeptide comprises one or more of encoded exons 1-9 from TRIM33 and one or more of encoded exons 10-17 of RAF1. In certain embodiments, the TRIM33-RAF1 fusion polypeptide comprises at least 1, 2, 3, 4, 5, 6, 7, 8, 9 or more encoded exons from TRIM33 and at least 1, 2, 3, 4, 5, 6, 7, 9 or more, encoded exons from RAF1. In certain embodiments, the TRIM33-RAF1 fusion polypeptide comprises a fusion of encoded exon 9 from TRIM33 and encoded exon 10 from RAF1 (or a fragment thereof). In other embodiments, the fusion comprises least 1, 2, 3, 4, 5, 6, 7, 8, 9 encoded exons from TRIM33; and at least 1, 2, 3, 4, 5, 6, 7, 9 encoded exons from RAF1. In certain embodiments, the TRIM33-RAF1 fusion polypeptide comprises encoded exons 1-9 from TRIM33 and exons 10-17 of RAF1. In certain embodiments, the 5' TRIM33-3' RAF1 fusion polypeptide comprises a fusion junction of the sequence of exon 9 from TRIM33 and the sequence of exon 10 from RAF1.

In certain embodiments, the TRIM33-RAF1 fusion comprises the amino acid sequence corresponding to exon 9 or a fragment thereof from TRIM33, and the amino acid sequence corresponding to exon 10 or a fragment thereof from RAF1 (e.g., as shown in FIG. 16 (SEQ ID NO:16) and FIG. 14 (SEQ ID NO:14)). In one embodiment, the TRIM33-RAF1 fusion comprises at least 5, 10, 15, 20 or more amino acids encoded from exon 9 of TRIM33 (e.g., from the amino acid sequence of TRIM33 preceding the fusion junction with RAF1, e.g., of the TRIM33 sequence shown in FIG. 16 (SEQ ID NO:16)), and at least 5, 10, 15, 20 or more amino acids encoded from exon 10 of RAF1 (e.g., from the amino acid sequence of RAF1 following the fusion junction with TRIM33, e.g., of the RAF1 sequence shown in FIG. 14 (SEQ ID NO:14)).

In one embodiment, the TRIM33-RAF1 fusion polypeptide includes a RAF1 tyrosine kinase domain or a functional fragment thereof. In a related aspect, the invention features TRIM33-RAF1 fusion polypeptide or fragments operatively linked to heterologous polypeptides to form fusion proteins.

In another embodiment, the TRIM33-RAF1 fusion polypeptide or fragment is a peptide, e.g., an immunogenic peptide or protein, that contains a fusion junction described herein. Such immunogenic peptides or proteins can be used to raise antibodies specific to the fusion protein. In other embodiments, such immunogenic peptides or proteins can be used for vaccine preparation. The vaccine preparation can include other components, e.g., an adjuvant.

In another aspect, the invention features antibody molecules that bind to a TRIM33-RAFT fusion polypeptide or fragment described herein. In embodiments, the antibody can distinguish wild type RAF1 (or TRIM33) from TRIM33-RAF1.

Detection Reagents and Detection of Mutations

In another aspect, the invention features a detection reagent, e.g., a purified or an isolated preparation thereof. Detection reagents can distinguish a nucleic acid, or protein sequence, having a breakpoint, e.g., a TRIM33-RAF1 breakpoint; from a reference sequence. In one embodiment, the detection reagent detects (e.g., specifically detects) a TRIM33-RAF1 fusion nucleic acid or a polypeptide (e.g., distinguishes a wild type RAF1 or another RAF1 fusion (or TRIM33) from a TRIM33-RAF1 nucleic acid (e.g., as described herein in FIGS. 15A-15D (SEQ ID NO:15) and FIGS. 13A-13B (SEQ ID NO:13); ora TRIM33-RAF1 polypeptide (e.g., as described herein in FIG. 16 (SEQ ID NO:16) and FIG. 14 (SEQ ID NO:14).

Detection reagents, e.g., nucleic acid-based detection reagents, can be used to identify mutations in a target nucleic acid, e.g., DNA, e.g., genomic DNA or cDNA, or RNA, e.g., in a sample, e.g., a sample of nucleic acid derived from a neoplastic or tumor cell, e.g., a melanocytic neoplasm, melanoma or metastatic cell. Detection reagents, e.g., antibody-based detection reagents, can be used to identify mutations in a target protein, e.g., in a sample, e.g., a sample of protein derived from, or produced by, a neoplastic or tumor cell, e.g., a melanocytic neoplasm, melanoma or metastatic cell.

Method of Treatment

TRIM33-RAF1 rearrangements have not been reported in ameloblastic fibrosarcoma, a rare odontogenic cancer, nor any other tumors. Based on similarity to another RAF1 fusion protein, SRGAP3-RAF1 (Jones D T, Kocialkowski S, Liu L, Pearson D M, Ichimura K, Collins V P Oncogenic RAF1 rearrangement and a novel BRAF mutation as alternatives to KIAA1549:BRAF fusion in activating the MAPK pathway in pilocytic astrocytoma. Oncogene 2009 May 21;28(20):2119-23), TRIM33-RAF1 is expected to result in an activated Raf1 kinase (also known as Craf). Sorafenib is a Raf1/Craf inhibitor that is FDA-approved in other tumor types, and pre-clinical evidence suggests that some Raf1 fusions may be sensitive to Sorafenib (Palanisamy N, Ateeq B, Kalyana-Sundaram S, Pflueger D, Ramnarayanan K, Shankar S, Han B, Cao Q, Cao X, Suleman K, Kumar-Sinha C, Dhanasekaran S M, Chen Y B, Esgueva R, Banerjee S, LaFargue C J, Siddiqui J, Demichelis F, Moeller P, Bismar T A, Kuefer R, Fullen D R, Johnson T M, Greenson J K, Giordano T J, Tan P, Tomlins S A, Varambally S, Rubin M A, Maher C A, Chinnaiyan A M Rearrangements of the RAF kinase pathway in prostate cancer, gastric cancer and melanoma. Nature medicine 2010 July; 16(7):793-8). Other Raf1/Craf inhibitors are currently in clinical development. In addition, activation of Raf1 kinase leads to the downstream activation of Mek. RAF1 encodes a MAP kinase kinase kinase (MAP3K), also known as CRAF, which can activate the kinases Mek1 and Mek2, which in turn activate Erk1 and Erk2. Raf/Mek/Erk activation is associated with cell proliferation and tumorigenesis (Maurer G, Tarkowski B, Baccarini M Raf kinases in cancer-roles and therapeutic opportunities. Oncogene 2011 Aug. 11;30(32):3477-88). TRIM33 encodes a member of the tripartite motif family (also named Tif 1 gamma), and may be a transcriptional corepressor. TRIM33 has tumor suppressor activity in some types of cancers (Aucagne R, Droin N, Paggetti J, Lagrange B, Largeot A, Hammann A, Bataille A, Martin L, Yan K P, Fenaux P, Losson R, Solary E, Bastie J N, Delva L Transcription intermediary factor 1? is a tumor suppressor in mouse and human chronic myelomonocytic leukemia. The Journal of clinical investigation 2011 June; 121(6):2361-70), and is overexpressed in others (Jain S, Singhal S, Francis F, Hajdu C, Wang J H, Suriawinata A, Wang Y Q, Zhang M, Weinshel E H, Francois F, Pei Z H, Lee P, Xu R L Association of overexpression of TIF1? with colorectal carcinogenesis and advanced colorectal adenocarcinoma. World journal of gastroenterology: WJG 2011 Sep. 21;17 (35):3994-4000).

Rearrangement leading to TRIM33-RAF1 fusion has not been previously reported. However, other RAF1 rearrangements leading to oncogenic fusions have been reported. A rearrangement resulting in an ESRP1-RAF1 fusion has been observed in pancreatic cancer (Palanisamy N, et al., Rearrangements of the RAF kinase pathway in prostate cancer, gastric cancer and melanoma. Nature medicine 2010 July; 16(7):793-8). This translocation fuses exons 1-13 of ESRP1 with exons 6-17 of RAF1, retaining the C-terminal kinase domain of Raf1. The ESRP1-RAF1 fusion was shown to have oncogenic activity in cell culture, presumably due to the C-terminal kinase domain of Raf1, combined with the loss of the N-terminal Ras-binding domain (Palanisamy N, et al., Rearrangements of the RAF kinase pathway in prostate cancer, gastric cancer and melanoma. Nature medicine 2010 July; 16(7):793-8). Another RAF1 rearrangement, a SRGAP3-RAF1 fusion, has been noted in pilocytic astrocytoma (Jones D T, et al., Oncogenic RAF1 rearrangement and a novel BRAF mutation as alternatives to KIAA1549: BRAF fusion in activating the MAPK pathway in pilocytic astrocytoma. Oncogene 2009 May 21;28(20):2119-23). This fusion contains exons 1-12 of SRGAP3 and exons 10-17 of RAF1. The resulting fusion protein retains the kinase domain and was shown to have elevated kinase activity in cell culture, compared to wild type Raf1 (Jones D T, et al., Oncogenic RAF1 rearrangement and a novel BRAF mutation as alternatives to KIAA1549:BRAF fusion in activating the MAPK pathway in pilocytic astrocytoma. Oncogene 2009 May 21;28(20):2119-23). N-terminal truncations of Raf1 of 303-324 amino acids have previously been shown to result in transforming activity (Stanton V P Jr, Nichols D W, Laudano A P, Cooper G M Definition of the human raf amino-terminal regulatory region by deletion mutagenesis. Molecular and cellular biology 1989 February; 9(2):639-47); the SRGAP3-RAF1 rearrangement represents a truncation of the N-terminal 330 amino acids. The TRIM33-RAF1 rearrangement observed in this tumor is reported to occur at intron 9 of Raf1; this implies that exons 10-17 of Raf1 are retained, as in the SRGAP3-RAF1 fusion described by Jones et al (Oncogenic RAF1 rearrangement and a novel BRAF mutation as alternatives to KIAA1549:BRAF fusion in activating the MAPK pathway in pilocytic astrocytoma. Oncogene 2009 May 21;28(20):2119-23). TRIM33-RAF1 would therefore be expected to result in an activated Raf1 kinase.

Ameloblastic fibrosarcoma is an extremely rare odontogenic cancer, and very little is known about its molecular pathology (Pontes H A, Pontes F S, Silva B S, Cury S E, Fonseca F P, Salim R A, Pinto Júnior Ddos S Immunoexpression of Ki67, proliferative cell nuclear antigen, and Bcl-2 proteins in a case of ameloblastic fibrosarcoma. Annals of diagnostic pathology 2010 December; 14(6):447-52). There are no literature reports of TRIM33-RAF1 rearrangements (or any other RAF1 rearrangements) in ameloblastic fibrosarcoma. Preclinical evidence suggests that N-terminally truncated RAF1 fusions may be sensitive to the FDA-approved Raf inhibitor sorafenib. Palanisamy et al demonstrated that the cellular invasion, anchorage-independent growth, and activation of downstream pathways mediated by ESRP1-RAF1 are reduced or eliminated upon treatment with sorafenib (Palanisamy N, et al., Chinnaiyan A M Rearrangements of the RAF kinase pathway in prostate cancer, gastric cancer and melanoma. Nature medicine 2010 July; 16(7):793-8). Sorafenib has been approved for use in hepatocellular and renal cell carcinoma, and clinical trials of sorafenib in other solid tumors are underway. Exemplary pan-RAF and CRAF inhibitors include XL281 and LGX818.

RAF/MEK/ERK pathway-induced cell proliferation (Palanisamy N, et al., Chinnaiyan A M Rearrangements of the RAF kinase pathway in prostate cancer, gastric cancer and melanoma. Nature medicine 2010 July; 16(7):793-8; Jones D T, et al., Oncogenic RAF1 rearrangement and a novel BRAF mutation as alternatives to KIAA1549:BRAF fusion in activating the MAPK pathway in pilocytic astrocytoma. Oncogene 2009 May 21;28(20):2119-23). Indeed, a preclinical study demonstrated that treatment of ESRP1-RAF1 cells with a Mek inhibitor (U0126) resulted in the reduction of oncogenic activity (Palanisamy N, et al., Rearrangements of the RAF kinase pathway in prostate cancer, gastric cancer and melanoma. Nature medicine 2010 July; 16(7):793-8). Several Mek inhibitors are in clinical trials for solid tumors. Since the TRIM33-RAF1 fusion identified in this tumor contains the same exons as the Srgap3-Rafl fusion protein, it may retain similar activity, and may therefore be sensitive to treatment with Mek inhibitors. Accordingly, in another aspect, a method of inhibiting, reducing, or treating a hyperproliferative disorder, e.g., a neoplasm (including benign, pre-malignant or malignant (e.g., a cancer), in a subject is provided. The method includes administering to the subject a preselected therapeutic agent, e.g., an anti-cancer agent (e.g., a kinase inhibitor), as a single agent, or in combination, in an amount sufficient to reduce, inhibit or treat the activity or expression of TRIM33-RAF1 (e.g., a TRIM33-RAF1 fusion described herein), thereby inhibiting, reducing, or treating the hyperproliferative disorder in the subject.

In one embodiment, the subject treated has a TRIM33-RAF1 fusion; e.g., the subject has a tumor or cancer harboring a TRIM33-RAF1 fusion. In other embodiments, the subject has been previously identified as having a TRIM33-RAF1 fusion. In yet other embodiments, the subject has been previously identified as being likely or unlikely to respond to treatment with a protein kinase inhibitor, e.g., a subject that has previously participated in a clinical trial. In other embodiments, the subject has been previously identified as being likely or unlikely to respond to treatment with a protein kinase inhibitor, based on the presence of the TRIM33-RAF1 fusion. In one embodiment, the subject is a mammal, e.g., a human. In one embodiment, the subject has, or at risk of having a cancer at any stage of disease. In other embodiments, the subject is a patient, e.g., a cancer patient.

In certain embodiments, the neoplasm or neoplastic cell is a benign, pre-malignant, malignant (cancer) or metastasis. In certain embodiments, the cancer is a solid tumor, a soft tissue tumor, or a metastatic lesion.

In one embodiment, the neoplasm or neoplastic cell is a benign, pre-malignant, malignant (cancer) or metastasis. In certain embodiments, the cancer is a solid tumor, a soft tissue tumor, or a metastatic lesion. In one embodiment, the cancer is a sarcoma. In one embodiment, the cancer is a fibrosarcoma. In one embodiment, the cancer is an amelioblastic fibrosarcoma. In one embodiment, the cancer is chosen from a lung cancer, a pancreatic cancer, melanoma, a colorectal cancer, an esophageal-gastric cancer, a thyroid cancer, or an adenocarcinoma. In one embodiment, the cancer is an adenocarcinoma. In one embodiment, the cancer is a lung adenocarcinoma. In other embodiment, the lung cancer is chosen from one or more of the following: non-small cell lung cancer (NSCLC), small cell lung cancer (SCLC), squamous cell carcinoma (SCC), adenocarcinoma of the lung, bronchogenic carcinoma, or a combination thereof. In one embodiment, the lung cancer is NSCLC or SCC. In certain embodiments, the cancer is a fibrosarcoma, e.g., an ameloblastic fibrosarcoma. In certain embodiments, the cancer is a odontogenic cancer.

In one embodiment, the anti-cancer agent is a kinase inhibitor. For example, the kinase inhibitor is a multi-kinase inhibitor or a RAF1-specific inhibitor. In one embodiment, the kinase inhibitor is a RAF1 inhibitor including, but not limited to, GDC-0973, GDC-0941, sorafenib (nexavar); PLX-4720; XL281, LGX818, U0126; or regorafenib (BAY 73-4506). In certain embodiments, the RAF1 inhibitor is a MEK inhibitor, In certain embodiments, the MEK inhibitor, is a MEK inhibitor described herein. In certain embodiments, the RAF1 inhibitor is a RAF1 inhibitor (e.g., C-Raf inhibitor) described herein. Exemplary Raf inhibitors include pan-Raf, B-Raf and C-Raf inhibitors including, but not limited to, XL281 and LGX818.

PDZRN3-RAF1 Fusions

In one embodiment, a fusion includes an in-frame fusion of an exon of PDZ domain containing ring finger 3 (PDZRN3), e.g., one more exons of PDZRN3 (e.g., one or more of exons 1-5 of PDZRN3) or a fragment thereof, and an exon of v-raf-1 murine leukemia viral oncogene homolog 1 (RAF1), e.g., one or more exons of a RAF1 (e.g., one or more of exons 8-17 of RAF1) or a fragment thereof. For example, the PDZRN3-RAF1 fusion can include an in-frame fusion within an intron of PDZRN3 (e.g., intron 5) or a fragment thereof, with an intron of RAF1 (e.g., intron 7) or a fragment thereof. In one embodiment, the fusion of the PDZRN3-RAF1 fusion comprises the nucleotide sequence of: chromosome 3 at one or more of nucleotide 12,642,141 (plus or minus 10, 20, 30, 50, 60, 70, 80, 100 or more nucleotides) and chromosome 3 at one or more of nucleotide 73,442,594 (plus or minus 10, 20, 30, 50, 60, 70, 80, 100 or more nucleotides). In one embodiment, the PDZRN3-RAF1 fusion is a deletion, e.g., a deletion of a portion of chromosome 3.

In certain embodiments, the PDZRN3-RAF1 fusion is in a 5'-PDZRN3 to 3'-RAF1 configuration (also referred to herein as "5'-PDZRN3-RAF1-3')." The term "fusion" or "fusion molecule" can refer to a polypeptide or a nucleic acid fusion, depending on the context. It may include a full-length sequence of a fusion or a fragment thereof, e.g., a fusion junction (e.g., a fragment including a portion of PDZRN3 and a portion of RAF1, e.g., a portion of the PDZRN3-RAF1 fusion described herein). In one embodiment, the PDZRN3-RAF1 fusion polypeptide includes a fragment of the amino acid sequence shown in FIG. 18 (SEQ ID NO:18) and a fragment of the amino acid sequence shown in FIG. 14 (SEQ ID NO:14), or an amino acid sequence substantially identical thereto. In another embodiment, the PDZRN3-RAF1 fusion nucleic acid includes a fragment of the nucleotide sequence shown in FIGS. 17A-17B (SEQ ID NO:17) and a fragment of the nucleotide sequence shown in FIGS. 13A-13B (SEQ ID NO:13), or a nucleotide sequence substantially identical thereto. In one embodiment, the PDZRN3-RAF1 fusion polypeptide comprises sufficient PDZRN3 and sufficient RAF1 sequence such that the 5' PDZRN3-3' RAF1 fusion has kinase activity, e.g., has elevated activity, e.g., RAF1 tyrosine kinase activity, as compared with wild type RAF1, e.g., in a cell of a cancer referred to herein (e.g., carcinoma, e.g., adenocarcinoma).

In certain embodiments, the PDZRN3-RAF1 fusion comprises one or more (or all of) exons 1-5 from PDZRN3 and one or more (or all of) exons 8-17 of RAF1 (e.g., one or more of the exons shown in FIGS. 17A-17B (SEQ ID NO:17) and FIGS. 13A-13C (SEQ ID NO:13). In another embodiment, the PDZRN3-RAF1 fusion comprises one or more (or all of) exons 1-5 of PDZRN3 and one or more (or all of) exons 8-17 of RAF1. In certain embodiments, the PDZRN3-RAF1 fusion comprises at least 1, 2, 3, 4, 5 or more exons (or encoded exons) from PDZRN3 and at least 1, 2, 3, 4, 5, 6, 7, 8, 9 or more exons (or encoded exons) from RAF1 (e.g., from the PDZRN3 and RAF1 sequences shown in FIGS. 17A-17B and FIG. 18 (SEQ ID NO:17 and 18) and FIGS. 13A-13BC and FIG. 14 (SEQ ID NOs:13 and 14).

In certain embodiments, the PDZRN3-RAF1 fusion comprises exon 5 or a fragment thereof from PDZRN3, and exon 8 or a fragment thereof from RAF1 (e.g., as shown in FIGS. 17A-17B (SEQ ID NO:17) and FIGS. 13A-13B (SEQ ID NO:13)). In one embodiment, the PDZRN3-RAF1 fusion comprises at least 5, 10, 15, 20, 30, 40, 50 or more amino acids encoded from exon 5 of PDZRN3 (e.g., from the amino acid sequence of PDZRN3 as shown in FIG. 18 (SEQ ID NO:18) (e.g., from the amino acid sequence of PDZRN3 preceding the fusion junction with RAF1), and at least 5, 10, 15, 20, 30, 40, 50 or more amino acids encoded from exon 8 of RAF1 (e.g., from the amino acid sequence of RAF1 as shown in FIG. 14 (SEQ ID NO:14)). In another embodiment, the PDZRN3-RAF1 fusion comprises at least 6, 12, 15, 20, 25, 50, 75, 100 or more nucleotides from exon 5 of PDZRN3 (e.g., from the nucleotide sequence of PDZRN3 as shown in FIGS. 17A-17B (SEQ ID NO:17) (e.g., from the nucleotide sequence of PDZRN3 preceding the fusion junction with RAF1); and at least 6, 12, 15, 20, 25, 50, 75, 100 or more nucleotides from exon 8 of RAF1 (e.g., from the nucleotide sequence of RAF1 as shown in FIGS. 13A-13B (SEQ ID NO:13)).

PDZRN3-RAF1 Nucleic Acid Molecules

In one aspect, the invention features a nucleic acid molecule (e.g., an isolated or purified) nucleic acid molecule that includes a fragment of a PDZRN3 gene and a fragment of a RAF1 gene. In one embodiment, the nucleotide sequence encodes a PDZRN3-RAF1 fusion polypeptide that includes a RAF1 tyrosine kinase domain or a functional fragment thereof. In another embodiment, the nucleotide sequence encodes a fragment of the RAF1 polypeptide including the amino acid sequence of SEQ ID NO:14 or a fragment thereof, or a sequence substantially identical thereto. In other embodiments, the nucleic acid molecule includes a fragment of the PDZRN3 gene encoding the amino acid sequence of SEQ ID NO:18 or a fragment thereof, or a sequence substantially identical thereto. In yet other embodiments, the nucleic acid molecule includes a nucleotide sequence encoding the amino acid sequence shown in FIG. 18 (SEQ ID NO:18), or a fragment thereof, and the amino acid sequence shown in FIG. 14 (SEQ ID NO:14) or a fragment thereof, or a sequence substantially identical thereto.

In one embodiment, the nucleic acid molecule includes a fusion, e.g., an in-frame fusion, between an intron of PDZRN3 (e.g., intron 5, or a fragment thereof), and an intron of RAF1 (e.g., intron 7, or a fragment thereof). The PDZRN3-RAF1 fusion can comprise a fusion of the nucleotide sequence of: chromosome 3 at one or more of nucleotide 12,642,141 (plus or minus 10, 20, 30, 50, 60, 70, 80, 100 nucleotides) and chromosome 3 at one or more of nucleotide 73,442,594 (plus or minus 10, 20, 30, 50, 60, 70, 80, 100 nucleotides), or a fragment thereof. In one embodiment, the PDZRN3-RAF1 fusion comprises a fusion of the nucleotide sequence of: chromosome 3 at one or more of nucleotide 12,642,141 (plus or minus 10, 20, 30, 50, 60, 70, 80, 100 nucleotides) and chromosome 3 at one or more of nucleotide 73,442,594 (plus or minus 10, 20, 30, 50, 60, 70, 80, 100 nucleotides), or a fragment thereof.

In another embodiment, the PDZRN3-RAF1 fusion comprises a nucleotide sequence (e.g., a fragment of a nucleotide sequence) shown in FIGS. 17A-17B (SEQ ID NO:17) and a nucleotide sequence (e.g., a fragment of a nucleotide sequence) shown in FIGS. 13A-13B (SEQ ID NO:13), or a fragment of the fusion. In one embodiment, the PDZRN3-RAF1 fusion comprises a nucleotide sequence substantially identical to the nucleotide sequence (e.g., a fragment of a nucleotide sequence) shown in FIGS. 17A-17B (SEQ ID NO:17) and the nucleotide sequence (e.g., a fragment of a nucleotide sequence) shown FIGS. 13A-13B (SEQ ID NO:13), or a fragment of the fusion. In one embodiment, the PDZRN3-RAF1 fusion comprises a nucleotide sequence at least 70%, at least 75%, at least 80%, at least 85%, at least 90%, at least 95%, at least 99%, at least 99.5 or greater, identical to the nucleotide sequence (e.g., a fragment of a nucleotide sequence) shown in FIGS. 17A-17B (SEQ ID NO:17) and to the nucleotide sequence (e.g., a fragment of a nucleotide sequence) shown in FIGS. 13A-13B (SEQ ID NO:13). In one embodiment, the PDZRN3-RAF1 fusion comprises a nucleotide sequence containing at least 25, 50, 100, 150, 200, 500, 1000, 1500, 2000, 2500, 3000, or more nucleotides of the nucleotide sequence shown in FIGS. 17A-17B (SEQ ID NO:17) and a nucleotide sequence containing at least 25, 50, 100, 150, 200, 500, 1000, 1500, 2000, 2500, 3000, or more nucleotides of the nucleotide sequence shown in FIGS. 13A-13B (SEQ ID NO:13). In one embodiment, the PDZRN3-RAF1 fusion comprises a nucleotide sequence containing at least 25, 50, 100, 150, 200, 500, 1000, 1500, 2000, 2500, 3000, or more contiguous nucleotides of the nucleotide sequence shown in FIGS. 17A-17B (SEQ ID NO:17) and a nucleotide sequence containing at least 25, 50, 100, 150, 200, 500, 1000, 1500, 2000, 2500, 3000, or more nucleotides of the nucleotide sequence shown in FIGS. 13A-13B (SEQ ID NO:13).

In another embodiment, the nucleic acid molecule includes a fusion, e.g., an in-frame fusion, of at least exon 5 of PDZRN3 or a fragment thereof (e.g., one or more of exons 1-5 of PDZRN3 or a fragment thereof), and at least exon 8 or a fragment thereof (e.g., one or more of exons 8-17 of RAF1 or a fragment thereof). In yet other embodiments, the nucleic acid molecule includes a fragment the nucleotide sequence shown in FIGS. 17A-17B (SEQ ID NO:17) and a fragment of the nucleotide sequence shown in FIGS. 13A-13B (SEQ ID NO:13) or a fragment of the fusion, or a sequence substantially identical thereto.

In one embodiment, the nucleic acid molecule is complementary to at least a portion of a nucleotide sequence disclosed herein, e.g., is capable of hybridizing under a stringency condition described herein to SEQ ID NO:17 and/or SEQ ID NO:13, or a fragment thereof. In yet another embodiment, the nucleic acid molecule hybridizes to a nucleotide sequence that is complementary to at least a portion of a nucleotide sequence disclosed herein, e.g., is capable of hybridizing under a stringency condition to a nucleotide sequence complementary to SEQ ID NO:17 and/or SEQ ID NO:13, or a fragment thereof. The nucleotide sequence of a cDNA encoding an exemplary 5' PDZRN3-3' RAF1 fusion is shown in at least exon 5 (e.g., exons 1-5) of SEQ ID NO:17 and at least exon 8 (e.g., exons 8-17) of SEQ ID NO:13, and the predicted amino acid sequence is shown in the corresponding encoded exons of SEQ ID NO:18 and the corresponding encoded exons of SEQ ID NO:14, respectively.

In an embodiment the PDZRN3-RAF1nucleic acid molecule comprises sufficient PDZRN3 and sufficient RAF1 sequence such that the encoded 5' PDZRN3-3' RAF1 fusion has kinase activity, e.g., has elevated activity, e.g., RAF1 kinase activity, as compared with wild type RAF1, e.g., in a cell of a cancer referred to herein. In certain embodiments, the 5' PDZRN3-3' RAF1 fusion comprises exons 1-5 from PDZRN3 and exons 8-17 from RAF1. In certain embodiments, the PDZRN3-RAF1 fusion comprises at least 1, 2, 3, 4, 5 or more exons from PDZRN3 and at least 1, 2, 3, 4, 5, 6, 7, 9, or more, exons from RAF1. In certain embodiments, the PDZRN3-RAF1 fusion comprises a fusion of exon 5 from PDZRN3 and exon 8 from RAF1. In another embodiment, the PDZRN3-RAF1 fusion comprises at least 1, 2, 3, 4, 5 exons from PDZRN3; and at least 1, 2, 3, 4, 5, 6, 7, 9 exons from RAF1.

In one embodiment, the nucleic acid molecule includes a nucleotide sequence that has an in-frame fusion of intron 5 of PDZRN3 (e.g., NM_017738) with intron 7 of RAF1 (e.g., NM_002880). In another embodiment, the nucleic acid molecule includes a nucleotide sequence that includes a breakpoint. For example, the nucleic acid molecule includes a nucleotide sequence that includes the fusion junction between the PDZRN3 gene and the RAF1 gene, e.g., the breakpoint between intron 5 of PDZRN3 and intron 7 of RAF1. In other embodiments, the nucleic acid molecules includes a nucleotide sequence of one or more of nucleotide 12,642,141 of chromosome 3 coupled to (e.g., directly or indirectly juxtaposed to) one or more of nucleotide 73,442, 594 of chromosome 3. In one embodiment, the nucleic acid molecule includes the nucleotide sequence of: chromosome 3 at one or more of nucleotide 12,642,141 plus or minus 10, 20, 30, 40 50, 60, 80, 100, 150 nucleotides and chromosome 3 at one or more of nucleotide 73,442,594 plus or minus 10, 20, 30, 40 50, 60, 80, 100, 150 nucleotides (corresponding to the breakpoint of a PDZRN3-RAF1 fusion), or a fragment thereof, or a sequence substantially identical thereto. In one embodiment, the nucleic acid molecule is complementary to at least a portion of a nucleotide sequence disclosed herein, e.g., is capable of hybridizing under a stringency condition described herein to SEQ ID NO:17 and/or SEQ ID NO:13 or a fragment thereof. In yet other embodiment, the nucleic acid molecule hybridizes to a nucleotide sequence that is complementary to at least a portion of a nucleotide sequence disclosed herein, e.g., is capable of hybridizing under a stringency condition described herein to a nucleotide sequence complementary to SEQ ID NO:17 or 13 or a fragment thereof.

In another embodiment, the PDZRN3-RAF1 fusion nucleic acid comprises at least 6, 12, 15, 20, 25, 50, 75, 100 or more nucleotides from exon 5 of PDZRN3 (e.g., from the nucleotide sequence of PDZRN3 preceding the fusion junction with RAF1, e.g., of the PDZRN3 sequence shown in FIGS. 17A-17B (SEQ ID NO:17)), and at least 6, 12, 15, 20, 25, 50, 75, 100 or more nucleotides from exon 8 of RAF1 (e.g., from the nucleotide sequence of RAF1 following the fusion junction with PDZRN3, e.g., of the RAF1 sequence shown in FIGS. 13A-13B (SEQ ID NO:13)).

In other embodiments, the nucleic acid molecule includes a nucleotide sequence encoding a PDZRN3-RAF1 fusion polypeptide that includes a fragment of a PDZRN3 gene and a fragment of an RAF1 gene. In one embodiment, the nucleotide sequence encodes a PDZRN3-RAF1 fusion polypeptide that includes e.g., an RAF1 tyrosine kinase domain or a functional fragment thereof. In yet other embodiments, the nucleic acid molecule includes a nucleotide sequence encoding the amino acid sequence (e.g., a fragment of the amino acid sequence) shown in FIG. 18 (e.g., SEQ ID NO:18) and a nucleotide sequence encoding the amino acid sequence (e.g., a fragment of the amino acid sequence) shown in FIG. 14 (e.g., SEQ ID NO:14), or a fragment of the fusion, or a sequence substantially identical thereto. In one embodiment, the encoded PDZRN3-RAF1 fusion polypeptide includes an RAF1 tyrosine kinase domain or a functional fragment thereof.

In a related aspect, the invention features nucleic acid constructs that include the PDZRN3-RAF1 nucleic acid molecules described herein. In certain embodiments, the nucleic acid molecules are operatively linked to a native or a heterologous regulatory sequence. Also included are vectors and host cells that include the PDZRN3-RAF1 nucleic acid molecules described herein, e.g., vectors and host cells suitable for producing the nucleic acid molecules and polypeptides described herein.

In a related aspect, methods of producing the nucleic acid molecules and polypeptides described herein are also described.

In another aspect, the invention features nucleic acid molecules that reduce or inhibit the expression of a nucleic acid molecule that encodes a PDZRN3-RAF1 fusion described herein. Examples of such nucleic acid molecules include, for example, antisense molecules, ribozymes, RNAi, triple helix molecules that hybridize to a nucleic acid encoding PDZRN3-RAF1, or a transcription regulatory region of PDZRN3-RAF1, and blocks or reduces mRNA expression of PDZRN3-RAF1.

Nucleic Acid Detection and Capturing Reagents

The invention also features a nucleic acid molecule, e.g., nucleic acid fragment, suitable as probe, primer, bait or library member that includes, flanks, hybridizes to, which are useful for identifying, or are otherwise based on, the PDZRN3-RAF1 fusions described herein. In certain embodiments, the probe, primer or bait molecule is an oligonucleotide that allows capture, detection or isolation of a PDZRN3-RAFT fusion nucleic acid molecule described herein. The oligonucleotide can comprise a nucleotide sequence substantially complementary to a fragment of the PDZRN3-RAF1 fusion nucleic acid molecules described herein. The sequence identity between the nucleic acid fragment, e.g., the oligonucleotide, and the target PDZRN3-RAF1 sequence need not be exact, so long as the sequences are sufficiently complementary to allow the capture, detection or isolation of the target sequence. In one embodiment, the nucleic acid fragment is a probe or primer that includes an oligonucleotide between about 5 and 25, e.g., between 10 and 20, or 10 and 15 nucleotides in length. In other embodiments, the nucleic acid fragment is a bait that includes an oligonucleotide between about 100 to 300 nucleotides, 130 and 230 nucleotides, or 150 and 200 nucleotides, in length.

In one embodiment, the nucleic acid fragment can be used to identify or capture, e.g., by hybridization, a PDZRN3-RAF1 fusion. For example, the nucleic acid fragment can be a probe, a primer, or a bait, for use in identifying or capturing, e.g., by hybridization, a PDZRN3-RAF1 fusion described herein. In one embodiment, the nucleic acid fragment can be useful for identifying or capturing a PDZRN3-RAF1 breakpoint, e.g., the nucleotide sequence of: chromosome 3 at nucleotide 12,642,141 plus or minus 10, 20, 30, 40, 50, 60, 80, 100, 150 nucleotides and chromosome 3 at nucleotide 73,442,594 plus or minus 10, 20, 30, 40 50, 60, 80, 100, 150 nucleotides.

In one embodiment, the nucleic acid fragment hybridizes to a nucleotide sequence within a chromosomal rearrangement that creates an in-frame fusion of intron 5 of PDZRN3 with intron 7 of RAF1. In one embodiment, the nucleic acid fragment hybridizes to a nucleotide sequence in the region In other embodiments, the nucleic acid molecules includes a nucleotide sequence in the region of nucleotides 12,642, 141 of chromosome 3 coupled to (e.g., juxtaposed to) nucleotides in the region of nucleotides 73,442,594 of chromosome 3. In one embodiment, the nucleic acid fragment hybridizes to a nucleotide sequence that includes a breakpoint, e.g., the nucleotide sequence of: chromosome 3 at nucleotide 12,642,141 plus or minus 10, 20, 30, 40 50, 60, 80, 100, 150 or more nucleotides and chromosome 3 at nucleotide 73,442,594 plus or minus 10, 20, 30, 40 50, 60, 80, 100, 150 or more nucleotides. For example, the nucleic acid fragment can hybridize to a nucleotide sequence that includes the fusion junction between the PDZRN3 gene and the RAF1 gene, e.g., a nucleotide sequence that includes a portion of a nucleotide sequence within intron 5 of a PDZRN3 gene and 7 of a RAF1 gene.

In another embodiment, the nucleic acid fragment hybridizes to a nucleotide sequence that comprises at least 6, 12, 15, 20, 25, 50, 75, 100, 150 or more nucleotides from exon 5 of PDZRN3 (e.g., from the nucleotide sequence of PDZRN3 preceding the fusion junction with RAF1, e.g., of the PDZRN3 sequence shown in FIGS. 17A-17B (SEQ ID NO:17)), and at least 6, 12, 15, 20, 25, 50, 75, 100, 150 or more nucleotides from exon 8 of RAF1 (e.g., from the nucleotide sequence of RAF1 following the fusion junction with PDZRN3, e.g., of the RAF1 sequence shown in FIGS. 13A-13B (SEQ ID NO:13)).

The probes or primers described herein can be used, for example, for FISH detection or PCR amplification. In one exemplary embodiment where detection is based on PCR, amplification of the PDZRN3-RAF1 fusion junction fusion junction can be performed using a primer or a primer pair, e.g., for amplifying a sequence flanking the fusion junctions described herein, e.g., the mutations or the junction of a chromosomal rearrangement described herein, e.g., PDZRN3-RAF1.

In one embodiment, a pair of isolated oligonucleotide primers can amplify a region containing or adjacent to a position in the PDZRN3-RAF1 fusion. For example, forward primers can be designed to hybridize to a nucleotide sequence within PDZRN3 genomic or mRNA sequence (e.g., a nucleotide sequence within exon 5 of PDZRN3 of SEQ ID NO:17), and the reverse primers can be designed to hybridize to a nucleotide sequence of RAF1 (e.g., a nucleotide sequence within exon 8 of RAF1, of SEQ ID NO:13).

In another embodiment, the nucleic acid fragments can be used to identify, e.g., by hybridization, a PDZRN3-RAF1 fusion. In one embodiment, the nucleic acid fragment hybridizes to a nucleotide sequence that includes a fusion junction between the PDZRN3 transcript and the RAF1 transcript.

In other embodiments, the nucleic acid fragment includes a bait that comprises a nucleotide sequence that hybridizes to a PDZRN3-RAF1 fusion nucleic acid molecule described herein, and thereby allows the capture or isolation said nucleic acid molecule. In one embodiment, a bait is suitable for solution phase hybridization. In other embodiments, a bait includes a binding entity, e.g., an affinity tag, that allows capture and separation, e.g., by binding to a binding entity, of a hybrid formed by a bait and a nucleic acid hybridized to the bait.

In other embodiments, the nucleic acid fragment includes a library member comprising a PDZRN3-RAF1nucleic acid molecule described herein. In one embodiment, the library member includes a rearrangement that results in a PDZRN3-RAF1 fusion described herein.

The nucleic acid fragment can be detectably labeled with, e.g., a radiolabel, a fluorescent label, a bioluminescent label, a chemiluminescent label, an enzyme label, a binding pair label, or can include an affinity tag; a tag, or identifier (e.g., an adaptor, barcode or other sequence identifier).

PDZRN3-RAF1 Fusion Polypeptides

In another embodiment, the PDZRN3-RAF1 fusion comprises an amino acid sequence (e.g., a fragment of the amino acid sequence) shown in FIG. 18 (SEQ ID NO:18) and an amino acid sequence (e.g., a fragment of the amino acid sequence) shown in FIG. 14 (SEQ ID NO:14), or a fragment of the fusion. In one embodiment, the PDZRN3-RAF1 fusion comprises an amino acid sequence substantially identical to the amino acid sequence (e.g., a fragment of the amino acid sequence) shown in FIG. 18 (SEQ ID NO:18) and the amino acid sequence (e.g., a fragment of the amino acid sequence) shown in FIG. 14 (SEQ ID NO:14), or a fragment thereof. In one embodiment, the PDZRN3-RAF1 fusion comprises an amino acid sequence at least 70%, at least 75%, at least 80%, at least 85%, at least 90%, at least 95%, at least 99%, at least 99.5 or greater, identical to the amino acid sequence (e.g., a fragment of the amino acid sequence) shown in FIG. 18 (SEQ ID NO:18) and the amino acid sequence (e.g., a fragment of the amino acid sequence) shown in FIG. 14 (SEQ ID NO:14). In one embodiment, the PDZRN3-RAF1 fusion comprises a sequence containing at least 10, 20, 50, 100, 500, 600, 700, 800, 900, 1000, or more amino acids of the amino acid sequence shown in FIG. 18 (SEQ ID NO:18) and FIG. 14 (SEQ ID NO:14). In one embodiment, the PDZRN3-RAF1 fusion comprises an amino acid sequence containing at least 5, 10, 20, 50, 100, 500, 600, 700, 800, 900, 1000, or more contiguous amino acids of the amino acid sequence shown in FIG. 18 (SEQ ID NO:18) and at least 5, 10, 20, 50, 100, 500, 600, 700, 800, 900, 1000, or more contiguous amino acids of the amino acid sequence shown in FIG. 14 (SEQ ID NO:14). In one embodiment, the 5' PDZRN3-3' RAF1 fusion polypeptide includes a RAF1 receptor tyrosine kinase domain or a functional fragment thereof. In an embodiment, the 5'PDZRN3-3'RAF1 fusion polypeptide comprises sufficient RAF1 and sufficient PDZRN3 sequence such that it has kinase activity, e.g., has elevated activity, e.g., RAF1 kinase activity, as compared with wild type RAF1, e.g., in a cell of a cancer referred to herein.

In another aspect, the invention features a PDZRN3-RAF1 fusion polypeptide (e.g., a purified PDZRN3-RAF1 fusion polypeptide), a biologically active or antigenic fragment thereof, as well as reagents (e.g., antibody molecules that bind to a PDZRN3-RAF1 fusion polypeptide), methods for modulating a PDZRN3-RAF1 polypeptide activity and detection of a PDZRN3-RAF1 polypeptide.

In one embodiment, the PDZRN3-RAF1 fusion polypeptide has at least one biological activity, e.g., an RAF1 kinase activity. In one embodiment, at least one biological activity of the PDZRN3-RAF1 fusion polypeptide is reduced or inhibited by an anti-cancer drug, e.g., a kinase inhibitor (e.g., a multikinase inhibitor or an RAF1-specific inhibitor). In one embodiment, at least one biological activity of the PDZRN3-RAF1 fusion polypeptide is reduced or inhibited by an RAF1 kinase inhibitor chosen from e.g., sorafenib (nexavar); PLX-4720; or regorafenib (BAY 73-4506).

In yet other embodiments, the PDZRN3-RAF1 fusion polypeptide is encoded by a nucleic acid molecule described herein. In one embodiment, the PDZRN3-RAF1 fusion polypeptide is encoded by an in-frame fusion of intron 5 of PDZRN3 with intron 7 of RAF1 (e.g., a sequence on chromosome 3 or a sequence on chromosome 3). In another embodiment, the PDZRN3-RAF1 fusion polypeptide includes an amino acid sequence encoded by a nucleotide sequence comprising a fusion junction between the PDZRN3 transcript and the RAF1 transcript.

In certain embodiments, the PDZRN3-RAF1 fusion polypeptide comprises one or more of encoded exons 1-5 from PDZRN3 and one or more of encoded exons 8-17 of RAF1. In certain embodiments, the PDZRN3-RAF1 fusion polypeptide comprises at least 1, 2, 3, 4, 5 or more encoded exons from PDZRN3 and at least 1, 2, 3, 4, 5, 6, 7, 9 or more, encoded exons from RAF1. In certain embodiments, the PDZRN3-RAF1 fusion polypeptide comprises a fusion of encoded exon 5 from PDZRN3 and encoded exon 8 from RAF1 (or a fragment thereof). In other embodiments, the fusion comprises least 1, 2, 3, 4, 5 encoded exons from PDZRN3; and at least 1, 2, 3, 4, 5, 6, 7, 9 encoded exons from RAF1. In certain embodiments, the PDZRN3-RAF1 fusion polypeptide comprises encoded exons 1-5 from PDZRN3 and exons 8-17 of RAF1. In certain embodiments, the 5' PDZRN3-3' RAF1 fusion polypeptide comprises a fusion junction of the sequence of exon 5 from PDZRN3 and the sequence of exon 8 from RAF1.

In certain embodiments, the PDZRN3-RAF1 fusion comprises the amino acid sequence corresponding to exon 5 or a fragment thereof from PDZRN3, and the amino acid sequence corresponding to exon 8 or a fragment thereof from RAF1 (e.g., as shown in FIG. 18 (SEQ ID NO:18) and FIG. 14 (SEQ ID NO:14)). In one embodiment, the PDZRN3-RAF1 fusion comprises at least 5, 10, 15, 20 or more amino acids from exon 5 of PDZRN3 (e.g., from the amino acid sequence of PDZRN3 preceding the fusion junction with RAF1, e.g., of the PDZRN3 sequence shown in FIG. 18 (SEQ ID NO:18)), and at least 5, 10, 15, 20 or more amino acids from exon 8 of RAF1 (e.g., from the amino acid sequence of RAF1 following the fusion junction with PDZRN3, e.g., of the RAF1 sequence shown in FIG. 14 (SEQ ID NO:14)).

In one embodiment, the PDZRN3-RAF1 fusion polypeptide includes a RAF1 tyrosine kinase domain or a functional fragment thereof. In a related aspect, the invention features PDZRN3-RAF1 fusion polypeptide or fragments operatively linked to heterologous polypeptides to form fusion proteins.

In another embodiment, the PDZRN3-RAF1 fusion polypeptide or fragment is a peptide, e.g., an immunogenic peptide or protein, that contains a fusion junction described herein. Such immunogenic peptides or proteins can be used to raise antibodies specific to the fusion protein. In other embodiments, such immunogenic peptides or proteins can be used for vaccine preparation. The vaccine preparation can include other components, e.g., an adjuvant.

In another aspect, the invention features antibody molecules that bind to a PDZRN3-RAF1 fusion polypeptide or fragment described herein. In embodiments, the antibody can distinguish wild type RAF1 (or PDZRN3) from PDZRN3-RAF1.

Detection Reagents and Detection of Mutations

In another aspect, the invention features a detection reagent, e.g., a purified or an isolated preparation thereof. Detection reagents can distinguish a nucleic acid, or protein sequence, having a breakpoint, e.g., a PDZRN3-RAF1 breakpoint; from a reference sequence. In one embodiment, the detection reagent detects (e.g., specifically detects) a PDZRN3-RAF1 fusion nucleic acid or a polypeptide (e.g., distinguishes a wild type RAF1 or another RAF1 fusion (or PDZRN3) from a PDZRN3-RAF1 nucleic acid (e.g., as described herein in FIGS. 17A-17B (SEQ ID NO:17) and FIGS. 13A-13B (SEQ ID NO:13); or a PDZRN3-RAF1 polypeptide (e.g., as described herein in FIG. 18 (SEQ ID NO:18) and FIG. 14 (SEQ ID NO:14).

Detection reagents, e.g., nucleic acid-based detection reagents, can be used to identify mutations in a target nucleic acid, e.g., DNA, e.g., genomic DNA or cDNA, or RNA, e.g., in a sample, e.g., a sample of nucleic acid derived from a neoplastic or tumor cell, e.g., a melanocytic neoplasm, melanoma or metastatic cell. Detection reagents, e.g., antibody-based detection reagents, can be used to identify mutations in a target protein, e.g., in a sample, e.g., a sample of protein derived from, or produced by, a neoplastic or tumor cell, e.g., a melanocytic neoplasm, melanoma or metastatic cell.

Method of Treatment

RAF1 encodes c-Raf, a member of the Raf family of signaling kinases (Gollob J A, Wilhelm S, Carter C, et al. (2006) Role of Raf kinase in cancer: therapeutic potential of targeting the Raf/MEK/ERK signal transduction pathway. Semin Oncol 33(4):392-406). These kinases are downstream of RAS and activate the MEK-ERK signaling pathway that promotes cell proliferation and survival (Maurer G, Tarkowski B, Baccarini M (2011) Raf kinases in cancer-roles and therapeutic opportunities. Oncogene 30(32):3477-88). The PDZRN3-RAF1 rearrangement has not been reported in the literature (PubMed, 2012) and RAF1 mutations have been reported at a frequency of less than 1% across cancers (COSMIC, August 2012). Based on similarity to another RAF1 fusion protein, SRGAP3-RAF1 (Jones D T, Kocialkowski S, Liu L, et al. (2009) Oncogenic RAF1 rearrangement and a novel BRAF mutation as alternatives to KIAA1549:BRAF fusion in activating the MAPK pathway in pilocytic astrocytoma. Oncogene 28(20):2119-23), PDZNR3-RAF1 is predicted to result in an activated Raf1 kinase (also known as Craf). Sorafenib is a Raf1/Craf inhibitor that is FDA-approved in other tumor types, and pre-clinical evidence suggests that some Raf1 fusions may be sensitive to Sorafenib (Palanisamy N, Ateeq B, Kalyana-Sundaram S, et al. (2010) Rearrangements of the RAF kinase pathway in prostate cancer, gastric cancer and melanoma. Nat Med 16(7):793-8). Other Raf1/Craf inhibitors are currently in clinical development. In addition, activation of Raf1 kinase leads to the downstream activation of Mek. Trials of Mek inhibitors may be relevant for tumors with constitutive Raf1 activation.

Accordingly, in another related aspect, a method of inhibiting, reducing, or treating a hyperproliferative disorder, e.g., a neoplasm (including benign, pre-malignant or malignant (e.g., a cancer), in a subject is provided. The method includes administering to the subject a preselected therapeutic agent, e.g., an anti-cancer agent (e.g., a kinase inhibitor), as a single agent, or in combination, in an amount sufficient to reduce, inhibit or treat the activity or expression of PDZRN3-RAF1 (e.g., a PDZRN3-RAF1 fusion described herein), thereby inhibiting, reducing, or treating the hyperproliferative disorder in the subject.

In one embodiment, the subject treated has a PDZRN3-RAF1 fusion; e.g., the subject has a tumor or cancer harboring a PDZRN3-RAF1 fusion. In other embodiments, the subject has been previously identified as having a PDZRN3-RAF1 fusion. In yet other embodiments, the subject has been previously identified as being likely or unlikely to respond to treatment with a protein kinase inhibitor, e.g., a subject that has previously participated in a clinical trial. In other embodiments, the subject has been previously identified as being likely or unlikely to respond to treatment with a protein kinase inhibitor, based on the presence of the PDZRN3-RAF1 fusion. In one embodiment, the subject is a mammal, e.g., a human. In one embodiment, the subject has, or at risk of having a cancer at any stage of disease. In other embodiments, the subject is a patient, e.g., a cancer patient.

In certain embodiments, the neoplasm or neoplastic cell is a benign, pre-malignant, malignant (cancer) or metastasis. In certain embodiments, the cancer is a solid tumor, a soft tissue tumor, or a metastatic lesion.

In one embodiment, the neoplasm or neoplastic cell is a benign, pre-malignant, malignant (cancer) or metastasis. In certain embodiments, the cancer is a solid tumor, a soft tissue tumor, or a metastatic lesion. In one embodiment, the cancer is an adenocarcinoma. In one embodiment, the cancer is chosen from a lung cancer, a pancreatic cancer, melanoma, a colorectal cancer, an esophageal-gastric cancer, a thyroid cancer, or an adenocarcinoma. In one embodiment, the cancer is an adenocarcinoma. In one embodiment, the cancer is a lung adenocarcinoma. In other embodiment, the lung cancer is chosen from one or more of the following: non-small cell lung cancer (NSCLC), small cell lung cancer (SCLC), squamous cell carcinoma (SCC), adenocarcinoma of the lung, bronchogenic carcinoma, or a combination thereof. In one embodiment, the lung cancer is NSCLC or SCC.

In one embodiment, the anti-cancer agent is a kinase inhibitor. For example, the kinase inhibitor is a multi-kinase inhibitor or a RAF1-specific inhibitor. In one embodiment, the kinase inhibitor is a RAF1 inhibitor including, but not limited to, GDC-0973, GDC-0941, sorafenib (nexavar); PLX-4720; XL281, LGX818, U0126; or regorafenib (BAY 73-4506). In certain embodiments, the RAF1 inhibitor is a MEK inhibitor, In certain embodiments, the MEK inhibitor, is a MEK inhibitor described herein. In certain embodiments, the RAF1 inhibitor is a RAF1 inhibitor described herein.

LMNA-NTRK1 Fusions

In one embodiment, a fusion includes an in-frame fusion of an exon of lamin A/C (LMNA), e.g., one more exons of LMNA (e.g., one or more of exons 1-5 of LMNA) or a fragment thereof, and an exon of neurotrophic tyrosine kinase receptor type 1 (NTRK1), e.g., one or more exons of a NTRK1 (e.g., one or more of exons 12-17 of NTRK1) or a fragment thereof. For example, the LMNA-NTRK1 fusion can include an in-frame fusion within an intron of LMNA (e.g., intron 5) or a fragment thereof, with an intron of NTRK1 (e.g., intron 12) or a fragment thereof. In one embodiment, the fusion of the LMNA-NTRK1 fusion comprises the nucleotide sequence of: chromosome 1 at one or more of nucleotide 156,844,787 (plus or minus 10, 20, 30, 50, 60, 70, 80, 100 or more nucleotides) and chromosome 1 at one or more of nucleotide 156,105,353 (plus or minus 10, 20, 30, 50, 60, 70, 80, 100 or more nucleotides). In one embodiment, the LMNA-NTRK1 fusion is a deletion, e.g., a deletion of a portion of chromosome 1.

In certain embodiments, the LMNA-NTRK1 fusion is in a 5'-LMNA to 3'-NTRK1 configuration (also referred to herein as "5'-LMNA-NTRK1-3')." The term "fusion" or "fusion molecule" can refer to a polypeptide or a nucleic acid fusion, depending on the context. It may include a full-length sequence of a fusion or a fragment thereof, e.g., a fusion junction (e.g., a fragment including a portion of LMNA and a portion of NTRK1, e.g., a portion of the LMNA-NTRK1 fusion described herein). In one embodiment, the LMNA-NTRK1 fusion polypeptide includes a fragment of the amino acid sequence shown in FIG. 20 (SEQ ID NO:20) and a fragment of the amino acid sequence shown in FIG. 22 (SEQ ID NO:22), or an amino acid sequence substantially identical thereto. In another embodiment, the LMNA-NTRK1 fusion nucleic acid includes a fragment of the nucleotide sequence shown in FIGS. 19A-19B (SEQ ID NO:19) and a fragment of the nucleotide sequence shown in FIGS. 21A-21B (SEQ ID NO:21), or a nucleotide sequence substantially identical thereto. In one embodiment, the LMNA-NTRK1 fusion polypeptide comprises sufficient LMNA and sufficient NTRK1 sequence such that the 5' LMNA-3' NTRK1 fusion has kinase activity, e.g., has elevated activity, e.g., NTRK1 tyrosine kinase activity, as compared with wild type NTRK1, e.g., in a cell of a cancer referred to herein (e.g., non-langerhans histocytosis).

In certain embodiments, the LMNA-NTRK1 fusion comprises one or more (or all of) exons 1-5 from LMNA and one or more (or all of) exons 12-17 of NTRK1 (e.g., one or more of the exons shown in FIGS. 19A-19B (SEQ ID NO:19) and FIGS. 21A-21B (SEQ ID NO:21). In another embodiment, the LMNA-NTRK1 fusion comprises one or more (or all of) exons 1-5 of LMNA and one or more (or all of) exons 12-17 of NTRK1. In certain embodiments, the LMNA-NTRK1 fusion comprises at least 1, 2, 3, 4, 5 or more exons (encoded exons) from LMNA and at least 1, 2, 3, 4, 5, or more exons (encoded exons) from NTRK1 (e.g., from the LMNA and NTRK1 sequences shown in FIGS. 19A-19B and FIG. 20 (SEQ ID NO:19 and 20) and FIGS. 21A-21C and FIGS. 22A-22C (SEQ ID NOs:21 and 22)).

In certain embodiments, the LMNA-NTRK1 fusion comprises exon 5 or a fragment thereof from LMNA, and exon 12 or a fragment thereof from NTRK1 (e.g., as shown in FIGS. 19A-19B (SEQ ID NO:19) and FIGS. 21A-21B (SEQ ID NO:21)). In one embodiment, the LMNA-NTRK1 fusion comprises at least 5, 10, 15, 20, 30, 40, 50 or more amino acids from exon 5 of LMNA (e.g., from the amino acid sequence of LMNA as shown in FIG. 20 (SEQ ID NO:20) (e.g., from the amino acid sequence of LMNA preceding the fusion junction with NTRK1, and at least 5, 10, 15, 20, 30, 40, 50 or more amino acids from exon 12 of NTRK1 (e.g., from the amino acid sequence of NTRK1 as shown in FIG. 22 (SEQ ID NO:22)). In another embodiment, the LMNA-NTRK1 fusion comprises at least 6, 12, 15, 20, 25, 50, 75, 100 or more nucleotides from exon 5 of LMNA (e.g., from the nucleotide sequence of LMNA as shown in FIGS. 19A-19B (SEQ ID NO:19) (e.g., from the nucleotide sequence of LMNA preceding the fusion junction with NTRK1); and at least 6, 12, 15, 20, 25, 50, 75, 100 or more nucleotides from exon 12 of NTRK1 (e.g., from the nucleotide sequence of NTRK1 as shown in FIGS. 21A-21B (SEQ ID NO:21).

LMNA-NTRK1 Nucleic Acid Molecules

In one aspect, the invention features a nucleic acid molecule (e.g., an isolated or purified) nucleic acid molecule that includes a fragment of a LMNA gene and a fragment of a NTRK1 gene. In one embodiment, the nucleotide sequence encodes a LMNA-NTRK1 fusion polypeptide that includes a NTRK1 tyrosine kinase domain or a functional fragment thereof. In another embodiment, the nucleotide sequence encodes a fragment of the NTRK1 polypeptide of the amino acid sequence of SEQ ID NO:22 or a fragment thereof, or a sequence substantially identical thereto. In other embodiments, the nucleic acid molecule includes a fragment of the LMNA gene encoding the amino acid sequence of SEQ ID NO:20 or a fragment thereof, or a sequence substantially identical thereto. In yet other embodiments, the nucleic acid molecule includes a nucleotide sequence encoding the amino acid sequence shown in FIG. 20 (SEQ ID NO:20), or a fragment thereof, and the amino acid sequence shown in FIG. 22 (SEQ ID NO:22) or a fragment thereof, or a sequence substantially identical thereto.

In one embodiment, the nucleic acid molecule includes a fusion, e.g., an in-frame fusion, between an intron of LMNA (e.g., intron 5, or a fragment thereof), and an intron of NTRK1 (e.g., intron 12, or a fragment thereof). The LMNA-NTRK1 fusion can comprise a fusion of the nucleotide sequence of: chromosome 1 at one or more of nucleotide 156,844,787 (plus or minus 10, 20, 30, 50, 60, 70, 80, 100 nucleotides) and chromosome 1 at one or more of nucleotide 156,105,353 (plus or minus 10, 20, 30, 50, 60, 70, 80, 100 nucleotides), or a fragment thereof. In one embodiment, the LMNA-NTRK1 fusion comprises a fusion of the nucleotide sequence of: chromosome 1 at one or more of nucleotide 156,844,787 (plus or minus 10, 20, 30, 50, 60, 70, 80, 100 nucleotides) and chromosome 1 at one or more of nucleotide 156,105,353 (plus or minus 10, 20, 30, 50, 60, 70, 80, 100 nucleotides), or a fragment thereof.

In another embodiment, the LMNA-NTRK1 fusion comprises a nucleotide sequence (e.g., a fragment of a nucleotide sequence) shown in FIGS. 19A-19B (SEQ ID NO:19) and a nucleotide sequence (e.g., a fragment of a nucleotide sequence) shown in FIGS. 21A-21B (SEQ ID NO:21), or a fragment of the fusion. In one embodiment, the LMNA-NTRK1 fusion comprises a nucleotide sequence substantially identical to the nucleotide sequence (e.g., a fragment of a nucleotide sequence) shown in FIGS. 19A-19B (SEQ ID NO:19) and the nucleotide sequence (e.g., a fragment of a nucleotide sequence) shown FIGS. 21A-21B (SEQ ID NO:21), or a fragment of the fusion. In one embodiment, the LMNA-NTRK1 fusion comprises a nucleotide sequence at least 70%, at least 75%, at least 80%, at least 85%, at least 90%, at least 95%, at least 99%, at least 99.5 or greater, identical to the nucleotide sequence (e.g., a fragment of a nucleotide sequence) shown in FIGS. 19A-19B (SEQ ID NO:19) and to the nucleotide sequence (e.g., a fragment of a nucleotide sequence) shown in FIGS. 21A-21B (SEQ ID NO:21). In one embodiment, the LMNA-NTRK1 fusion comprises a nucleotide sequence containing at least 25, 50, 100, 150, 200, 500, 1000, 1500, 2000, 2500, 3000, or more nucleotides of the nucleotide sequence shown in FIGS. 19A-19B (SEQ ID NO:19) and a nucleotide sequence containing at least 25, 50, 100, 150, 200, 500, 1000, 1500, 2000, 2500, 3000, or more nucleotides of the nucleotide sequence shown in FIGS. 21A-21B (SEQ ID NO:21). In one embodiment, the LMNA-NTRK1 fusion comprises a nucleotide sequence containing at least 25, 50, 100, 150, 200, 500, 1000, 1500, 2000, 2500, 3000, or more contiguous nucleotides of the nucleotide sequence shown in FIGS. 19A-19B (SEQ ID NO:19) and a nucleotide sequence containing at least 25, 50, 100, 150, 200, 500, 1000, 1500, 2000, 2500, 3000, or more nucleotides of the nucleotide sequence shown in FIGS. 21A-21B (SEQ ID NO:21).

In another embodiment, the nucleic acid molecule includes a fusion, e.g., an in-frame fusion, of at least exon 5 of LMNA or a fragment thereof (e.g., one or more of exons 1-5 of LMNA or a fragment thereof), and at least exon 12 or a fragment thereof (e.g., one or more of exons 12-17 of NTRK1 or a fragment thereof). In yet other embodiments, the nucleic acid molecule includes a fragment the nucleotide sequence shown in FIGS. 19A-19B (SEQ ID NO:19) and a fragment of the nucleotide sequence shown in FIGS. 21A-21B (SEQ ID NO:21) or a fragment of the fusion, or a sequence substantially identical thereto.

In one embodiment, the nucleic acid molecule is complementary to at least a portion of a nucleotide sequence disclosed herein, e.g., is capable of hybridizing under a stringency condition described herein to SEQ ID NO:19 and/or SEQ ID NO:21, or a fragment thereof. In yet another embodiment, the nucleic acid molecule hybridizes to a nucleotide sequence that is complementary to at least a portion of a nucleotide sequence disclosed herein, e.g., is capable of hybridizing under a stringency condition to a nucleotide sequence complementary to SEQ ID NO:19 and/or SEQ ID NO:21, or a fragment thereof. The nucleotide sequence of a cDNA encoding an exemplary 5' LMNA-3' NTRK1 fusion is shown in at least exon 5 (e.g., exons 1-5) of SEQ ID NO:19 and at least exon 12 (e.g., exons 12-17) of SEQ ID NO:21, and the predicted amino acid sequence is shown in the corresponding encoded exons of SEQ ID NO:20 and the corresponding encoded exons of SEQ ID NO:22, respectively.

In an embodiment the LMNA-NTRK1 nucleic acid molecule comprises sufficient LMNA and sufficient NTRK1 sequence such that the encoded 5' LMNA-3' NTRK1 fusion has kinase activity, e.g., has elevated activity, e.g., NTRK1 kinase activity, as compared with wild type NTRK1, e.g., in a cell of a cancer referred to herein. In certain embodiments, the 5' LMNA-3' NTRK1 fusion comprises exons 1-5 from LMNA and exon 12-17 from NTRK1. In certain embodiments, the LMNA-NTRK1 fusion comprises at least 1, 2, 3, 4, 5 or more exons from LMNA and at least 1, 2, 3, 4, 5, or more, exons from NTRK1. In certain embodiments, the LMNA-NTRK1 fusion comprises a fusion of exon 5 from LMNA and exon 12 from NTRK1. In another embodiment, the LMNA-NTRK1 fusion comprises at least 1, 2, 3, 4, 5 exons from LMNA; and at least 1, 2, 3, 4, 5, exons from NTRK1.

In one embodiment, the nucleic acid molecule includes a nucleotide sequence that has an in-frame fusion of intron 5 of LMNA (e.g., NM_170707) with intron 12 of NTRK1 (e.g., NM_002529). In another embodiment, the nucleic acid molecule includes a nucleotide sequence that includes a breakpoint. For example, the nucleic acid molecule includes a nucleotide sequence that includes the fusion junction between the LMNA gene and the NTRK1 gene, e.g., the breakpoint between intron 5 of LMNA and intron 11 of NTRK1. In other embodiments, the nucleic acid molecules includes a nucleotide sequence of one or more of nucleotide 156,844,787 of chromosome 1 coupled to (e.g., directly or indirectly juxtaposed to) one or more of nucleotide 156,105,353 of chromosome 1. In one embodiment, the nucleic acid molecule includes the nucleotide sequence of: chromosome 1 at one or more of nucleotide 156,844,787 plus or minus 10, 20, 30, 40 50, 60, 80, 100, 150 nucleotides and chromosome 1 at one or more of nucleotide 156,105,353 plus or minus 10, 20, 30, 40 50, 60, 80, 100, 150 nucleotides (corresponding to the breakpoint of a LMNA-NTRK1 fusion), or a fragment thereof, or a sequence substantially identical thereto. In one embodiment, the nucleic acid molecule is complementary to at least a portion of a nucleotide sequence disclosed herein, e.g., is capable of hybridizing under a stringency condition described herein to SEQ ID NO:19 and/or SEQ ID NO:21 or a fragment thereof. In yet other embodiment, the nucleic acid molecule hybridizes to a nucleotide sequence that is complementary to at least a portion of a nucleotide sequence disclosed herein, e.g., is capable of hybridizing under a stringency condition described herein to a nucleotide sequence complementary to SEQ ID NO:19 or 21 or a fragment thereof.

In another embodiment, the LMNA-NTRK1 fusion nucleic acid comprises at least 6, 12, 15, 20, 25, 50, 75, 100 or more nucleotides from exon 5 of LMNA (e.g., from the nucleotide sequence of LMNA preceding the fusion junction with NTRK1, e.g., of the LMNA sequence shown in FIGS. 19A-19B (SEQ ID NO:19)), and at least 6, 12, 15, 20, 25, 50, 75, 100 or more nucleotides from exon 12 of NTRK1 (e.g., from the nucleotide sequence of NTRK1 following the fusion junction with LMNA, e.g., of the NTRK1 sequence shown in FIGS. 21A-21B (SEQ ID NO:21)).

In other embodiments, the nucleic acid molecule includes a nucleotide sequence encoding a LMNA-NTRK1 fusion polypeptide that includes a fragment of a LMNA gene and a fragment of an NTRK1 gene. In one embodiment, the nucleotide sequence encodes a LMNA-NTRK1 fusion polypeptide that includes e.g., an NTRK1 tyrosine kinase domain or a functional fragment thereof. In yet other embodiments, the nucleic acid molecule includes a nucleotide sequence encoding the amino acid sequence (e.g., a fragment of the amino acid sequence) shown in FIG. 20 (e.g., SEQ ID NO:20) and a nucleotide sequence encoding the amino acid sequence (e.g., a fragment of the amino acid sequence) shown in FIG. 22 (e.g., SEQ ID NO:22), or a fragment of the fusion, or a sequence substantially identical thereto. In one embodiment, the encoded LMNA-NTRK1 fusion polypeptide includes an NTRK1 tyrosine kinase domain or a functional fragment thereof.

In a related aspect, the invention features nucleic acid constructs that include the LMNA-NTRK1 nucleic acid molecules described herein. In certain embodiments, the nucleic acid molecules are operatively linked to a native or a heterologous regulatory sequence. Also included are vectors and host cells that include the LMNA-NTRK1 nucleic acid molecules described herein, e.g., vectors and host cells suitable for producing the nucleic acid molecules and polypeptides described herein.

In a related aspect, methods of producing the nucleic acid molecules and polypeptides described herein are also described.

In another aspect, the invention features nucleic acid molecules that reduce or inhibit the expression of a nucleic acid molecule that encodes a LMNA-NTRK1 fusion described herein. Examples of such nucleic acid molecules include, for example, antisense molecules, ribozymes, RNAi, triple helix molecules that hybridize to a nucleic acid encoding LMNA-NTRK1, or a transcription regulatory region of LMNA-NTRK1, and blocks or reduces mRNA expression of LMNA-NTRK1.

Nucleic Acid Detection and Capturing Reagents

The invention also features a nucleic acid molecule, e.g., nucleic acid fragment, suitable as probe, primer, bait or library member that includes, flanks, hybridizes to, which are useful for identifying, or are otherwise based on, the LMNA-NTRK1 fusions described herein. In certain embodiments, the probe, primer or bait molecule is an oligonucleotide that allows capture, detection or isolation of a LMNA-NTRK1 fusion nucleic acid molecule described herein. The oligonucleotide can comprise a nucleotide sequence substantially complementary to a fragment of the LMNA-NTRK1 fusion nucleic acid molecules described herein. The sequence identity between the nucleic acid fragment, e.g., the oligonucleotide, and the target LMNA-NTRK1 sequence need not be exact, so long as the sequences are sufficiently complementary to allow the capture, detection or isolation of the target sequence. In one embodiment, the nucleic acid fragment is a probe or primer that includes an oligonucleotide between about 5 and 25, e.g., between 10 and 20, or 10 and 15 nucleotides in length. In other embodiments, the nucleic acid fragment is a bait that includes an oligonucleotide between about 100 to 300 nucleotides, 130 and 230 nucleotides, or 150 and 200 nucleotides, in length.

In one embodiment, the nucleic acid fragment can be used to identify or capture, e.g., by hybridization, a LMNA-NTRK1 fusion. For example, the nucleic acid fragment can be a probe, a primer, or a bait, for use in identifying or capturing, e.g., by hybridization, a LMNA-NTRK1 fusion described herein. In one embodiment, the nucleic acid fragment can be useful for identifying or capturing a LMNA-NTRK1 breakpoint, e.g., the nucleotide sequence of: chromosome 1 at nucleotide 156,844,787 plus or minus 10, 20, 30, 40 50, 60, 80, 100, 150 nucleotides and chromosome 1 at nucleotide 156,105,353 plus or minus 10, 20, 30, 40 50, 60, 80, 100, 150 nucleotides.

In one embodiment, the nucleic acid fragment hybridizes to a nucleotide sequence within a chromosomal rearrangement that creates an in-frame fusion of intron 5 of LMNA with intron 11 of NTRK1. In one embodiment, the nucleic acid fragment hybridizes to a nucleotide sequence in the region In other embodiments, the nucleic acid molecules includes a nucleotide sequence in the region of nucleotides 156,844,787 of chromosome 1 coupled to (e.g., juxtaposed to) nucleotides in the region of nucleotides 156,105,353 of chromosome 1. In one embodiment, the nucleic acid fragment hybridizes to a nucleotide sequence that includes a breakpoint, e.g., the nucleotide sequence of: chromosome 1 at nucleotide 156,844,787 plus or minus 10, 20, 30, 40 50, 60, 80, 100, 150 or more nucleotides and chromosome 1 at nucleotide 156,105,353 plus or minus 10, 20, 30, 40 50, 60, 80, 100, 150 or more nucleotides. For example, the nucleic acid fragment can hybridize to a nucleotide sequence that includes the fusion junction between the LMNA gene and the NTRK1 gene, e.g., a nucleotide sequence that includes a portion of a nucleotide sequence within introns 5 of a LMNA gene and 11 of a NTRK1 gene.

In another embodiment, the nucleic acid fragment hybridizes to a nucleotide sequence that comprises at least 6, 12, 15, 20, 25, 50, 75, 100, 150 or more nucleotides from exon 5 of LMNA (e.g., from the nucleotide sequence of LMNA preceding the fusion junction with NTRK1, e.g., of the LMNA sequence shown in FIGS. 19A-19B (SEQ ID NO:19)), and at least 6, 12, 15, 20, 25, 50, 75, 100, 150 or more nucleotides from exon 12 of NTRK1 (e.g., from the nucleotide sequence of NTRK1 following the fusion junction with LMNA, e.g., of the NTRK1 sequence shown in FIGS. 21A-21B (SEQ ID NO:21)).

The probes or primers described herein can be used, for example, for FISH detection or PCR amplification. In one exemplary embodiment where detection is based on PCR, amplification of the LMNA-NTRK1 fusion junction fusion junction can be performed using a primer or a primer pair, e.g., for amplifying a sequence flanking the fusion junctions described herein, e.g., the mutations or the junction of a chromosomal rearrangement described herein, e.g., LMNA-NTRK1.

In one embodiment, a pair of isolated oligonucleotide primers can amplify a region containing or adjacent to a position in the LMNA-NTRK1 fusion. For example, forward primers can be designed to hybridize to a nucleotide sequence within LMNA genomic or mRNA sequence (e.g., a nucleotide sequence within exon 5 of LMNA of SEQ ID NO:19), and the reverse primers can be designed to hybridize to a nucleotide sequence of NTRK1 (e.g., a nucleotide sequence within exon 12 of NTRK1, of SEQ ID NO:21).

In another embodiment, the nucleic acid fragments can be used to identify, e.g., by hybridization, a LMNA-NTRK1 fusion. In one embodiment, the nucleic acid fragment hybridizes to a nucleotide sequence that includes a fusion junction between the LMNA transcript and the NTRK1 transcript.

In other embodiments, the nucleic acid fragment includes a bait that comprises a nucleotide sequence that hybridizes to a LMNA-NTRK1 fusion nucleic acid molecule described herein, and thereby allows the capture or isolation said nucleic acid molecule. In one embodiment, a bait is suitable for solution phase hybridization. In other embodiments, a bait includes a binding entity, e.g., an affinity tag, that allows capture and separation, e.g., by binding to a binding entity, of a hybrid formed by a bait and a nucleic acid hybridized to the bait.

In other embodiments, the nucleic acid fragment includes a library member comprising a LMNA-NTRK1 nucleic acid molecule described herein. In one embodiment, the library member includes a rearrangement that results in a LMNA-NTRK1 fusion described herein.

The nucleic acid fragment can be detectably labeled with, e.g., a radiolabel, a fluorescent label, a bioluminescent label, a chemiluminescent label, an enzyme label, a binding pair label, or can include an affinity tag; a tag, or identifier (e.g., an adaptor, barcode or other sequence identifier).

LMNA-NTRK1 Fusion Polypeptides

In another embodiment, the LMNA-NTRK1 fusion comprises an amino acid sequence (e.g., a fragment of the amino acid sequence) shown in FIG. 20 (SEQ ID NO:20) and an amino acid sequence (e.g., a fragment of the amino acid sequence) shown in FIG. 22 (SEQ ID NO:22), or a fragment of the fusion. In one embodiment, the LMNA-NTRK1 fusion comprises an amino acid sequence substantially identical to the amino acid sequence (e.g., a fragment of the amino acid sequence) shown in FIG. 20 (SEQ ID NO:20) and the amino acid sequence (e.g., a fragment of the amino acid sequence) shown in FIG. 22 (SEQ ID NO:22), or a fragment thereof. In one embodiment, the LMNA-NTRK1 fusion comprises an amino acid sequence at least 70%, at least 75%, at least 80%, at least 85%, at least 90%, at least 95%, at least 99%, at least 99.5 or greater, identical to the amino acid sequence (e.g., a fragment of the amino acid sequence) shown in FIG. 20 (SEQ ID NO:20) and the amino acid sequence (e.g., a fragment of the amino acid sequence) shown in FIG. 22 (SEQ ID NO:22). In one embodiment, the LMNA-NTRK1 fusion comprises a sequence containing at least 10, 20, 50, 100, 500, 600, 700, 800, 900, 1000, or more amino acids of the amino acid sequence shown in FIG. 20 (SEQ ID NO:20) and FIG. 22 (SEQ ID NO:22). In one embodiment, the LMNA-NTRK1 fusion comprises an amino acid sequence containing at least 5, 10, 20, 50, 100, 500, 600, 700, 800, 900, 1000, or more contiguous amino acids of the amino acid sequence shown in FIG. 20 (SEQ ID NO:20) and at least 5, 10, 20, 50, 100, 500, 600, 700, 800, 900, 1000, or more contiguous amino acids of the amino acid sequence shown in FIG. 22 (SEQ ID NO:22). In one embodiment, the 5' LMNA-3' NTRK1 fusion polypeptide includes a NTRK1 receptor tyrosine kinase domain or a functional fragment thereof. In an embodiment, the 5'LMNA-3'NTRK1 fusion polypeptide comprises sufficient NTRK1 and sufficient LMNA sequence such that it has kinase activity, e.g., has elevated activity, e.g., NTRK1 kinase activity, as compared with wild type NTRK1, e.g., in a cell of a cancer referred to herein.

In another aspect, the invention features a LMNA-NTRK1 fusion polypeptide (e.g., a purified LMNA-NTRK1 fusion polypeptide), a biologically active or antigenic fragment thereof, as well as reagents (e.g., antibody molecules that bind to a LMNA-NTRK1 fusion polypeptide), methods for modulating a LMNA-NTRK1 polypeptide activity and detection of a LMNA-NTRK1 polypeptide.

In one embodiment, the LMNA-NTRK1 fusion polypeptide has at least one biological activity, e.g., an NTRK1 kinase activity. In one embodiment, at least one biological activity of the LMNA-NTRK1 fusion polypeptide is reduced or inhibited by an anti-cancer drug, e.g., a kinase inhibitor (e.g., a multikinase inhibitor or an NTRK1-specific inhibitor). In one embodiment, at least one biological activity of the LMNA-NTRK1 fusion polypeptide is reduced or inhibited by an NTRK1 kinase inhibitor chosen from e.g., lestaurtinib (CEP-701); AZ-23; indenopyrrolocarboazole 12a; oxindole 3; isothiazole 5n; thiazole 20 h.

In yet other embodiments, the LMNA-NTRK1 fusion polypeptide is encoded by a nucleic acid molecule described herein. In one embodiment, the LMNA-NTRK1 fusion polypeptide is encoded by an in-frame fusion of intron 5 of LMNA with intron 11 of NTRK1 (e.g., a sequence on chromosome 1). In another embodiment, the LMNA-NTRK1 fusion polypeptide includes an amino acid sequence encoded by a nucleotide sequence comprising a fusion junction between the LMNA transcript and the NTRK1 transcript.

In certain embodiments, the LMNA-NTRK1 fusion polypeptide comprises one or more of encoded exons 1-5 from LMNA and one or more of encoded exon 12-17 of NTRK1. In certain embodiments, the LMNA-NTRK1 fusion polypeptide comprises at least 1, 2, 3, 4, 5 or more encoded exons from LMNA and at least 1, 2, 3, 4, 5 or more, encoded exons from NTRK1. In certain embodiments, the LMNA-NTRK1 fusion polypeptide comprises a fusion of encoded exon 5 from LMNA and encoded exon 12 from NTRK1 (or a fragment thereof). In other embodiments, the fusion comprises least 1, 2, 3, 4, 5 encoded exons from LMNA; and at least 1, 2, 3, 4, 5 encoded exons from NTRK1. In certain embodiments, the LMNA-NTRK1 fusion polypeptide comprises encoded exons 1-5 from LMNA and exon 12-17 of NTRK1. In certain embodiments, the 5' LMNA-3' NTRK1 fusion polypeptide comprises a fusion junction of the sequence of exon 5 from LMNA and the sequence of exon 12 from NTRK1.

In certain embodiments, the LMNA-NTRK1 fusion comprises the amino acid sequence corresponding to exon 5 or a fragment thereof from LMNA, and the amino acid sequence corresponding to exon 12 or a fragment thereof from NTRK1 (e.g., as shown in FIG. 20 (SEQ ID NO:20) and FIG. 22 (SEQ ID NO:22)). In one embodiment, the LMNA-NTRK1 fusion comprises at least 5, 10, 15, 20 or more amino acids from exon 5 of LMNA (e.g., from the amino acid sequence of LMNA preceding the fusion junction with NTRK1, e.g., of the LMNA sequence shown in FIG. 20 (SEQ ID NO:20)), and at least 5, 10, 15, 20 or more amino acids from exon 12 of NTRK1 (e.g., from the amino acid sequence of NTRK1 following the fusion junction with LMNA, e.g., of the NTRK1 sequence shown in FIG. 22 (SEQ ID NO:22)).

In one embodiment, the LMNA-NTRK1 fusion polypeptide includes a NTRK1 tyrosine kinase domain or a functional fragment thereof. In a related aspect, the invention features LMNA-NTRK1 fusion polypeptide or fragments operatively linked to heterologous polypeptides to form fusion proteins.

In another embodiment, the LMNA-NTRK1 fusion polypeptide or fragment is a peptide, e.g., an immunogenic peptide or protein, that contains a fusion junction described herein. Such immunogenic peptides or proteins can be used to raise antibodies specific to the fusion protein. In other embodiments, such immunogenic peptides or proteins can be used for vaccine preparation. The vaccine preparation can include other components, e.g., an adjuvant.

In another aspect, the invention features antibody molecules that bind to a LMNA-NTRK1 fusion polypeptide or fragment described herein. In embodiments, the antibody can distinguish wild type NTRK1 (or LMNA) from LMNA-NTRK1.

Detection Reagents and Detection of Mutations

In another aspect, the invention features a detection reagent, e.g., a purified or an isolated preparation thereof. Detection reagents can distinguish a nucleic acid, or protein sequence, having a breakpoint, e.g., a LMNA-NTRK1 breakpoint; from a reference sequence. In one embodiment, the detection reagent detects (e.g., specifically detects) a LMNA-NTRK1 fusion nucleic acid or a polypeptide (e.g., distinguishes a wild type NTRK1 or another NTRK1 fusion (or LMNA) from a LMNA-NTRK1 nucleic acid (e.g., as described herein in FIGS. 19A-19B (SEQ ID NO:19) and FIGS. 21A-21B (SEQ ID NO:21); or a LMNA-NTRK1 polypeptide (e.g., as described herein in FIG. 20 (SEQ ID NO:20) and FIG. 22A (SEQ ID NO:22).

Detection reagents, e.g., nucleic acid-based detection reagents, can be used to identify mutations in a target nucleic acid, e.g., DNA, e.g., genomic DNA or cDNA, or RNA, e.g., in a sample, e.g., a sample of nucleic acid derived from a neoplastic or tumor cell, e.g., a melanocytic neoplasm, melanoma or metastatic cell. Detection reagents, e.g., antibody-based detection reagents, can be used to identify mutations in a target protein, e.g., in a sample, e.g., a sample of protein derived from, or produced by, a neoplastic or tumor cell, e.g., a melanocytic neoplasm, melanoma or metastatic cell.

Method of Treatment

NTRK1 encodes a receptor tyrosine kinase that plays a role in the development of the nervous system by regulating cell proliferation, differentiation and survival of neurons. NTRK1 is activated upon binding of its ligand NGF (Klein R, Jing S Q, Nanduri V, et al. (1991) The trk proto-oncogene encodes a receptor for nerve growth factor. Cell 65(1):189-97) to promote several downstream signaling pathways, including GRB2-Ras-MAPK, NF-Kappa-B, and Ras-PI3 kinase-AKT1 (Wooten M W, Seibenhener M L, Mamidipudi V, et al. (2001) The atypical protein kinase C-interacting protein p62 is a scaffold for NF-kappaB activation by nerve growth factor. J Biol Chem 276(11):7709-12, Stephens R M, Loeb D M, Copeland T D, et al. (1994) Trk receptors use redundant signal transduction pathways involving SHC and PLC-gamma 1 to mediate NGF responses. Neuron 12(3): 691-705, Tacconelli A, Farina A R, Cappabianca L, et al. (2004) TrkA alternative splicing: a regulated tumor-promoting switch in human neuroblastoma. Cancer Cell 6(4):347-60). The rearrangement detected in this tumor results in a fusion that contains an N-terminal portion of LMNA (Lamin A, possibly exons 1-5) fused to the C-terminal portion of NTRK1 (possibly exons 11-17). There are no reports in the literature of LMNA-NTRK1 fusion proteins (PubMed, September 2012). The fusion protein reported herein is expected to be active, as it contains a full NTRK1 kinase domain (Indo Y, Mardy S, Tsuruta M, et al. (1997) Structure and organization of the human TRKA gene encoding a high affinity receptor for nerve growth factor. Jpn J Hum Genet 42(2):343-51); further, it may have constitutive kinase activity, by comparison to other NTRK1 fusions reported in thyroid papillary carcinoma (Greco A, Mariani C, Miranda C, et al. (1993) Characterization of the NTRK1 genomic region involved in chromosomal rearrangements generating TRK oncogenes. Genomics 18(2):397-400, Greco A, Mariani C, Miranda C, et al. (1995) The DNA rearrangement that generates the TRK-T3 oncogene involves a novel gene on chromosome 3 whose product has a potential coiled-coil domain. Mol Cell Biol 15(11):6118-27, Greco A, Pierotti M A, Bongarzone I, et al. (1992) TRK-T1 is a novel oncogene formed by the fusion of TPR and TRK genes in human papillary thyroid carcinomas. Oncogene 7(2):237-42, Martin-Zanca D, Hughes S H, Barbacid M A human oncogene formed by the fusion of truncated tropomyosin and protein tyrosine kinase sequences. Nature 319(6056):743-8). Fusions or rearrangements involving NTRK1 have not been reported in non-Langerhans histiocytosis. NTRK1 inhibitors can be used to treat the cancers described herein.

Accordingly, in another aspect, a method of inhibiting, reducing, or treating a hyperproliferative disorder, e.g., a neoplasm (including benign, pre-malignant or malignant (e.g., a cancer), in a subject is provided. The method includes administering to the subject a preselected therapeutic agent, e.g., an anti-cancer agent (e.g., a kinase inhibitor), as a single agent, or in combination, in an amount sufficient to reduce, inhibit or treat the activity or expression of LMNA-NTRK1 (e.g., a LMNA-NTRK1 fusion described herein), thereby inhibiting, reducing, or treating the hyperproliferative disorder in the subject.

In one embodiment, the subject treated has a LMNA-NTRK1 fusion; e.g., the subject has a tumor or cancer harboring a LMNA-NTRK1 fusion. In other embodiments, the subject has been previously identified as having a LMNA-NTRK1 fusion. In yet other embodiments, the subject has been previously identified as being likely or unlikely to respond to treatment with a protein kinase inhibitor, e.g., a subject that has previously participated in a clinical trial. In other embodiments, the subject has been previously identified as being likely or unlikely to respond to treatment with a protein kinase inhibitor, based on the presence of the LMNA-NTRK1 fusion. In one embodiment, the subject is a mammal, e.g., a human. In one embodiment, the subject has, or at risk of having a cancer at any stage of disease. In other embodiments, the subject is a patient, e.g., a cancer patient.

In certain embodiments, the neoplasm or neoplastic cell is a benign, pre-malignant, malignant (cancer) or metastasis. In certain embodiments, the cancer is a solid tumor, a soft tissue tumor, or a metastatic lesion.

In one embodiment, the neoplasm or neoplastic cell is a benign, pre-malignant, malignant (cancer) or metastasis. In certain embodiments, the cancer is a solid tumor, a soft tissue tumor, or a metastatic lesion. In an embodiment, the cancer is a non-langerhans histiocytosis. In one embodiment, the cancer is chosen from a lung cancer, a pancreatic cancer, melanoma, a colorectal cancer, an esophageal-gastric cancer, a thyroid cancer, or an adenocarcinoma. In one embodiment, the cancer is a lung adenocarcinoma. In other embodiment, the lung cancer is chosen from one or more of the following: non-small cell lung cancer (NSCLC), small cell lung cancer (SCLC), squamous cell carcinoma (SCC), adenocarcinoma of the lung, bronchogenic carcinoma, or a combination thereof. In one embodiment, the lung cancer is NSCLC or SCC. In one embodiment, the cancer is a neuroblastoma. In certain embodiments, the cancer is leukemia, e.g., a myeloid leukemia.

In one embodiment, the anti-cancer agent is a kinase inhibitor. For example, the kinase inhibitor is a multi-kinase inhibitor or a NTRK1-specific inhibitor. In one embodiment, the kinase inhibitor is a NTRK1 inhibitor including, but not limited to, danusertib (PHA-739358); PHA-848125; CEP-2563; K252a; KRC-108; lestaurtinib (CEP-701); AZ-23; indenopyrrolocarboazole 12a; oxindole 3; isothiazole 5n; thiazole 20 h. In certain embodiments, the inhibitor is an HSP90 inhibitor, In certain embodiments, the HSP90 inhibtior is 17-DMAG. In certain embodiments, the NTRK1 inhibitor is an NTRK1 inhibitor described herein.

RABGAP1L-NTRK1 Fusions

In one embodiment, a fusion includes an in-frame fusion of an exon of RAB GTPase activating protein 1-like (RABGAP1L), e.g., one more exons of RABGAP1L (e.g., one or more of exons 1-14 of RABGAP1L) or a fragment thereof, and an exon of neurotrophic tyrosine kinase receptor type 1 (NTRK1), e.g., one or more exons of a NTRK1 (e.g., one or more of exons 16-17 of NTRK1) or a fragment thereof. For example, the RABGAP1L-NTRK1 fusion can include an in-frame fusion within an intron of RABGAP1L (e.g., intron 14) or a fragment thereof, with an intron of NTRK1 (e.g., intron 15) or a fragment thereof. In one embodiment, the fusion of the RABGAP1L-NTRK1 fusion comprises the nucleotide sequence of: chromosome 1 at one or more of nucleotide 156,849,730 (plus or minus 10, 20, 30, 50, 60, 70, 80, 100 or more nucleotides) and chromosome 1 at one or more of nucleotide 174,637,720 (plus or minus 10, 20, 30, 50, 60, 70, 80, 100 or more nucleotides). In one embodiment, the RABGAP1L-NTRK1 fusion is a deletion, e.g., a deletion of a portion of chromosome 1.

In certain embodiments, the RABGAP1L-NTRK1 fusion is in a 5'-RABGAP1L to 3'-NTRK1 configuration (also referred to herein as "5'-RABGAP1L-NTRK1-3')." The term "fusion" or "fusion molecule" can refer to a polypeptide or a nucleic acid fusion, depending on the context. It may include a full-length sequence of a fusion or a fragment thereof, e.g., a fusion junction (e.g., a fragment including a portion of RABGAP1L and a portion of NTRK1, e.g., a portion of the RABGAP1L-NTRK1 fusion described herein). In one embodiment, the RABGAP1L-NTRK1 fusion polypeptide includes a fragment of the amino acid sequence shown in FIG. 24 (SEQ ID NO:24) and a fragment of the amino acid sequence shown in FIG. 22 (SEQ ID NO:22), or an amino acid sequence substantially identical thereto. In another embodiment, the RABGAP1L-NTRK1 fusion nucleic acid includes a fragment of the nucleotide sequence shown in FIGS. 23A-23B (SEQ ID NO:23) and a fragment of the nucleotide sequence shown in FIGS. 21A-21B (SEQ ID NO:21), or a nucleotide sequence substantially identical thereto. In one embodiment, the RABGAP1L-NTRK1 fusion polypeptide comprises sufficient RABGAP1L and sufficient NTRK1 sequence such that the 5' RABGAP1L-3' NTRK1 fusion has kinase activity, e.g., has elevated activity, e.g., NTRK1 tyrosine kinase activity, as compared with wild type NTRK1, e.g., in a cell of a cancer referred to herein (e.g., cholangiocarcinoma).

In certain embodiments, the RABGAP1L-NTRK1 fusion comprises one or more (or all of) exons 1-14 from RABGAP1L and one or more (or all of) exons 16-17 of NTRK1 (e.g., one or more of the exons shown in FIGS. 23A-23C (SEQ ID NO:23) and FIGS. 21A-21C (SEQ ID NO:21). In another embodiment, the RABGAP1L-NTRK1 fusion comprises one or more (or all of) exons 1-14 of RABGAP1L and one or more (or all of) exons 16-17 of NTRK1. In certain embodiments, the RABGAP1L-NTRK1 fusion comprises at least 1, 2, 3, 4, 5, 6, 7, 8, 9, 10, 11, 12, 13, 14 or more exons (or encoded exons) from RABGAP1L and at least 1, 2 or more exons (or encoded exons) from NTRK1 (e.g., from the RABGAP1L and NTRK1 sequences shown in FIGS. 23A-23B and FIG. 24 (SEQ ID NO:23 and 24) and FIGS. 21A-21B and FIG. 22 (SEQ ID NOs:21 and 22).

In certain embodiments, the RABGAP1L-NTRK1 fusion comprises exon 14 or a fragment thereof from RABGAP1L, and exon 16 or a fragment thereof from NTRK1 (e.g., as shown in FIGS. 23A-23B (SEQ ID NO:23) and FIGS. 21A-21B (SEQ ID NO:21)). In one embodiment, the RABGAP1L-NTRK1 fusion comprises at least 5, 10, 15, 20, 30, 40, 50 or more amino acids from exon 14 of RABGAP1L (e.g., from the amino acid sequence of RABGAP1L as shown in FIG. 24 (SEQ ID NO:24) (e.g., from the amino acid sequence of RABGAP1L preceding the fusion junction with NTRK1, and at least 5, 10, 15, 20, 30, 40, 50 or more amino acids from exon 16 of NTRK1 (e.g., from the amino acid sequence of NTRK1 as shown in FIG. 22 (SEQ ID NO:22)). In another embodiment, the RABGAP1L-NTRK1 fusion comprises at least 6, 12, 15, 20, 25, 50, 75, 100 or more nucleotides from exon 14 of RABGAP1L (e.g., from the nucleotide sequence of RABGAP1L as shown in FIGS. 23A-23B (SEQ ID NO:23) (e.g., from the nucleotide sequence of RABGAP1L preceding the fusion junction with NTRK1); and at least 6, 12, 15, 20, 25, 50, 75, 100 or more nucleotides from exon 16 of NTRK1 (e.g., from the nucleotide sequence of NTRK1 as shown in FIGS. 21A-21B (SEQ ID NO:21)).

RABGAP1L-NTRK1 Nucleic Acid Molecules

In one aspect, the invention features a nucleic acid molecule (e.g., an isolated or purified) nucleic acid molecule that includes a fragment of a RABGAP1L gene and a fragment of a NTRK1 gene. In one embodiment, the nucleotide sequence encodes a RABGAP1L-NTRK1 fusion polypeptide that includes a NTRK1 tyrosine kinase domain or a functional fragment thereof. In another embodiment, the nucleotide sequence encodes a fragment of the NTRK1 polypeptide including the amino acid sequence of SEQ ID NO:22 or a fragment thereof, or a sequence substantially identical thereto. In other embodiments, the nucleic acid molecule includes a fragment of the RABGAP1L gene encoding the amino acid sequence of SEQ ID NO:24 or a fragment thereof, or a sequence substantially identical thereto. In yet other embodiments, the nucleic acid molecule includes a nucleotide sequence encoding the amino acid sequence shown in FIG. 24 (SEQ ID NO:24), or a fragment thereof, and the amino acid sequence shown in FIG. 22 (SEQ ID NO:22) or a fragment thereof, or a sequence substantially identical thereto.

In one embodiment, the nucleic acid molecule includes a fusion, e.g., an in-frame fusion, between an intron of RABGAP1L (e.g., intron 14, or a fragment thereof), and an intron of NTRK1 (e.g., intron 15, or a fragment thereof). The RABGAP1L-NTRK1 fusion can comprise a fusion of the nucleotide sequence of: chromosome 1 at one or more of nucleotide 156,849,730 (plus or minus 10, 20, 30, 50, 60, 70, 80, 100 nucleotides) and chromosome 1 at one or more of nucleotide 174,637,720 (plus or minus 10, 20, 30, 50, 60, 70, 80, 100 nucleotides), or a fragment thereof. In one embodiment, the RABGAP1L-NTRK1 fusion comprises a fusion of the nucleotide sequence of: chromosome 1 at one or more of nucleotide 156,849,730 (plus or minus 10, 20, 30, 50, 60, 70, 80, 100 nucleotides) and chromosome 1 at one or more of nucleotide 174,637,720 (plus or minus 10, 20, 30, 50, 60, 70, 80, 100 nucleotides), or a fragment thereof.

In another embodiment, the RABGAP1L-NTRK1 fusion comprises a nucleotide sequence (e.g., a fragment of a nucleotide sequence) shown in FIGS. 23A-23B (SEQ ID NO:23) and a nucleotide sequence (e.g., a fragment of a nucleotide sequence) shown in FIGS. 21A-21B (SEQ ID NO:21), or a fragment of the fusion. In one embodiment, the RABGAP1L-NTRK1 fusion comprises a nucleotide sequence substantially identical to the nucleotide sequence (e.g., a fragment of a nucleotide sequence) shown in FIGS. 23A-23B (SEQ ID NO:23) and the nucleotide sequence (e.g., a fragment of a nucleotide sequence) shown FIGS. 21A-21B (SEQ ID NO:21), or a fragment of the fusion. In one embodiment, the RABGAP1L-NTRK1 fusion comprises a nucleotide sequence at least 70%, at least 75%, at least 80%, at least 85%, at least 90%, at least 95%, at least 99%, at least 99.5 or greater, identical to the nucleotide sequence (e.g., a fragment of a nucleotide sequence) shown in FIGS. 23A-23B (SEQ ID NO:23) and to the nucleotide sequence (e.g., a fragment of a nucleotide sequence) shown in FIGS. 21A-21B (SEQ ID NO:21). In one embodiment, the RABGAP1L-NTRK1 fusion comprises a nucleotide sequence containing at least 25, 50, 100, 150, 200, 500, 1000, 1500, 2000, 2500, 3000, or more nucleotides of the nucleotide sequence shown in FIGS. 23A-23C (SEQ ID NO:23) and a nucleotide sequence containing at least 25, 50, 100, 150, 200, 500, 1000, 1500, 2000, 2500, 3000, or more nucleotides of the nucleotide sequence shown in FIGS. 21A-21B (SEQ ID NO:21). In one embodiment, the RABGAP1L-NTRK1 fusion comprises a nucleotide sequence containing at least 25, 50, 100, 150, 200, 500, 1000, 1500, 2000, 2500, 3000, or more contiguous nucleotides of the nucleotide sequence shown in FIGS. 23A-23B (SEQ ID NO:23) and a nucleotide sequence containing at least 25, 50, 100, 150, 200, 500, 1000, 1500, 2000, 2500, 3000, or more nucleotides of the nucleotide sequence shown in FIGS. 21A-21B (SEQ ID NO:21).

In another embodiment, the nucleic acid molecule includes a fusion, e.g., an in-frame fusion, of at least exon 14 of RABGAP1L or a fragment thereof (e.g., one or more of exons 1-14 of RABGAP1L or a fragment thereof), and at least exon 16 or a fragment thereof (e.g., one or more of exons 16-17 of NTRK1 or a fragment thereof). In yet other embodiments, the nucleic acid molecule includes a fragment the nucleotide sequence shown in FIGS. 23A-23B (SEQ ID NO:23) and a fragment of the nucleotide sequence shown in FIGS. 21A-21B (SEQ ID NO:21) or a fragment of the fusion, or a sequence substantially identical thereto.

In one embodiment, the nucleic acid molecule is complementary to at least a portion of a nucleotide sequence disclosed herein, e.g., is capable of hybridizing under a stringency condition described herein to SEQ ID NO:23 and/or SEQ ID NO:21, or a fragment thereof. In yet another embodiment, the nucleic acid molecule hybridizes to a nucleotide sequence that is complementary to at least a portion of a nucleotide sequence disclosed herein, e.g., is capable of hybridizing under a stringency condition described herein, e.g., is a nucleotide sequence complementary to SEQ ID NO:23 and/or SEQ ID NO:21, or a fragment thereof. The nucleotide sequence of a cDNA encoding an exemplary 5' RABGAP1L-3' NTRK1 fusion is shown in at least exon 14 (e.g., exons 1-14) of SEQ ID NO:23 and at least exon 16 (e.g., exons 16-17) of SEQ ID NO:21, and the predicted amino acid sequence is shown in the corresponding encoded exons of SEQ ID NO:24 and the corresponding encoded exons of SEQ ID NO:22, respectively.

In an embodiment the RABGAP1L-NTRK1 nucleic acid molecule comprises sufficient RABGAP1L and sufficient NTRK1 sequence such that the encoded 5' RABGAP1L-3' NTRK1 fusion has kinase activity, e.g., has elevated activity, e.g., NTRK1 kinase activity, as compared with wild type NTRK1, e.g., in a cell of a cancer referred to herein. In certain embodiments, the 5' RABGAP1L-3' NTRK1 fusion comprises exons 1-14 from RABGAP1L and exons 16-X from NTRK1. In certain embodiments, the RABGAP1L-NTRK1 fusion comprises at least 1, 2, 3, 4, 5, 6, 7, 8, 9, 10, 11, 12, 13, 14 or more exons from RABGAP1L and at least 1, 2, or more, exons from NTRK1. In certain embodiments, the RABGAP1L-NTRK1 fusion comprises a fusion of exon 14 from RABGAP1L and exon 16 from NTRK1. In another embodiment, the RABGAP1L-NTRK1 fusion comprises at least 1, 2, 3, 4, 5, 6, 7, 8, 9, 10, 11, 12, 13, 14 exons from RABGAP1L; and at least 1, or 2 exons from NTRK1.

In one embodiment, the nucleic acid molecule includes a nucleotide sequence that has an in-frame fusion of intron 14 of RABGAP1L (e.g., NM_014857) with intron 15 of NTRK1 (e.g., NM_002529). In another embodiment, the nucleic acid molecule includes a nucleotide sequence that includes a breakpoint. For example, the nucleic acid molecule includes a nucleotide sequence that includes the fusion junction between the RABGAP1L gene and the NTRK1 gene, e.g., the breakpoint between intron 14 of RABGAP1L and intron 15 of NTRK1. In other embodiments, the nucleic acid molecules includes a nucleotide sequence of one or more of nucleotide 156,849,730 of chromosome 1 coupled to (e.g., directly or indirectly juxtaposed to) one or more of nucleotide 174,637,720 of chromosome 1. In one embodiment, the nucleic acid molecule includes the nucleotide sequence of: chromosome 1 at one or more of nucleotide 156,849,730 plus or minus 10, 20, 30, 40 50, 60, 80, 100, 150 nucleotides and chromosome 1 at one or more of nucleotide 174,637,720 plus or minus 10, 20, 30, 40 50, 60, 80, 100, 150 nucleotides (corresponding to the breakpoint of a RABGAP1L-NTRK1 fusion), or a fragment thereof, or a sequence substantially identical thereto. In one embodiment, the nucleic acid molecule is complementary to at least a portion of a nucleotide sequence disclosed herein, e.g., is capable of hybridizing under a stringency condition described herein to SEQ ID NO:23 and/or SEQ ID NO:21 or a fragment thereof. In yet other embodiment, the nucleic acid molecule hybridizes to a nucleotide sequence that is complementary to at least a portion of a nucleotide sequence disclosed herein, e.g., is capable of hybridizing under a stringency condition described herein to a nucleotide sequence complementary to SEQ ID NO:23 or 21 or a fragment thereof.

In another embodiment, the RABGAP1L-NTRK1 fusion nucleic acid comprises at least 6, 12, 15, 20, 25, 50, 75, 100 or more nucleotides from exon 14 of RABGAP1L (e.g., from the nucleotide sequence of RABGAP1L preceding the fusion junction with NTRK1, e.g., of the RABGAP1L sequence shown in FIGS. 23A-23B (SEQ ID NO:23)), and at least 6, 12, 15, 20, 25, 50, 75, 100 or more nucleotides from exon 16 of NTRK1 (e.g., from the nucleotide sequence of NTRK1 following the fusion junction with RABGAP1L, e.g., of the NTRK1 sequence shown in FIGS. 21A-21B (SEQ ID NO:21)).

In other embodiments, the nucleic acid molecule includes a nucleotide sequence encoding a RABGAP1L-NTRK1 fusion polypeptide that includes a fragment of a RABGAP1L gene and a fragment of an NTRK1 gene. In one embodiment, the nucleotide sequence encodes a RABGAP1L-NTRK1 fusion polypeptide that includes e.g., an NTRK1 tyrosine kinase domain or a functional fragment thereof. In yet other embodiments, the nucleic acid molecule includes a nucleotide sequence encoding the amino acid sequence (e.g., a fragment of the amino acid sequence) shown in FIG. 24 (e.g., SEQ ID NO:24) and a nucleotide sequence encoding the amino acid sequence (e.g., a fragment of the amino acid sequence) shown in FIG. 22 (e.g., SEQ ID NO:22), or a fragment of the fusion, or a sequence substantially identical thereto. In one embodiment, the encoded RABGAP1L-NTRK1 fusion polypeptide includes an NTRK1 tyrosine kinase domain or a functional fragment thereof.

In a related aspect, the invention features nucleic acid constructs that include the RABGAP1L-NTRK1 nucleic acid molecules described herein. In certain embodiments, the nucleic acid molecules are operatively linked to a native or a heterologous regulatory sequence. Also included are vectors and host cells that include the RABGAP1L-NTRK1 nucleic acid molecules described herein, e.g., vectors and host cells suitable for producing the nucleic acid molecules and polypeptides described herein.

In a related aspect, methods of producing the nucleic acid molecules and polypeptides described herein are also described.

In another aspect, the invention features nucleic acid molecules that reduce or inhibit the expression of a nucleic acid molecule that encodes a RABGAP1L-NTRK1 fusion described herein. Examples of such nucleic acid molecules include, for example, antisense molecules, ribozymes, RNAi, triple helix molecules that hybridize to a nucleic acid encoding RABGAP1L-NTRK1, or a transcription regulatory region of RABGAP1L-NTRK1, and blocks or reduces mRNA expression of RABGAP1L-NTRK1.

Nucleic Acid Detection and Capturing Reagents

The invention also features a nucleic acid molecule, e.g., nucleic acid fragment, suitable as probe, primer, bait or library member that includes, flanks, hybridizes to, which are useful for identifying, or are otherwise based on, the RABGAP1L-NTRK1 fusions described herein. In certain embodiments, the probe, primer or bait molecule is an oligonucleotide that allows capture, detection or isolation of a RABGAP1L-NTRK1 fusion nucleic acid molecule described herein. The oligonucleotide can comprise a nucleotide sequence substantially complementary to a fragment of the RABGAP1L-NTRK1 fusion nucleic acid molecules described herein. The sequence identity between the nucleic acid fragment, e.g., the oligonucleotide, and the target RABGAP1L-NTRK1 sequence need not be exact, so long as the sequences are sufficiently complementary to allow the capture, detection or isolation of the target sequence. In one embodiment, the nucleic acid fragment is a probe or primer that includes an oligonucleotide between about 5 and 25, e.g., between 10 and 20, or 10 and 15 nucleotides in length. In other embodiments, the nucleic acid fragment is a bait that includes an oligonucleotide between about 100 to 300 nucleotides, 130 and 230 nucleotides, or 150 and 200 nucleotides, in length.

In one embodiment, the nucleic acid fragment can be used to identify or capture, e.g., by hybridization, a RABGAP1L-NTRK1 fusion. For example, the nucleic acid fragment can be a probe, a primer, or a bait, for use in identifying or capturing, e.g., by hybridization, a RABGAP1L-NTRK1 fusion described herein. In one embodiment, the nucleic acid fragment can be useful for identifying or capturing a RABGAP1L-NTRK1 breakpoint, e.g., the nucleotide sequence of: chromosome 1 at nucleotide 156,849,730 plus or minus 10, 20, 30, 40, 50, 60, 80, 100, 150 nucleotides and chromosome 1 at nucleotide 174,637,720 plus or minus 10, 20, 30, 40 50, 60, 80, 100, 150 nucleotides.

In one embodiment, the nucleic acid fragment hybridizes to a nucleotide sequence within a chromosomal rearrangement that creates an in-frame fusion of intron 14 of RABGAP1L with intron 15 of NTRK1. In one embodiment, the nucleic acid fragment hybridizes to a nucleotide sequence in the region In other embodiments, the nucleic acid molecules includes a nucleotide sequence in the region of nucleotides 156,849,730 of chromosome 1 coupled to (e.g., juxtaposed to) nucleotides in the region of nucleotides 174,637,720 of chromosome 1. In one embodiment, the nucleic acid fragment hybridizes to a nucleotide sequence that includes a breakpoint, e.g., the nucleotide sequence of: chromosome 1 at nucleotide 156,849,730 plus or minus 10, 20, 30, 40 50, 60, 80, 100, 150 or more nucleotides and chromosome 1 at nucleotide 174,637,720 plus or minus 10, 20, 30, 40 50, 60, 80, 100, 150 or more nucleotides. For example, the nucleic acid fragment can hybridize to a nucleotide sequence that includes the fusion junction between the RABGAP1L gene and the NTRK1 gene, e.g., a nucleotide sequence that includes a portion of a nucleotide sequence within introns 14 of a RABGAP1L gene and 15 of a NTRK1 gene.

In another embodiment, the nucleic acid fragment hybridizes to a nucleotide sequence that comprises at least 6, 12, 15, 20, 25, 50, 75, 100, 150 or more nucleotides from exon 14 of RABGAP1L (e.g., from the nucleotide sequence of RABGAP1L preceding the fusion junction with NTRK1, e.g., of the RABGAP1L sequence shown in FIGS. 23A-23B (SEQ ID NO:23)), and at least 6, 12, 15, 20, 25, 50, 75, 100, 150 or more nucleotides from exon 16 of NTRK1 (e.g., from the nucleotide sequence of NTRK1 following the fusion junction with RABGAP1L, e.g., of the NTRK1 sequence shown in FIGS. 21A-21B (SEQ ID NO:21)).

The probes or primers described herein can be used, for example, for FISH detection or PCR amplification. In one exemplary embodiment where detection is based on PCR, amplification of the RABGAP1L-NTRK1 fusion junction fusion junction can be performed using a primer or a primer pair, e.g., for amplifying a sequence flanking the fusion junctions described herein, e.g., the mutations or the junction of a chromosomal rearrangement described herein, e.g., RABGAP1L-NTRK1.

In one embodiment, a pair of isolated oligonucleotide primers can amplify a region containing or adjacent to a position in the RABGAP1L-NTRK1 fusion. For example, forward primers can be designed to hybridize to a nucleotide sequence within RABGAP1L genomic or mRNA sequence (e.g., a nucleotide sequence within exon 14 of RABGAP1L of SEQ ID NO:23), and the reverse primers can be designed to hybridize to a nucleotide sequence of NTRK1 (e.g., a nucleotide sequence within exon 16 of NTRK1, of SEQ ID NO:21).

In another embodiment, the nucleic acid fragments can be used to identify, e.g., by hybridization, a RABGAP1L-NTRK1 fusion. In one embodiment, the nucleic acid fragment hybridizes to a nucleotide sequence that includes a fusion junction between the RABGAP1L transcript and the NTRK1 transcript.

In other embodiments, the nucleic acid fragment includes a bait that comprises a nucleotide sequence that hybridizes to a RABGAP1L-NTRK1 fusion nucleic acid molecule described herein, and thereby allows the capture or isolation said nucleic acid molecule. In one embodiment, a bait is suitable for solution phase hybridization. In other embodiments, a bait includes a binding entity, e.g., an affinity tag, that allows capture and separation, e.g., by binding to a binding entity, of a hybrid formed by a bait and a nucleic acid hybridized to the bait.

In other embodiments, the nucleic acid fragment includes a library member comprising a RABGAP1L-NTRK1 nucleic acid molecule described herein. In one embodiment, the library member includes a rearrangement that results in a RABGAP1L-NTRK1 fusion described herein.

The nucleic acid fragment can be detectably labeled with, e.g., a radiolabel, a fluorescent label, a bioluminescent label, a chemiluminescent label, an enzyme label, a binding pair label, or can include an affinity tag; a tag, or identifier (e.g., an adaptor, barcode or other sequence identifier).

RABGAP1L-NTRK1 Fusion Polypeptides

In another embodiment, the RABGAP1L-NTRK1 fusion comprises an amino acid sequence (e.g., a fragment of the amino acid sequence) shown in FIG. 24 (SEQ ID NO:24) and an amino acid sequence (e.g., a fragment of the amino acid sequence) shown in FIG. 22 (SEQ ID NO:22), or a fragment of the fusion. In one embodiment, the RABGAP1L-NTRK1 fusion comprises an amino acid sequence substantially identical to the amino acid sequence (e.g., a fragment of the amino acid sequence) shown in FIG. 24 (SEQ ID NO:24) and the amino acid sequence (e.g., a fragment of the amino acid sequence) shown in FIG. 22 (SEQ ID NO:22), or a fragment thereof. In one embodiment, the RABGAP1L-NTRK1 fusion comprises an amino acid sequence at least 70%, at least 75%, at least 80%, at least 85%, at least 90%, at least 95%, at least 99%, at least 99.5 or greater, identical to the amino acid sequence (e.g., a fragment of the amino acid sequence) shown in FIG. 24 (SEQ ID NO:24) and the amino acid sequence (e.g., a fragment of the amino acid sequence) shown in FIG. 22 (SEQ ID NO:22). In one embodiment, the RABGAP1L-NTRK1 fusion comprises a sequence containing at least 10, 20, 50, 100, 500, 600, 700, 800, 900, 1000, or more amino acids of the amino acid sequence shown in FIG. 24 (SEQ ID NO:24) and FIG. 22 (SEQ ID NO:22). In one embodiment, the RABGAP1L-NTRK1 fusion comprises an amino acid sequence containing at least 5, 10, 20, 50, 100, 500, 600, 700, 800, 900, 1000, or more contiguous amino acids of the amino acid sequence shown in FIG. 24 (SEQ ID NO:24) and at least 5, 10, 20, 50, 100, 500, 600, 700, 800, 900, 1000, or more contiguous amino acids of the amino acid sequence shown in FIG. 22 (SEQ ID NO:22). In one embodiment, the 5' RABGAP1L-3' NTRK1 fusion polypeptide includes a NTRK1 receptor tyrosine kinase domain or a functional fragment thereof. In an embodiment, the 5'RABGAP1L-3'NTRK1 fusion polypeptide comprises sufficient NTRK1 and sufficient RABGAP1L sequence such that it has kinase activity, e.g., has elevated activity, e.g., NTRK1 kinase activity, as compared with wild type NTRK1, e.g., in a cell of a cancer referred to herein.

In another aspect, the invention features a RABGAP1L-NTRK1 fusion polypeptide (e.g., a purified RABGAP1L-NTRK1 fusion polypeptide), a biologically active or antigenic fragment thereof, as well as reagents (e.g., antibody molecules that bind to a RABGAP1L-NTRK1 fusion polypeptide), methods for modulating a RABGAP1L-NTRK1 polypeptide activity and detection of a RABGAP1L-NTRK1 polypeptide.

In one embodiment, the RABGAP1L-NTRK1 fusion polypeptide has at least one biological activity, e.g., an NTRK1 kinase activity. In one embodiment, at least one biological activity of the RABGAP1L-NTRK1 fusion polypeptide is reduced or inhibited by an anti-cancer drug, e.g., a kinase inhibitor (e.g., a multikinase inhibitor or an NTRK1-specific inhibitor). In one embodiment, at least one biological activity of the RABGAP1L-NTRK1 fusion polypeptide is reduced or inhibited by an NTRK1 kinase inhibitor chosen from e.g., lestaurtinib (CEP-701); AZ-23; indenopyrrolocarboazole 12a; oxindole 3; isothiazole 5n; thiazole 20 h.

In yet other embodiments, the RABGAP1L-NTRK1 fusion polypeptide is encoded by a nucleic acid molecule described herein. In one embodiment, the RABGAP1L-NTRK1 fusion polypeptide is encoded by an in-frame fusion of intron 14 of RABGAP1L with intron 11 of NTRK1 (e.g., a sequence on chromosome 1). In another embodiment, the RABGAP1L-NTRK1 fusion polypeptide includes an amino acid sequence encoded by a nucleotide sequence comprising a fusion junction between the RABGAP1L transcript and the NTRK1 transcript.

In certain embodiments, the RABGAP1L-NTRK1 fusion polypeptide comprises one or more of encoded exons 1-14 from RABGAP1L and one or more of encoded exons 16-17 of NTRK1. In certain embodiments, the RABGAP1L-NTRK1 fusion polypeptide comprises at least 1, 2, 3, 4, 5, 6, 7, 8, 9, 10, 11, 12, 13, 14 or more encoded exons from RABGAP1L and at least 1, 2 or more, encoded exons from NTRK1. In certain embodiments, the RABGAP1L-NTRK1 fusion polypeptide comprises a fusion of encoded exon 14 from RABGAP1L and encoded exon 16 from NTRK1 (or a fragment thereof). In other embodiments, the fusion comprises least 1, 2, 3, 4, 5, 6, 7, 8, 9, 10, 11, 12, 13, 14 encoded exons from RABGAP1L; and at least 1, 2, encoded exons from NTRK1. In certain embodiments, the RABGAP1L-NTRK1 fusion polypeptide comprises encoded exons 1-14 from RABGAP1L and exons 16-X of NTRK1. In certain embodiments, the 5' RABGAP1L-3' NTRK1 fusion polypeptide comprises a fusion junction of the sequence of exon 14 from RABGAP1L and the sequence of exon 16 from NTRK1.

In certain embodiments, the RABGAP1L-NTRK1 fusion comprises the amino acid sequence corresponding to exon 14 or a fragment thereof from RABGAP1L, and the amino acid sequence corresponding to exon 16 or a fragment thereof from NTRK1 (e.g., as shown in FIG. 24 (SEQ ID NO:24) and FIG. 22 (SEQ ID NO:22)). In one embodiment, the RABGAP1L-NTRK1 fusion comprises at least 5, 10, 15, 20 or more amino acids from exon 14 of RABGAP1L (e.g., from the amino acid sequence of RABGAP1L preceding the fusion junction with NTRK1, e.g., of the RABGAP1L sequence shown in FIG. 24 (SEQ ID NO:24)), and at least 5, 10, 15, 20 or more amino acids from exon 16 of NTRK1 (e.g., from the amino acid sequence of NTRK1 following the fusion junction with RABGAP1L, e.g., of the NTRK1 sequence shown in FIG. 24 (SEQ ID NO:22)).

In one embodiment, the RABGAP1L-NTRK1 fusion polypeptide includes a NTRK1 tyrosine kinase domain or a functional fragment thereof. In a related aspect, the invention features RABGAP1L-NTRK1 fusion polypeptide or fragments operatively linked to heterologous polypeptides to form fusion proteins.

In another embodiment, the RABGAP1L-NTRK1 fusion polypeptide or fragment is a peptide, e.g., an immunogenic peptide or protein, that contains a fusion junction described herein. Such immunogenic peptides or proteins can be used to raise antibodies specific to the fusion protein. In other embodiments, such immunogenic peptides or proteins can be used for vaccine preparation. The vaccine preparation can include other components, e.g., an adjuvant.

In another aspect, the invention features antibody molecules that bind to a RABGAP1L-NTRK1 fusion polypeptide or fragment described herein. In embodiments, the antibody can distinguish wild type NTRK1 (or RABGAP1L) from RABGAP1L-NTRK1.

Detection Reagents and Detection of Mutations

In another aspect, the invention features a detection reagent, e.g., a purified or an isolated preparation thereof. Detection reagents can distinguish a nucleic acid, or protein sequence, having a breakpoint, e.g., a RABGAP1L-NTRK1 breakpoint; from a reference sequence. In one embodiment, the detection reagent detects (e.g., specifically detects) a RABGAP1L-NTRK1 fusion nucleic acid or a polypeptide (e.g., distinguishes a wild type NTRK1 or another NTRK1 fusion (or RABGAP1L) from a RABGAP1L-NTRK1 nucleic acid (e.g., as described herein in FIGS. 23A-23B (SEQ ID NO:23) and FIGS. 21A-21B (SEQ ID NO:21); or a RABGAP1L-NTRK1 polypeptide (e.g., as described herein in FIG. 24 (SEQ ID NO:24) and FIG. 22 (SEQ ID NO:22).

Detection reagents, e.g., nucleic acid-based detection reagents, can be used to identify mutations in a target nucleic acid, e.g., DNA, e.g., genomic DNA or cDNA, or RNA, e.g., in a sample, e.g., a sample of nucleic acid derived from a neoplastic or tumor cell, e.g., a melanocytic neoplasm, melanoma or metastatic cell. Detection reagents, e.g., antibody-based detection reagents, can be used to identify mutations in a target protein, e.g., in a sample, e.g., a sample of protein derived from, or produced by, a neoplastic or tumor cell, e.g., a melanocytic neoplasm, melanoma or metastatic cell.

Method of Treatment

The RABGAP1L-NTRK1 fusion has not been previously reported. NTRK1 encodes the "High affinity nerve growth factor receptor", also called "Neurotrophic tyrosine kinase receptor type 1". This is a receptor tyrosine kinase that plays a role in the development of the nervous system by regulating cell proliferation, differentiation and survival of neurons. NTRK1 is activated upon binding of its ligand NGF (Klein R, Jing S Q, Nanduri V, O'Rourke E, Barbacid M The trk proto-oncogene encodes a receptor for nerve growth factor. Cell 1991 Apr. 5; 65(1):189-97), to promote several downstream signaling pathways including GRB2-Ras-MAPK, NF-Kappa-B, and Ras-PI3 kinase-AKT1 (Wooten M W, Seibenhener M L, Mamidipudi V, Diaz-Meco M T, Barker P A, Moscat J The atypical protein kinase (-interacting protein p62 is a scaffold for NF-kappaB activation by nerve growth factor. The Journal of biological chemistry 2001 Mar. 16; 276(11):7709-12, Stephens R M, Loeb D M, Copeland T D, Pawson T, Greene L A, Kaplan D R Trk receptors use redundant signal transduction pathways involving SHC and PLC-gamma 1 to mediate NGF responses. Neuron 1994 March; 12(3):691-705, Tacconelli A, Farina A R, Cappabianca L, Desantis G, Tessitore A, Vetuschi A, Sferra R, Rucci N, Argenti B, Screpanti I, Gulino A, Mackay A R TrkA alternative splicing: a regulated tumor-promoting switch in human neuroblastoma. Cancer cell 2004 October; 6(4):347-60).

The fusion identified contains all or part of RABGAP1L fused to exons 16-17 of NTRK1. This NTRK1 variant has not been previously reported (PubMed, May 2012). The NTRK1 tyrosine kinase domain is encoded by exons 13-17 (Indo Y, Mardy S, Tsuruta M, Karim M A, Matsuda I Structure and organization of the human TRKA gene encoding a high affinity receptor for nerve growth factor. The Japanese journal of human genetics 1997 June; 42(2):343-51). Therefore this variant contains only a portion of the kinase domain and is predicted to be inactive. NTRK1 mutations have been reported in 2% of 1438 cancers analyzed in COSMIC (Catalogue of Somatic Mutations in Cancer, a database of known somatic mutations in cancer, May 2012). The highest mutation rates have been reported in cancers of ovary (8%), skin, stomach, upper aerodigestive tract (5% each) and lung (3%) (COSMIC, May 2012). Chromosomal rearrangements have been shown to produce NTRK1 oncogenes, which contain the tyrosine-kinase domain of NTRK1 fused to an activating quence of another gene, and generate fusion proteins with constitutive kinase activity (Greco A, Mariani C, Miranda C, Pagliardini S, Pierotti M A Characterization of the NTRKg1 enomic region involved in chromosomal rearrangements generating TRK oncogenes. Genomics 1993 November; 18(2):397-400). Such NTRK1 fusions are frequently found in thyroid papillary carcinoma, including translocations between NTRK1 and TGF, TPM3, or TPR (Greco A, Mariani C, Miranda C, Lupas A, Pagliardini S, Pomati M, Pierotti M A The DNA rearrangement that generates the TRK-T3 oncogene involves a novel gene on chromosome 3 whose product has a potential coiled-coil domain. Molecular and cellular biology 1995 November; 15(11):6118-27, Greco A, Pierotti M A, Bongarzone I, Pagliardini S, Lanzi C, Della Porta G TRK-T1 is a novel oncogene formed by the fusion of TPR and TRK genes in human papillary thyroid carcinomas. Oncogene 1992 February; 7(2):237-42, Martin-Zanca D, Hughes S H, Barbacid M A human oncogene formed by the fusion of truncated tropomyosin and protein tyrosine kinase sequences. Nature 1986 Feb. 27-Mar. 5; 319(6056):743-8). Oncogenic splice variant TrkAIII has been reported in neuroblastoma (Tacconelli A, Farina A R, Cappabianca L, Desantis G, Tessitore A, Vetuschi A, Sferra R, Rucci N, Argenti B, Screpanti I, Gulino A, Mackay A R TrkA alternative splicing: a regulated tumor-promoting switch in human neuroblastoma. Cancer cell 2004 October; 6(4):347-60).

NTRK1 mutations are also associated with the genetic disorder "hereditary sensory and autonomic neuropathy type IV" (HSAN IV), also called "congenital insensitivity to pain with anidrosis" (CIPA) (Miura Y, Mardy S, Awaya Y, Nihei K, Endo F, Matsuda I, Indo Y Mutation and polymorphism analysis of the TRKA (NTRKOgene encoding a high-affinity receptor for nerve growth factor in congenital insensitivity to pain with anhidrosis (CIPA) families. Human genetics 2000 January; 106(1):116-24, Huehne K, Zweier C, Raab K, Odent S, Bonnaure-Mallet M, Sixou J L, Landrieu P, Goizet C, Sarlangue J, Baumann M, Eggermann T, Rauch A, Ruppert S, Stettner G M, Rautenstrauss B Novel missense, insertion and deletion mutations in the neurotrophic tyrosine kinase receptor type lgene (NTRK1) associated with congenital insensitivity to pain with anhidrosis. Neuromuscular disorders: NMD 2008 February; 18(2):159-66). The RABGAP1L-NTRK1 fusion detected in this patient has not previously been reported in the literature (PubMed, May 2012), but it is likely to be inactivating. COSMIC reports no incidences of NTRK1 mutation, out of two bile duct carcinomas analyzed (COSMIC, May 2012). NTRK1 has not been analyzed or studied in cholangiocarcinoma (PubMed, May 2012). NTRK1 inactivation and loss have not been reported to be oncogenic (PubMed, May 2012). At the present time there are no therapies or clinical rials targeting NTRK1 inactivation or loss in cancer. In another aspect, a method of inhibiting, reducing, or treating a hyperproliferative disorder, e.g., a neoplasm (including benign, pre-malignant or malignant (e.g., a cancer), in a subject is provided. The method includes administering to the subject a preselected therapeutic agent, e.g., an anti-cancer agent (e.g., a kinase inhibitor), as a single agent, or in combination, in an amount sufficient to reduce, inhibit or treat the activity or expression of RABGAP1L-NTRK1 (e.g., a RABGAP1L-NTRK1 fusion described herein), thereby inhibiting, reducing, or treating the hyperproliferative disorder in the subject.

In one embodiment, the subject treated has a RABGAP1L-NTRK1 fusion; e.g., the subject has a tumor or cancer harboring a RABGAP1L-NTRK1 fusion. In other embodiments, the subject has been previously identified as having a RABGAP1L-NTRK1 fusion. In yet other embodiments, the subject has been previously identified as being likely or unlikely to respond to treatment with a protein kinase inhibitor, e.g., a subject that has previously participated in a clinical trial. In other embodiments, the subject has been previously identified as being likely or unlikely to respond to treatment with a protein kinase inhibitor, based on the presence of the RABGAP1L-NTRK1 fusion. In one embodiment, the subject is a mammal, e.g., a human. In one embodiment, the subject has, or at risk of having a cancer at any stage of disease. In other embodiments, the subject is a patient, e.g., a cancer patient.

In certain embodiments, the neoplasm or neoplastic cell is a benign, pre-malignant, malignant (cancer) or metastasis. In certain embodiments, the cancer is a solid tumor, a soft tissue tumor, or a metastatic lesion.

In one embodiment, the neoplasm or neoplastic cell is a benign, pre-malignant, malignant (cancer) or metastasis. In certain embodiments, the cancer is a solid tumor, a soft tissue tumor, or a metastatic lesion. In one embodiment, the cancer is a cholangiocarcinoma. In one embodiment, the cancer is chosen from a lung cancer, a pancreatic cancer, melanoma, a colorectal cancer, an esophageal-gastric cancer, a thyroid cancer, or an adenocarcinoma. In one embodiment, the cancer is a lung adenocarcinoma. In other embodiment, the lung cancer is chosen from one or more of the following: non-small cell lung cancer (NSCLC), small cell lung cancer (SCLC), squamous cell carcinoma (SCC), adenocarcinoma of the lung, bronchogenic carcinoma, or a combination thereof. In one embodiment, the lung cancer is NSCLC or SCC.

In certain embodiments, the cancer is a cholangiocarcinoma. In some embodiments, such cancers of the bile ducts can arise within the liver as an intrahepatic cholangiocarcinoma (ICC) or originate from extrahepatic bile ducts as a bile duct carcinoma also referred to as an extrahepatic cholangiocarcinoma. ICC is the second most common primary hepatic malignancy after hepatocellular carcinoma (HCC) and accounts for 3% of the malignant tumors of the gastrointestinal system and 15% of primary hepatic malignancies. In that ICC has a routine histologic appearance of an adenocarcinoma, the diagnosis of ICC on a liver biopsy requires an immunohistochemical (IHC) study of the tumor and a thorough clinical workup including imaging studies to rule out a metastatic adenocarcinoma to the liver. ICC is associated with primary sclerosing cholangitis, parasitic biliary infection, polycystic disease of the liver, congenital intrahepatic bile duct dilatation (Caroli's Disease), congenital hepatic fibrosis, and choledochal cysts. Chronic Hepatitis C infection is an established cause of ICC with some studies describing a more than 300 fold increase in ICC incidence in patients with long-standing Hepatitis C infections. ICC has also been associated with cigarette smoking, alcohol consumption and exposure to a variety of toxins and chemical carcinogens.

In one embodiment, the anti-cancer agent is a kinase inhibitor. In one embodiment, the anti-cancer agent is a kinase inhibitor. For example, the kinase inhibitor is a multi-kinase inhibitor or a NTRK1-specific inhibitor. In one embodiment, the kinase inhibitor is a NTRK1 inhibitor including, but not limited to, lestaurtinib (CEP-701); AZ-23; indenopyrrolocarboazole 12a; oxindole 3; isothiazole 5n; thiazole 20 h. In certain embodiments, the NTRK1 inhibitor is a NTRK1 inhibitor described herein.

In one embodiment, the therapeutic agent is an agent that binds and inhibits FGFR2 or TACC3. For example, the therapeutic agent is an antibody molecule (e.g., a monoclonal antibody) against FGFR2; and/or a small molecule (e.g., kinase) inhibitor that is selective for FGFR2 or TACC3.

In another embodiment, the therapeutic agent is selected from antisense molecules, ribozymes, RNAi, triple helix molecules that hybridize to a nucleic acid encoding the fusion, or a transcription regulatory region that blocks or reduces mRNA expression of the fusion. In certain embodiments, the NTRK1 inhibitor is a NTRK1 inhibitor described herein.

MPRIP-NTRK1 Fusions

In one embodiment, a fusion includes an in-frame fusion of an exon of myosin phosphatase Rho interacting protein (MPRIP), e.g., one more exons of MPRIP (e.g., one or more of exons 1-21 of MPRIP) or a fragment thereof, and an exon of neurotrophic tyrosine kinase receptor type 1 (NTRK1), e.g., one or more exons of a NTRK1 (e.g., one or more of exons 12-17 of NTRK1) or a fragment thereof. For example, the MPRIP-NTRK1 fusion can include an in-frame fusion within an intron of MPRIP (e.g., intron 21) or a fragment thereof, with an intron of NTRK1 (e.g., intron 11) or a fragment thereof. In one embodiment, the fusion of the MPRIP-NTRK1 fusion comprises the nucleotide sequence of: chromosome 1 at one or more of nucleotide 156,845,212 (plus or minus 10, 20, 30, 50, 60, 70, 80, 100 or more nucleotides) and chromosome 17 at one or more of nucleotide 17,080,829 (plus or minus 10, 20, 30, 50, 60, 70, 80, 100 or more nucleotides). In one embodiment, the MPRIP-NTRK1 fusion is a translocation, e.g., a translocation of a portion of chromosome 1 and a portion of chromosome 17.

In certain embodiments, the MPRIP-NTRK1 fusion is in a 5'-MPRIP to 3'-NTRK1 configuration (also referred to herein as "5'-MPRIP-NTRK1-3')." The term "fusion" or "fusion molecule" can refer to a polypeptide or a nucleic acid fusion, depending on the context. It may include a full-length sequence of a fusion or a fragment thereof, e.g., a fusion junction (e.g., a fragment including a portion of MPRIP and a portion of NTRK1, e.g., a portion of the MPRIP-NTRK1 fusion described herein). In one embodiment, the MPRIP-NTRK1 fusion polypeptide includes a fragment of the amino acid sequence shown in FIG. 26 (SEQ ID NO:26) and a fragment of the amino acid sequence shown in FIG. 22 (SEQ ID NO:22), or an amino acid sequence substantially identical thereto. In another embodiment, the MPRIP-NTRK1 fusion nucleic acid includes a fragment of the nucleotide sequence shown in FIGS. 25A-25E (SEQ ID NO:25) and a fragment of the nucleotide sequence shown in FIGS. 21A-21B (SEQ ID NO:21), or a nucleotide sequence substantially identical thereto. In one embodiment, the MPRIP-NTRK1 fusion polypeptide comprises sufficient MPRIP and sufficient NTRK1 sequence such that the 5' MPRIP-3' NTRK1 fusion has kinase activity, e.g., has elevated activity, e.g., NTRK1 tyrosine kinase activity, as compared with wild type NTRK1, e.g., in a cell of a cancer referred to herein (e.g., adenocarcinoma, e.g., lung adenocarcinoma).

In certain embodiments, the MPRIP-NTRK1 fusion comprises one or more (or all of) exons 1-21 from MPRIP and one or more (or all of) exons 12-17 of NTRK1 (e.g., one or more of the exons shown in FIGS. 25A-25E (SEQ ID NO:25) and FIGS. 21A-21B (SEQ ID NO:21). In another embodiment, the MPRIP-NTRK1 fusion comprises one or more (or all of) exons 1-21 of MPRIP and one or more (or all of) exons 12-17 of NTRK1. In certain embodiments, the MPRIP-NTRK1 fusion comprises at least 1, 2, 3, 4, 5, 6, 7, 8, 9, 10, 11, 12, 13, 14, 15, 16, 17, 18, 19, 20, 21 or more exons (or encoded exons) from MPRIP and at least 1, 2, 3, 4, 5, or more exons (or encoded exons) from NTRK1 (e.g., from the MPRIP and NTRK1 sequences shown in FIGS. 25A-25E and FIG. 26 (SEQ ID NO:25 and 26) and FIGS. 21A-21B and FIG. 22 (SEQ ID NOs:21 and 22).

In certain embodiments, the MPRIP-NTRK1 fusion comprises exon 21 or a fragment thereof from MPRIP, and exon 12 or a fragment thereof from NTRK1 (e.g., as shown in FIGS. 25A-25E (SEQ ID NO:25) and FIGS. 21A-21B (SEQ ID NO:21)). In one embodiment, the MPRIP-NTRK1 fusion comprises at least 5, 10, 15, 20, 30, 40, 50 or more amino acids from exon 21 of MPRIP (e.g., from the amino acid sequence of MPRIP as shown in FIG. 26 (SEQ ID NO:26) (e.g., from the amino acid sequence of MPRIP preceding the fusion junction with NTRK1, and at least 5, 10, 15, 20, 30, 40, 50 or more amino acids from exon 12 of NTRK1 (e.g., from the amino acid sequence of NTRK1 as shown in FIG. 22 (SEQ ID NO:22)). In another embodiment, the MPRIP-NTRK1 fusion comprises at least 6, 12, 15, 20, 25, 50, 75, 100 or more nucleotides from exon 21 of MPRIP (e.g., from the nucleotide sequence of MPRIP as shown in FIGS. 25A-25E (SEQ ID NO:25) (e.g., from the nucleotide sequence of MPRIP preceding the fusion junction with NTRK1); and at least 6, 12, 15, 20, 25, 50, 75, 100 or more nucleotides from exon 12 of NTRK1 (e.g., from the nucleotide sequence of NTRK1 as shown in FIGS. 21A-21B (SEQ ID NO:21)).

MPRIP-NTRK1 Nucleic Acid Molecules

In one aspect, the invention features a nucleic acid molecule (e.g., an isolated or purified) nucleic acid molecule that includes a fragment of a MPRIP gene and a fragment of a NTRK1 gene. In one embodiment, the nucleotide sequence encodes a MPRIP-NTRK1 fusion polypeptide that includes a NTRK1 tyrosine kinase domain or a functional fragment thereof. In another embodiment, the nucleotide sequence encodes a fragment of the NTRK1 polypeptide including the amino acid sequence of SEQ ID NO:22 or a fragment thereof, or a sequence substantially identical thereto. In other embodiments, the nucleic acid molecule includes a fragment of the MPRIP gene encoding the amino acid sequence of SEQ ID NO:26 or a fragment thereof, or a sequence substantially identical thereto. In yet other embodiments, the nucleic acid molecule includes a nucleotide sequence encoding the amino acid sequence shown in FIG. 26 (SEQ ID NO:26), or a fragment thereof, and the amino acid sequence shown in FIG. 22 (SEQ ID NO:22) or a fragment thereof, or a sequence substantially identical thereto.

In one embodiment, the nucleic acid molecule includes a fusion, e.g., an in-frame fusion, between an intron of MPRIP (e.g., intron 21, or a fragment thereof), and an intron of NTRK1 (e.g., intron 11, or a fragment thereof). The MPRIP-NTRK1 fusion can comprise a fusion of the nucleotide sequence of: chromosome 1 at one or more of nucleotide 156,845,212 (plus or minus 10, 20, 30, 50, 60, 70, 80, 100 nucleotides) and chromosome 17 at one or more of nucleotide 17,080,829 (plus or minus 10, 20, 30, 50, 60, 70, 80, 100 nucleotides), or a fragment thereof. In one embodiment, the MPRIP-NTRK1 fusion comprises a fusion of the nucleotide sequence of: chromosome 1 at one or more of nucleotide 156,845,212 (plus or minus 10, 20, 30, 50, 60, 70, 80, 100 nucleotides) and chromosome 17 at one or more of nucleotide 17,080,829 (plus or minus 10, 20, 30, 50, 60, 70, 80, 100 nucleotides), or a fragment thereof.

In another embodiment, the MPRIP-NTRK1 fusion comprises a nucleotide sequence (e.g., a fragment of a nucleotide sequence) shown in FIGS. 25A-25E (SEQ ID NO:25) and a nucleotide sequence (e.g., a fragment of a nucleotide sequence) shown in FIGS. 21A-21B (SEQ ID NO:21), or a fragment of the fusion. In one embodiment, the MPRIP-NTRK1 fusion comprises a nucleotide sequence substantially identical to the nucleotide sequence (e.g., a fragment of a nucleotide sequence) shown in FIGS. 25A-25E (SEQ ID NO:25) and the nucleotide sequence (e.g., a fragment of a nucleotide sequence) shown FIGS. 21A-21B (SEQ ID NO:21), or a fragment of the fusion. In one embodiment, the MPRIP-NTRK1 fusion comprises a nucleotide sequence at least 70%, at least 75%, at least 80%, at least 85%, at least 90%, at least 95%, at least 99%, at least 99.5 or greater, identical to the nucleotide sequence (e.g., a fragment of a nucleotide sequence) shown in FIGS. 25A-25E (SEQ ID NO:25) and to the nucleotide sequence (e.g., a fragment of a nucleotide sequence) shown in FIGS. 21A-21B (SEQ ID NO:21). In one embodiment, the MPRIP-NTRK1 fusion comprises a nucleotide sequence containing at least 25, 50, 100, 150, 200, 500, 1000, 1500, 2000, 2500, 3000, or more nucleotides of the nucleotide sequence shown in FIGS. 25A-25E (SEQ ID NO:25) and a nucleotide sequence containing at least 25, 50, 100, 150, 200, 500, 1000, 1500, 2000, 2500, 3000, or more nucleotides of the nucleotide sequence shown in FIGS. 21A-21B (SEQ ID NO:21). In one embodiment, the MPRIP-NTRK1 fusion comprises a nucleotide sequence containing at least 25, 50, 100, 150, 200, 500, 1000, 1500, 2000, 2500, 3000, or more contiguous nucleotides of the nucleotide sequence shown in FIGS. 25A-25E (SEQ ID NO:25) and a nucleotide sequence containing at least 25, 50, 100, 150, 200, 500, 1000, 1500, 2000, 2500, 3000, or more nucleotides of the nucleotide sequence shown in FIGS. 21A-21B (SEQ ID NO:21).

In another embodiment, the nucleic acid molecule includes a fusion, e.g., an in-frame fusion, of at least exon 21 of MPRIP or a fragment thereof (e.g., one or more of exons 1-21 of MPRIP or a fragment thereof), and at least exon 12 or a fragment thereof (e.g., one or more of exons 12-17 of NTRK1 or a fragment thereof). In yet other embodiments, the nucleic acid molecule includes a fragment the nucleotide sequence shown in FIGS. 25A-25E (SEQ ID NO:25) and a fragment of the nucleotide sequence shown in FIGS. 21A-21B (SEQ ID NO:21) or a fragment of the fusion, or a sequence substantially identical thereto.

In one embodiment, the nucleic acid molecule is complementary to at least a portion of a nucleotide sequence disclosed herein, e.g., is capable of hybridizing under a stringency condition described herein to SEQ ID NO:25 and/or SEQ ID NO:21, or a fragment thereof. In yet another embodiment, the nucleic acid molecule hybridizes to a nucleotide sequence that is complementary to at least a portion of a nucleotide sequence disclosed herein, e.g., is capable of hybridizing under a stringency condition to a nucleotide sequence complementary to SEQ ID NO:25 and/or SEQ ID NO:21, or a fragment thereof. The nucleotide sequence of a cDNA encoding an exemplary 5' MPRIP-3' NTRK1 fusion is shown in at least exon 21 (e.g., exons 1-21) of SEQ ID NO:25 and at least exon 12 (e.g., exons 12-17) of SEQ ID NO:21, and the predicted amino acid sequence is shown in the corresponding encoded exons of SEQ ID NO:26 and the corresponding encoded exons of SEQ ID NO:22, respectively.

In an embodiment the MPRIP-NTRK1 nucleic acid molecule comprises sufficient MPRIP and sufficient NTRK1 sequence such that the encoded 5' MPRIP-3' NTRK1 fusion has kinase activity, e.g., has elevated activity, e.g., NTRK1 kinase activity, as compared with wild type NTRK1, e.g., in a cell of a cancer referred to herein. In certain embodiments, the 5' MPRIP-3' NTRK1 fusion comprises exons 1-21 from MPRIP and exons 12-17 from NTRK1. In certain embodiments, the MPRIP-NTRK1 fusion comprises at least 1, 2, 3, 4, 5, 6, 7, 8, 9, 10, 11, 12, 13, 14, 15, 16, 17, 18, 19, 20, 21 or more exons from MPRIP and at least 1, 2, 3, 4, 5, or more, exons from NTRK1. In certain embodiments, the MPRIP-NTRK1 fusion comprises a fusion of exon 21 from MPRIP and exon 12 from NTRK1. In another embodiment, the MPRIP-NTRK1 fusion comprises at least 1, 2, 3, 4, 5, 6, 7, 8, 9, 10, 11, 12, 13, 14, 15, 16, 17, 18, 19, 20, 21 exons from MPRIP; and at least 1, 2, 3, 4, or 5, exons from NTRK1.

In one embodiment, the nucleic acid molecule includes a nucleotide sequence that has an in-frame fusion of intron 21 of MPRIP (e.g., NM_015134) with intron 11 of NTRK1 (e.g., NM_002529). In another embodiment, the nucleic acid molecule includes a nucleotide sequence that includes a breakpoint. For example, the nucleic acid molecule includes a nucleotide sequence that includes the fusion junction between the MPRIP gene and the NTRK1 gene, e.g., the breakpoint between intron 21 of MPRIP and intron 11 of NTRK1. In other embodiments, the nucleic acid molecules includes a nucleotide sequence of one or more of nucleotide 156,845,212 of chromosome 1 coupled to (e.g., directly or indirectly juxtaposed to) one or more of nucleotide 17,080,829 of chromosome 17. In one embodiment, the nucleic acid molecule includes the nucleotide sequence of: chromosome 1 at one or more of nucleotide 156,845,212 plus or minus 10, 20, 30, 40 50, 60, 80, 100, 150 nucleotides and chromosome 17 at one or more of nucleotide 17,080,829 plus or minus 10, 20, 30, 40 50, 60, 80, 100, 150 nucleotides (corresponding to the breakpoint of a MPRIP-NTRK1 fusion), or a fragment thereof, or a sequence substantially identical thereto. In one embodiment, the nucleic acid molecule is complementary to at least a portion of a nucleotide sequence disclosed herein, e.g., is capable of hybridizing under a stringency condition described herein to SEQ ID NO:25 and/or SEQ ID NO:21 or a fragment thereof. In yet other embodiment, the nucleic acid molecule hybridizes to a nucleotide sequence that is complementary to at least a portion of a nucleotide sequence disclosed herein, e.g., is capable of hybridizing under a stringency condition described herein to a nucleotide sequence complementary to SEQ ID NO:25 or 21 or a fragment thereof.

In another embodiment, the MPRIP-NTRK1 fusion nucleic acid comprises at least 6, 12, 15, 20, 25, 50, 75, 100 or more nucleotides from exon 21 of MPRIP (e.g., from the nucleotide sequence of MPRIP preceding the fusion junction with NTRK1, e.g., of the MPRIP sequence shown in FIGS. 25A-25E (SEQ ID NO:25)), and at least 6, 12, 15, 20, 25, 50, 75, 100 or more nucleotides from exon 12 of NTRK1 (e.g., from the nucleotide sequence of NTRK1 following the fusion junction with MPRIP, e.g., of the NTRK1 sequence shown in FIGS. 21A-21B (SEQ ID NO:21)).

In other embodiments, the nucleic acid molecule includes a nucleotide sequence encoding a MPRIP-NTRK1 fusion polypeptide that includes a fragment of a MPRIP gene and a fragment of an NTRK1 gene. In one embodiment, the nucleotide sequence encodes a MPRIP-NTRK1 fusion polypeptide that includes e.g., an NTRK1 tyrosine kinase domain or a functional fragment thereof. In yet other embodiments, the nucleic acid molecule includes a nucleotide sequence encoding the amino acid sequence (e.g., a fragment of the amino acid sequence) shown in FIG. 26 (e.g., SEQ ID NO:26) and a nucleotide sequence encoding the amino acid sequence (e.g., a fragment of the amino acid sequence) shown in FIG. 22 (e.g., SEQ ID NO:22), or a fragment of the fusion, or a sequence substantially identical thereto. In one embodiment, the encoded MPRIP-NTRK1 fusion polypeptide includes an NTRK1 tyrosine kinase domain or a functional fragment thereof.

In a related aspect, the invention features nucleic acid constructs that include the MPRIP-NTRK1 nucleic acid molecules described herein. In certain embodiments, the nucleic acid molecules are operatively linked to a native or a heterologous regulatory sequence. Also included are vectors and host cells that include the MPRIP-NTRK1 nucleic acid molecules described herein, e.g., vectors and host cells suitable for producing the nucleic acid molecules and polypeptides described herein.

In a related aspect, methods of producing the nucleic acid molecules and polypeptides described herein are also described.

In another aspect, the invention features nucleic acid molecules that reduce or inhibit the expression of a nucleic acid molecule that encodes a MPRIP-NTRK1 fusion described herein. Examples of such nucleic acid molecules include, for example, antisense molecules, ribozymes, RNAi, triple helix molecules that hybridize to a nucleic acid encoding MPRIP-NTRK1, or a transcription regulatory region of MPRIP-NTRK1, and blocks or reduces mRNA expression of MPRIP-NTRK1.

Nucleic Acid Detection and Capturing Reagents

The invention also features a nucleic acid molecule, e.g., nucleic acid fragment, suitable as probe, primer, bait or library member that includes, flanks, hybridizes to, which are useful for identifying, or are otherwise based on, the MPRIP-NTRK1 fusions described herein. In certain embodiments, the probe, primer or bait molecule is an oligonucleotide that allows capture, detection or isolation of a MPRIP-NTRK1 fusion nucleic acid molecule described herein. The oligonucleotide can comprise a nucleotide sequence substantially complementary to a fragment of the MPRIP-NTRK1 fusion nucleic acid molecules described herein. The sequence identity between the nucleic acid fragment, e.g., the oligonucleotide, and the target MPRIP-NTRK1 sequence need not be exact, so long as the sequences are sufficiently complementary to allow the capture, detection or isolation of the target sequence. In one embodiment, the nucleic acid fragment is a probe or primer that includes an oligonucleotide between about 5 and 25, e.g., between 10 and 20, or 10 and 15 nucleotides in length. In other embodiments, the nucleic acid fragment is a bait that includes an oligonucleotide between about 100 to 300 nucleotides, 130 and 230 nucleotides, or 150 and 200 nucleotides, in length.

In one embodiment, the nucleic acid fragment can be used to identify or capture, e.g., by hybridization, a MPRIP- NTRK1 fusion. For example, the nucleic acid fragment can be a probe, a primer, or a bait, for use in identifying or capturing, e.g., by hybridization, a MPRIP-NTRK1 fusion described herein. In one embodiment, the nucleic acid fragment can be useful for identifying or capturing a MPRIP-NTRK1 breakpoint, e.g., the nucleotide sequence of: chromosome 1 at nucleotide 156,845,212 plus or minus 10, 20, 30, 40, 50, 60, 80, 100, 150 nucleotides and chromosome 17 at nucleotide 17,080,829 plus or minus 10, 20, 30, 40 50, 60, 80, 100, 150 nucleotides.

In one embodiment, the nucleic acid fragment hybridizes to a nucleotide sequence within a chromosomal rearrangement that creates an in-frame fusion of intron 21 of MPRIP with intron 11 of NTRK1. In one embodiment, the nucleic acid fragment hybridizes to a nucleotide sequence in the region In other embodiments, the nucleic acid molecules includes a nucleotide sequence in the region of nucleotides 156,845,212 of chromosome 1 coupled to (e.g., juxtaposed to) nucleotides in the region of nucleotides 17,080,829 of chromosome 17. In one embodiment, the nucleic acid fragment hybridizes to a nucleotide sequence that includes a breakpoint, e.g., the nucleotide sequence of: chromosome 1 at nucleotide 156,845,212 plus or minus 10, 20, 30, 40 50, 60, 80, 100, 150 or more nucleotides and chromosome 17 at nucleotide 17,080,829 plus or minus 10, 20, 30, 40 50, 60, 80, 100, 150 or more nucleotides. For example, the nucleic acid fragment can hybridize to a nucleotide sequence that includes the fusion junction between the MPRIP gene and the NTRK1 gene, e.g., a nucleotide sequence that includes a portion of a nucleotide sequence within introns 21 of a MPRIP gene and 11 of a NTRK1 gene.

In another embodiment, the nucleic acid fragment hybridizes to a nucleotide sequence that comprises at least 6, 12, 15, 20, 25, 50, 75, 100, 150 or more nucleotides from exon 21 of MPRIP (e.g., from the nucleotide sequence of MPRIP preceding the fusion junction with NTRK1, e.g., of the MPRIP sequence shown in FIGS. 25A-25E (SEQ ID NO:25)), and at least 6, 12, 15, 20, 25, 50, 75, 100, 150 or more nucleotides from exon 12 of NTRK1 (e.g., from the nucleotide sequence of NTRK1 following the fusion junction with MPRIP, e.g., of the NTRK1 sequence shown in FIGS. 21A-21B (SEQ ID NO:21)).

The probes or primers described herein can be used, for example, for FISH detection or PCR amplification. In one exemplary embodiment where detection is based on PCR, amplification of the MPRIP-NTRK1 fusion junction fusion junction can be performed using a primer or a primer pair, e.g., for amplifying a sequence flanking the fusion junctions described herein, e.g., the mutations or the junction of a chromosomal rearrangement described herein, e.g., MPRIP-NTRK1.

In one embodiment, a pair of isolated oligonucleotide primers can amplify a region containing or adjacent to a position in the MPRIP-NTRK1 fusion. For example, forward primers can be designed to hybridize to a nucleotide sequence within MPRIP genomic or mRNA sequence (e.g., a nucleotide sequence within exon 21 of MPRIP of SEQ ID NO:25), and the reverse primers can be designed to hybridize to a nucleotide sequence of NTRK1 (e.g., a nucleotide sequence within exon 12 of NTRK1, of SEQ ID NO:21).

In another embodiment, the nucleic acid fragments can be used to identify, e.g., by hybridization, a MPRIP-NTRK1 fusion. In one embodiment, the nucleic acid fragment hybridizes to a nucleotide sequence that includes a fusion junction between the MPRIP transcript and the NTRK1 transcript.

In other embodiments, the nucleic acid fragment includes a bait that comprises a nucleotide sequence that hybridizes to a MPRIP-NTRK1 fusion nucleic acid molecule described herein, and thereby allows the capture or isolation said nucleic acid molecule. In one embodiment, a bait is suitable for solution phase hybridization. In other embodiments, a bait includes a binding entity, e.g., an affinity tag, that allows capture and separation, e.g., by binding to a binding entity, of a hybrid formed by a bait and a nucleic acid hybridized to the bait.

In other embodiments, the nucleic acid fragment includes a library member comprising a MPRIP-NTRK1 nucleic acid molecule described herein. In one embodiment, the library member includes a rearrangement that results in a MPRIP-NTRK1 fusion described herein.

The nucleic acid fragment can be detectably labeled with, e.g., a radiolabel, a fluorescent label, a bioluminescent label, a chemiluminescent label, an enzyme label, a binding pair label, or can include an affinity tag; a tag, or identifier (e.g., an adaptor, barcode or other sequence identifier).

MPRIP-NTRK1 Fusion Polypeptides

In another embodiment, the MPRIP-NTRK1 fusion comprises an amino acid sequence (e.g., a fragment of the amino acid sequence) shown in FIG. 26 (SEQ ID NO:26) and an amino acid sequence (e.g., a fragment of the amino acid sequence) shown in FIG. 22 (SEQ ID NO:22), or a fragment of the fusion. In one embodiment, the MPRIP-NTRK1 fusion comprises an amino acid sequence substantially identical to the amino acid sequence (e.g., a fragment of the amino acid sequence) shown in FIG. 26 (SEQ ID NO:26) and the amino acid sequence (e.g., a fragment of the amino acid sequence) shown in FIG. 22 (SEQ ID NO:22), or a fragment thereof. In one embodiment, the MPRIP-NTRK1 fusion comprises an amino acid sequence at least 70%, at least 75%, at least 80%, at least 85%, at least 90%, at least 95%, at least 99%, at least 99.5 or greater, identical to the amino acid sequence (e.g., a fragment of the amino acid sequence) shown in FIG. 26 (SEQ ID NO:26) and the amino acid sequence (e.g., a fragment of the amino acid sequence) shown in FIG. 22 (SEQ ID NO:22). In one embodiment, the MPRIP-NTRK1 fusion comprises a sequence containing at least 10, 20, 50, 100, 500, 600, 700, 800, 900, 1000, or more amino acids of the amino acid sequence shown in FIG. 26 (SEQ ID NO:26) and FIG. 22 (SEQ ID NO:22). In one embodiment, the MPRIP-NTRK1 fusion comprises an amino acid sequence containing at least 5, 10, 20, 50, 100, 500, 600, 700, 800, 900, 1000, or more contiguous amino acids of the amino acid sequence shown in FIGS. 26A-26C (SEQ ID NO:26) and at least 5, 10, 20, 50, 100, 500, 600, 700, 800, 900, 1000, or more contiguous amino acids of the amino acid sequence shown in FIG. 22 (SEQ ID NO:22). In one embodiment, the 5' MPRIP-3' NTRK1 fusion polypeptide includes a NTRK1 receptor tyrosine kinase domain or a functional fragment thereof. In an embodiment, the 5'MPRIP-3'NTRK1 fusion polypeptide comprises sufficient NTRK1 and sufficient MPRIP sequence such that it has kinase activity, e.g., has elevated activity, e.g., NTRK1 kinase activity, as compared with wild type NTRK1, e.g., in a cell of a cancer referred to herein.

In another aspect, the invention features a MPRIP-NTRK1 fusion polypeptide (e.g., a purified MPRIP-NTRK1 fusion polypeptide), a biologically active or antigenic fragment thereof, as well as reagents (e.g., antibody molecules that bind to a MPRIP-NTRK1 fusion polypeptide), methods for modulating a MPRIP-NTRK1 polypeptide activity and detection of a MPRIP-NTRK1 polypeptide.

In one embodiment, the MPRIP-NTRK1 fusion polypeptide has at least one biological activity, e.g., an NTRK1 kinase activity. In one embodiment, at least one biological activity of the MPRIP-NTRK1 fusion polypeptide is reduced or inhibited by an anti-cancer drug, e.g., a kinase inhibitor (e.g., a multikinase inhibitor or an NTRK1-specific inhibitor). In one embodiment, at least one biological activity of the MPRIP-NTRK1 fusion polypeptide is reduced or inhibited by an NTRK1 kinase inhibitor chosen from e.g., lestaurtinib (CEP-701); AZ-23; indenopyrrolocarboazole 12a; oxindole 3; isothiazole 5n; thiazole 20 h.

In yet other embodiments, the MPRIP-NTRK1 fusion polypeptide is encoded by a nucleic acid molecule described herein. In one embodiment, the MPRIP-NTRK1 fusion polypeptide is encoded by an in-frame fusion of intron 21 of MPRIP with intron 11 of NTRK1 (e.g., a sequence on chromosome 1). In another embodiment, the MPRIP-NTRK1 fusion polypeptide includes an amino acid sequence encoded by a nucleotide sequence comprising a fusion junction between the MPRIP transcript and the NTRK1 transcript.

In certain embodiments, the MPRIP-NTRK1 fusion polypeptide comprises one or more of encoded exons 1-21 from MPRIP and one or more of encoded exons 12-17 of NTRK1. In certain embodiments, the MPRIP-NTRK1 fusion polypeptide comprises at least 1, 2, 3, 4, 5, 6, 7, 8, 9, 10, 11, 12, 13, 14, 15, 16, 17, 18, 19, 20, 21 or more encoded exons from MPRIP and at least 1, 2, 3, 4, 5 or more, encoded exons from NTRK1. In certain embodiments, the MPRIP-NTRK1 fusion polypeptide comprises a fusion of encoded exon 21 from MPRIP and encoded exon 12 from NTRK1 (or a fragment thereof). In other embodiments, the fusion comprises least 1, 2, 3, 4, 5, 6, 7, 8, 9, 10, 11, 12, 13, 14, 15, 16, 17, 18, 19, 20, 21 encoded exons from MPRIP; and at least 1, 2, 3, 4, or 5 encoded exons from NTRK1. In certain embodiments, the MPRIP-NTRK1 fusion polypeptide comprises encoded exons 1-21 from MPRIP and exons 12-17 of NTRK1. In certain embodiments, the 5' MPRIP-3' NTRK1 fusion polypeptide comprises a fusion junction of the sequence of exon 21 from MPRIP and the sequence of exon 12 from NTRK1.

In certain embodiments, the MPRIP-NTRK1 fusion comprises the amino acid sequence corresponding to exon 21 or a fragment thereof from MPRIP, and the amino acid sequence corresponding to exon 12 or a fragment thereof from NTRK1 (e.g., as shown in FIG. 26 (SEQ ID NO:26) and FIG. 22 (SEQ ID NO:22)). In one embodiment, the MPRIP-NTRK1 fusion comprises at least 5, 10, 15, 20 or more amino acids from exon 21 of MPRIP (e.g., from the amino acid sequence of MPRIP preceding the fusion junction with NTRK1, e.g., of the MPRIP sequence shown in FIG. 26 (SEQ ID NO:26)), and at least 5, 10, 15, 20 or more amino acids from exon 12 of NTRK1 (e.g., from the amino acid sequence of NTRK1 following the fusion junction with MPRIP, e.g., of the NTRK1 sequence shown in FIG. 22 (SEQ ID NO:22)).

In one embodiment, the MPRIP-NTRK1 fusion polypeptide includes a NTRK1 tyrosine kinase domain or a functional fragment thereof. In a related aspect, the invention features MPRIP-NTRK1 fusion polypeptide or fragments operatively linked to heterologous polypeptides to form fusion proteins.

In another embodiment, the MPRIP-NTRK1 fusion polypeptide or fragment is a peptide, e.g., an immunogenic peptide or protein, that contains a fusion junction described herein. Such immunogenic peptides or proteins can be used to raise antibodies specific to the fusion protein. In other embodiments, such immunogenic peptides or proteins can be used for vaccine preparation. The vaccine preparation can include other components, e.g., an adjuvant.

In another aspect, the invention features antibody molecules that bind to a MPRIP-NTRK1 fusion polypeptide or fragment described herein. In embodiments, the antibody can distinguish wild type NTRK1 (or MPRIP) from MPRIP-NTRK1.

Detection Reagents and Detection of Mutations

In another aspect, the invention features a detection reagent, e.g., a purified or an isolated preparation thereof. Detection reagents can distinguish a nucleic acid, or protein sequence, having a breakpoint, e.g., a MPRIP-NTRK1 breakpoint; from a reference sequence. In one embodiment, the detection reagent detects (e.g., specifically detects) a MPRIP-NTRK1 fusion nucleic acid or a polypeptide (e.g., distinguishes a wild type NTRK1 or another NTRK1 fusion (or MPRIP) from a MPRIP-NTRK1 nucleic acid (e.g., as described herein in FIGS. 25A-25E (SEQ ID NO:25) and FIGS. 21A-21B (SEQ ID NO:21); or a MPRIP-NTRK1 polypeptide (e.g., as described herein in FIG. 26 (SEQ ID NO:26) and FIG. 22 (SEQ ID NO:22).

Detection reagents, e.g., nucleic acid-based detection reagents, can be used to identify mutations in a target nucleic acid, e.g., DNA, e.g., genomic DNA or cDNA, or RNA, e.g., in a sample, e.g., a sample of nucleic acid derived from a neoplastic or tumor cell, e.g., a melanocytic neoplasm, melanoma or metastatic cell. Detection reagents, e.g., antibody-based detection reagents, can be used to identify mutations in a target protein, e.g., in a sample, e.g., a sample of protein derived from, or produced by, a neoplastic or tumor cell, e.g., a melanocytic neoplasm, melanoma or metastatic cell.

Method of Treatment

In a related aspect, a method of inhibiting, reducing, or treating a hyperproliferative disorder, e.g., a neoplasm (including benign, pre-malignant or malignant (e.g., a cancer), in a subject is provided. The method includes administering to the subject a preselected therapeutic agent, e.g., an anti-cancer agent (e.g., a kinase inhibitor), as a single agent, or in combination, in an amount sufficient to reduce, inhibit or treat the activity or expression of MPRIP-NTRK1 (e.g., a MPRIP-NTRK1 fusion described herein), thereby inhibiting, reducing, or treating the hyperproliferative disorder in the subject.

In one embodiment, the subject treated has a MPRIP-NTRK1 fusion; e.g., the subject has a tumor or cancer harboring a MPRIP-NTRK1 fusion. In other embodiments, the subject has been previously identified as having a MPRIP-NTRK1 fusion. In yet other embodiments, the subject has been previously identified as being likely or unlikely to respond to treatment with a protein kinase inhibitor, e.g., a subject that has previously participated in a clinical trial. In other embodiments, the subject has been previously identified as being likely or unlikely to respond to treatment with a protein kinase inhibitor, based on the presence of the MPRIP-NTRK1 fusion. In one embodiment, the subject is a mammal, e.g., a human. In one embodiment, the subject has, or at risk of having a cancer at any stage of disease. In other embodiments, the subject is a patient, e.g., a cancer patient.

In certain embodiments, the neoplasm or neoplastic cell is a benign, pre-malignant, malignant (cancer) or metastasis. In certain embodiments, the cancer is a solid tumor, a soft tissue tumor, or a metastatic lesion.

In one embodiment, the neoplasm or neoplastic cell is a benign, pre-malignant, malignant (cancer) or metastasis. In certain embodiments, the cancer is a solid tumor, a soft tissue tumor, or a metastatic lesion. In one embodiment, the cancer is chosen from a lung cancer, a pancreatic cancer, melanoma, a colorectal cancer, an esophageal-gastric cancer, a thyroid cancer, or an adenocarcinoma. In one embodiment, the cancer is an adenocarcinoma. In one embodiment, the cancer is a lung adenocarcinoma. In other embodiment, the lung cancer is chosen from one or more of the following: non-small cell lung cancer (NSCLC), small cell lung cancer (SCLC), squamous cell carcinoma (SCC), adenocarcinoma of the lung, bronchogenic carcinoma, or a combination thereof. In one embodiment, the lung cancer is NSCLC or SCC. In certain embodiments, the cancer is a thyroid cancer, e.g., a thyroid papillary carcinoma. In certain embodiments, the cancer is a cancer os the ovary, large intestine, skin, stomach, upper aerodigestive tract, and/or lung. In certain embodiments, the cancer is a thyroid cancer, e.g., a thyroid papillary carcinoma, In one embodiment, the anti-cancer agent is a kinase inhibitor. For example, the kinase inhibitor is a multi-kinase inhibitor or a NTRK1-specific inhibitor. In one embodiment, the kinase inhibitor is a NTRK1 inhibitor including, but not limited to, lestaurtinib (CEP-701); AZ-23; indenopyrrolocarboazole 12a; oxindole 3; isothiazole 5n; thiazole 20 h. In certain embodiments, the NTRK1 inhibitor is a NTRK1 inhibitor described herein.

TRIM33-RET Fusions

In one embodiment, a fusion includes an in-frame fusion of an exon of tripartite motif containing 33 (TRIM33), e.g., one more exons of TRIM33 (e.g., one or more of exons 1-14 of TRIM33) or a fragment thereof, and an exon of ret proto-oncogene (RET), e.g., one or more exons of a RET (e.g., one or more of exons 12-19 of RET) or a fragment thereof. For example, the TRIM33-RET fusion can include an in-frame fusion within an intron of TRIM33 (e.g., intron 14) or a fragment thereof, with an intron of RET (e.g., intron 11) or a fragment thereof. In one embodiment, the fusion of the TRIM33-RET fusion comprises the nucleotide sequence of: chromosome 1 at one or more of nucleotide 114,948,358 (plus or minus 10, 20, 30, 50, 60, 70, 80, 100 or more nucleotides) and chromosome 10 at one or more of nucleotide 43,611,185 (plus or minus 10, 20, 30, 50, 60, 70, 80, 100 or more nucleotides). In one embodiment, the TRIM33-RET fusion is a translocation, e.g., a translocation of a portion of chromosome 1 or a portion of chromosome 10.

In certain embodiments, the TRIM33-RET fusion is in a 5'-TRIM33 to 3'-RET configuration (also referred to herein as "5'-TRIM33-RET-3')." The term "fusion" or "fusion molecule" can refer to a polypeptide or a nucleic acid fusion, depending on the context. It may include a full-length sequence of a fusion or a fragment thereof, e.g., a fusion junction (e.g., a fragment including a portion of TRIM33 and a portion of RET, e.g., a portion of the TRIM33-RET fusion described herein). In one embodiment, the TRIM33-RET fusion polypeptide includes a fragment of the amino acid sequence shown in FIG. 16 (SEQ ID NO:16) and a fragment of the amino acid sequence shown in FIG. 30 (SEQ ID NO:30), or an amino acid sequence substantially identical thereto. In another embodiment, the TRIM33-RET fusion nucleic acid includes a fragment of the nucleotide sequence shown in FIGS. 15A-15D (SEQ ID NO:15) and a fragment of the nucleotide sequence shown in FIGS. 29A-29B (SEQ ID NO:29), or a nucleotide sequence substantially identical thereto. In one embodiment, the TRIM33-RET fusion polypeptide comprises sufficient TRIM33 and sufficient RET sequence such that the 5' TRIM33-3' RET fusion has kinase activity, e.g., has elevated activity, e.g., RET tyrosine kinase activity, as compared with wild type RET, e.g., in a cell of a cancer referred to herein (e.g., adenocarcinoma, e.g., lung adenocarcinoma).

In certain embodiments, the TRIM33-RET fusion comprises one or more (or all of) exons 1-14 from TRIM33 and one or more (or all of) exons 12-19 of RET (e.g., one or more of the exons shown in FIGS. 15A-15D (SEQ ID NO:15) and FIGS. 29A-29B (SEQ ID NO:29). In another embodiment, the TRIM33-RET fusion comprises one or more (or all of) exons 1-14 of TRIM33 and one or more (or all of) exons 12-19 of RET. In certain embodiments, the TRIM33-RET fusion comprises at least 1, 2, 3, 4, 5, 6, 7, 8, 9, 10, 11, 12, 13, 14 or more exons (or encoded exons) from TRIM33 and at least 1, 2, 3, 4, 5, 6, 7, 8, 9 or more exons (or encoded) from RET (e.g., from the TRIM33 and RET sequences shown in FIGS. 15A-15D (SEQ ID NO:15) and FIG. 16 (SEQ ID NO:15 and 16) and FIGS. 29A-29B and FIG. 30 (SEQ ID NOs:29 and 30).

In certain embodiments, the TRIM33-RET fusion comprises exon 14 or a fragment thereof from TRIM33, and exon 12 or a fragment thereof from RET (e.g., as shown in FIGS. 15A-15D (SEQ ID NO:15) and FIGS. 29A-29B (SEQ ID NO:29)). In one embodiment, the TRIM33-RET fusion comprises at least 5, 10, 15, 20, 30, 40, 50 or more amino acids from exon 14 of TRIM33 (e.g., from the amino acid sequence of TRIM33 as shown in FIG. 16 (SEQ ID NO:16) (e.g., from the amino acid sequence of TRIM33 preceding the fusion junction with RET, and at least 5, 10, 15, 20, 30, 40, 50 or more amino acids from exon 12 of RET (e.g., from the amino acid sequence of RET as shown in FIG. 30 (SEQ ID NO:30)). In another embodiment, the TRIM33-RET fusion comprises at least 6, 12, 15, 20, 25, 50, 75, 100 or more nucleotides from exon 14 of TRIM33 (e.g., from the nucleotide sequence of TRIM33 as shown in FIGS. 15A-15D (SEQ ID NO:15) (e.g., from the nucleotide sequence of TRIM33 preceding the fusion junction with RET); and at least 6, 12, 15, 20, 25, 50, 75, 100 or more nucleotides from exon 12 of RET (e.g., from the nucleotide sequence of RET as shown in FIGS. 29A-29B (SEQ ID NO:29)).

TRIM33-RET Nucleic Acid Molecules

In one aspect, the invention features a nucleic acid molecule (e.g., an isolated or purified) nucleic acid molecule that includes a fragment of a TRIM33 gene and a fragment of a RET gene. In one embodiment, the nucleotide sequence encodes a TRIM33-RET fusion polypeptide that includes a RET tyrosine kinase domain or a functional fragment thereof. In another embodiment, the nucleotide sequence encodes a fragment of the RET polypeptide including the amino acid sequence of SEQ ID NO:30 or a fragment thereof, or a sequence substantially identical thereto. In other embodiments, the nucleic acid molecule includes a fragment of the TRIM33 gene encoding the amino acid sequence of SEQ ID NO:16 or a fragment thereof, or a sequence substantially identical thereto. In yet other embodiments, the nucleic acid molecule includes a nucleotide sequence encoding the amino acid sequence shown in FIG. 16 (SEQ ID NO:16), or a fragment thereof, and the amino acid sequence shown in FIG. 30 (SEQ ID NO:30) or a fragment thereof, or a sequence substantially identical thereto.

In one embodiment, the nucleic acid molecule includes a fusion, e.g., an in-frame fusion, between an intron of TRIM33 (e.g., intron 14, or a fragment thereof), and an intron of RET (e.g., intron 11, or a fragment thereof). The TRIM33-RET fusion can comprise a fusion of the nucleotide sequence of: chromosome 1 at one or more of nucleotide 114,948,358 (plus or minus 10, 20, 30, 50, 60, 70, 80, 100 nucleotides) and chromosome 10 at one or more of nucleotide 43,611,185 (plus or minus 10, 20, 30, 50, 60, 70, 80, 100 nucleotides), or a fragment thereof. In one embodiment, the TRIM33-RET fusion comprises a fusion of the nucleotide sequence of: chromosome 1 at one or more of nucleotide 114,948,358 (plus or minus 10, 20, 30, 50, 60, 70, 80, 100 nucleotides) and chromosome 10 at one or more of nucleotide 43,611,185 (plus or minus 10, 20, 30, 50, 60, 70, 80, 100 nucleotides), or a fragment thereof.

In another embodiment, the TRIM33-RET fusion comprises a nucleotide sequence (e.g., a fragment of a nucleotide sequence) shown in FIGS. 15A-15D (SEQ ID NO:15) and a nucleotide sequence (e.g., a fragment of a nucleotide sequence) shown in FIGS. 29A-29B (SEQ ID NO:29), or a fragment of the fusion. In one embodiment, the TRIM33-RET fusion comprises a nucleotide sequence substantially identical to the nucleotide sequence (e.g., a fragment of a nucleotide sequence) shown in FIGS. 15A-15D (SEQ ID NO:15) and the nucleotide sequence (e.g., a fragment of a nucleotide sequence) shown FIGS. 29A-29B (SEQ ID NO:29), or a fragment of the fusion. In one embodiment, the TRIM33-RET fusion comprises a nucleotide sequence at least 70%, at least 75%, at least 80%, at least 85%, at least 90%, at least 95%, at least 99%, at least 99.5 or greater, identical to the nucleotide sequence (e.g., a fragment of a nucleotide sequence) shown in FIGS. 15A-15D (SEQ ID NO:15) and to the nucleotide sequence (e.g., a fragment of a nucleotide sequence) shown in FIGS. 29A-29B (SEQ ID NO:29). In one embodiment, the TRIM33-RET fusion comprises a nucleotide sequence containing at least 25, 50, 100, 150, 200, 500, 1000, 1500, 2000, 2500, 3000, or more nucleotides of the nucleotide sequence shown in FIGS. 15A-15D (SEQ ID NO:15) and a nucleotide sequence containing at least 25, 50, 100, 150, 200, 500, 1000, 1500, 2000, 2500, 3000, or more nucleotides of the nucleotide sequence shown in FIGS. 29A-29B (SEQ ID NO:29). In one embodiment, the TRIM33-RET fusion comprises a nucleotide sequence containing at least 25, 50, 100, 150, 200, 500, 1000, 1500, 2000, 2500, 3000, or more contiguous nucleotides of the nucleotide sequence shown in FIGS. 15A-15D (SEQ ID NO:15) and a nucleotide sequence containing at least 25, 50, 100, 150, 200, 500, 1000, 1500, 2000, 2500, 3000, or more nucleotides of the nucleotide sequence shown in FIGS. 29A-29B (SEQ ID NO:29).

In another embodiment, the nucleic acid molecule includes a fusion, e.g., an in-frame fusion, of at least exon 14 of TRIM33 or a fragment thereof (e.g., one or more of exons 1-14 of TRIM33 or a fragment thereof), and at least exon 12 or a fragment thereof (e.g., one or more of exons 12-19 of RET or a fragment thereof). In yet other embodiments, the nucleic acid molecule includes a fragment the nucleotide sequence shown in FIGS. 15A-15D (SEQ ID NO:15) and a fragment of the nucleotide sequence shown in FIGS. 29A-29B (SEQ ID NO:29) or a fragment of the fusion, or a sequence substantially identical thereto.

In one embodiment, the nucleic acid molecule is complementary to at least a portion of a nucleotide sequence disclosed herein, e.g., is capable of hybridizing under a stringency condition described herein to SEQ ID NO:15 and/or SEQ ID NO:29, or a fragment thereof. In yet another embodiment, the nucleic acid molecule hybridizes to a nucleotide sequence that is complementary to at least a portion of a nucleotide sequence disclosed herein, e.g., is capable of hybridizing under a stringency condition to a nucleotide sequence complementary to SEQ ID NO:15 and/or SEQ ID NO:29, or a fragment thereof. The nucleotide sequence of a cDNA encoding an exemplary 5' TRIM33-3' RET fusion is shown in at least exon 14 (e.g., exons 1-14) of SEQ ID NO:27 and at least exon 12 (e.g., exons 12-19) of SEQ ID NO:29, and the predicted amino acid sequence is shown in the corresponding encoded exons of SEQ ID NO:16 and the corresponding encoded exons of SEQ ID NO:30, respectively.

In an embodiment the TRIM33-RET nucleic acid molecule comprises sufficient TRIM33 and sufficient RET sequence such that the encoded 5' TRIM33-3' RET fusion has kinase activity, e.g., has elevated activity, e.g., RET kinase activity, as compared with wild type RET, e.g., in a cell of a cancer referred to herein. In certain embodiments, the 5' TRIM33-3' RET fusion comprises exons 1-14 from TRIM33 and exons 12-19 from RET. In certain embodiments, the TRIM33-RET fusion comprises at least 1, 2, 3, 4, 5, 6, 7, 8, 9, 10, 11, 12, 13, 14 or more exons from TRIM33 and at least 1, 2, 3, 4, 5, 6, 7, 8, 9 or more, exons from RET. In certain embodiments, the TRIM33-RET fusion comprises a fusion of exon 14 from TRIM33 and exon 12 from RET. In another embodiment, the TRIM33-RET fusion comprises at least 1, 2, 3, 4, 5, 6, 7, 8, 9, 10, 11, 12, 13, 14 exons from TRIM33; and at least 1, 2, 3, 4, 5, 6, 7, 8, 9 exons from RET.

In one embodiment, the nucleic acid molecule includes a nucleotide sequence that has an in-frame fusion of intron 14 of TRIM33 (e.g., NM_015906) with intron 11 of RET (e.g., NM_020630). In another embodiment, the nucleic acid molecule includes a nucleotide sequence that includes a breakpoint. For example, the nucleic acid molecule includes a nucleotide sequence that includes the fusion junction between the TRIM33 gene and the RET gene, e.g., the breakpoint between intron 14 of TRIM33 and intron 11 of RET. In other embodiments, the nucleic acid molecules includes a nucleotide sequence of one or more of nucleotide 114,948,358 of chromosome 1 coupled to (e.g., directly or indirectly juxtaposed to) one or more of nucleotide 43,611,185 of chromosome 10. In one embodiment, the nucleic acid molecule includes the nucleotide sequence of: chromosome 1 at one or more of nucleotide 114,948,358 plus or minus 10, 20, 30, 40 50, 60, 80, 100, 150 nucleotides and chromosome 10 at one or more of nucleotide 43,611,185 plus or minus 10, 20, 30, 40 50, 60, 80, 100, 150 nucleotides (corresponding to the breakpoint of a TRIM33-RET fusion), or a fragment thereof, or a sequence substantially identical thereto. In one embodiment, the nucleic acid molecule is complementary to at least a portion of a nucleotide sequence disclosed herein, e.g., is capable of hybridizing under a stringency condition described herein to SEQ ID NO:15 and/or SEQ ID NO:29 or a fragment thereof. In yet other embodiment, the nucleic acid molecule hybridizes to a nucleotide sequence that is complementary to at least a portion of a nucleotide sequence disclosed herein, e.g., is capable of hybridizing under a stringency condition described herein to a nucleotide sequence complementary to SEQ ID NO:15 or 29 or a fragment thereof.

In another embodiment, the TRIM33-RET fusion nucleic acid comprises at least 6, 12, 15, 20, 25, 50, 75, 100 or more nucleotides from exon 14 of TRIM33 (e.g., from the nucleotide sequence of TRIM33 preceding the fusion junction with RET, e.g., of the TRIM33 sequence shown in FIGS. 15A-15D (SEQ ID NO:15)), and at least 6, 12, 15, 20, 25, 50, 75, 100 or more nucleotides from exon 12 of RET (e.g., from the nucleotide sequence of RET following the fusion junction with TRIM33, e.g., of the RET sequence shown in FIGS. 29A-29B (SEQ ID NO:29)).

In other embodiments, the nucleic acid molecule includes a nucleotide sequence encoding a TRIM33-RET fusion polypeptide that includes a fragment of a TRIM33 gene and a fragment of an RET gene. In one embodiment, the nucleotide sequence encodes a TRIM33-RET fusion polypeptide that includes e.g., an RET tyrosine kinase domain or a functional fragment thereof. In yet other embodiments, the nucleic acid molecule includes a nucleotide sequence encoding the amino acid sequence (e.g., a fragment of the amino acid sequence) shown in FIG. 16 (e.g., SEQ ID NO:16) and a nucleotide sequence encoding the amino acid sequence (e.g., a fragment of the amino acid sequence) shown in FIG. 30 (e.g., SEQ ID NO:30), or a fragment of the fusion, or a sequence substantially identical thereto. In one embodiment, the encoded TRIM33-RET fusion polypeptide includes an RET tyrosine kinase domain or a functional fragment thereof.

In a related aspect, the invention features nucleic acid constructs that include the TRIM33-RET nucleic acid molecules described herein. In certain embodiments, the nucleic acid molecules are operatively linked to a native or a heterologous regulatory sequence. Also included are vectors and host cells that include the TRIM33-RET nucleic acid molecules described herein, e.g., vectors and host cells suitable for producing the nucleic acid molecules and polypeptides described herein.

In a related aspect, methods of producing the nucleic acid molecules and polypeptides described herein are also described.

In another aspect, the invention features nucleic acid molecules that reduce or inhibit the expression of a nucleic acid molecule that encodes a TRIM33-RET fusion described herein. Examples of such nucleic acid molecules include, for example, antisense molecules, ribozymes, RNAi, triple helix molecules that hybridize to a nucleic acid encoding TRIM33-RET, or a transcription regulatory region of TRIM33-RET, and blocks or reduces mRNA expression of TRIM33-RET.

Nucleic Acid Detection and Capturing Reagents

The invention also features a nucleic acid molecule, e.g., nucleic acid fragment, suitable as probe, primer, bait or library member that includes, flanks, hybridizes to, which are useful for identifying, or are otherwise based on, the TRIM33-RET fusions described herein. In certain embodiments, the probe, primer or bait molecule is an oligonucleotide that allows capture, detection or isolation of a TRIM33-RET fusion nucleic acid molecule described herein. The oligonucleotide can comprise a nucleotide sequence substantially complementary to a fragment of the TRIM33-RET fusion nucleic acid molecules described herein. The sequence identity between the nucleic acid fragment, e.g., the oligonucleotide, and the target TRIM33-RET sequence need not be exact, so long as the sequences are sufficiently complementary to allow the capture, detection or isolation of the target sequence. In one embodiment, the nucleic acid fragment is a probe or primer that includes an oligonucleotide between about 5 and 25, e.g., between 10 and 20, or 10 and 15 nucleotides in length. In other embodiments, the nucleic acid fragment is a bait that includes an oligonucleotide between about 100 to 300 nucleotides, 130 and 230 nucleotides, or 150 and 200 nucleotides, in length.

In one embodiment, the nucleic acid fragment can be used to identify or capture, e.g., by hybridization, a TRIM33-RET fusion. For example, the nucleic acid fragment can be a probe, a primer, or a bait, for use in identifying or capturing, e.g., by hybridization, a TRIM33-RET fusion described herein. In one embodiment, the nucleic acid fragment can be useful for identifying or capturing a TRIM33-RET breakpoint, e.g., the nucleotide sequence of: chromosome 1 at nucleotide 114,948,358 plus or minus 10, 20, 30, 40, 50, 60, 80, 100, 150 nucleotides and chromosome 10 at nucleotide 43,611,185 plus or minus 10, 20, 30, 40 50, 60, 80, 100, 150 nucleotides.

In one embodiment, the nucleic acid fragment hybridizes to a nucleotide sequence within a chromosomal rearrangement that creates an in-frame fusion of intron 14 of TRIM33 with intron 11 of RET. In one embodiment, the nucleic acid fragment hybridizes to a nucleotide sequence in the region In other embodiments, the nucleic acid molecules includes a nucleotide sequence in the region of nucleotides 114,948, 358 of chromosome 1 coupled to (e.g., juxtaposed to) nucleotides in the region of nucleotides 43,611,185 of chromosome 10. In one embodiment, the nucleic acid fragment hybridizes to a nucleotide sequence that includes a breakpoint, e.g., the nucleotide sequence of: chromosome 1 at nucleotide 114,948,358 plus or minus 10, 20, 30, 40 50, 60, 80, 100, 150 or more nucleotides and chromosome 10 at nucleotide 43,611,185 plus or minus 10, 20, 30, 40 50, 60, 80, 100, 150 or more nucleotides. For example, the nucleic acid fragment can hybridize to a nucleotide sequence that includes the fusion junction between the TRIM33 gene and the RET gene, e.g., a nucleotide sequence that includes a portion of a nucleotide sequence within introns 14 of a TRIM33 gene and 11 of a RET gene.

In another embodiment, the nucleic acid fragment hybridizes to a nucleotide sequence that comprises at least 6, 12, 15, 20, 25, 50, 75, 100, 150 or more nucleotides from exon 14 of TRIM33 (e.g., from the nucleotide sequence of TRIM33 preceding the fusion junction with RET, e.g., of the TRIM33 sequence shown in FIGS. 15A-15D (SEQ ID NO:15)), and at least 6, 12, 15, 20, 25, 50, 75, 100, 150 or more nucleotides from exon 12 of RET (e.g., from the nucleotide sequence of RET following the fusion junction with TRIM33, e.g., of the RET sequence shown in FIGS. 29A-29B (SEQ ID NO:29)).

The probes or primers described herein can be used, for example, for FISH detection or PCR amplification. In one exemplary embodiment where detection is based on PCR, amplification of the TRIM33-RET fusion junction fusion junction can be performed using a primer or a primer pair, e.g., for amplifying a sequence flanking the fusion junctions described herein, e.g., the mutations or the junction of a chromosomal rearrangement described herein, e.g., TRIM33-RET.

In one embodiment, a pair of isolated oligonucleotide primers can amplify a region containing or adjacent to a position in the TRIM33-RET fusion. For example, forward primers can be designed to hybridize to a nucleotide sequence within TRIM33 genomic or mRNA sequence (e.g., a nucleotide sequence within exon 14 of TRIM33 of SEQ ID NO:15), and the reverse primers can be designed to hybridize to a nucleotide sequence of RET (e.g., a nucleotide sequence within exon 12 of RET, of SEQ ID NO:29).

In another embodiment, the nucleic acid fragments can be used to identify, e.g., by hybridization, a TRIM33-RET fusion. In one embodiment, the nucleic acid fragment hybridizes to a nucleotide sequence that includes a fusion junction between the TRIM33 transcript and the RET transcript.

In other embodiments, the nucleic acid fragment includes a bait that comprises a nucleotide sequence that hybridizes to a TRIM33-RET fusion nucleic acid molecule described herein, and thereby allows the capture or isolation said nucleic acid molecule. In one embodiment, a bait is suitable for solution phase hybridization. In other embodiments, a bait includes a binding entity, e.g., an affinity tag, that allows capture and separation, e.g., by binding to a binding entity, of a hybrid formed by a bait and a nucleic acid hybridized to the bait.

In other embodiments, the nucleic acid fragment includes a library member comprising a TRIM33-RETnucleic acid molecule described herein. In one embodiment, the library member includes a rearrangement that results in a TRIM33-RET fusion described herein.

The nucleic acid fragment can be detectably labeled with, e.g., a radiolabel, a fluorescent label, a bioluminescent label, a chemiluminescent label, an enzyme label, a binding pair label, or can include an affinity tag; a tag, or identifier (e.g., an adaptor, barcode or other sequence identifier).

TRIM33-RET Fusion Polypeptides

In another embodiment, the TRIM33-RET fusion comprises an amino acid sequence (e.g., a fragment of the amino acid sequence) shown in FIG. 16 (SEQ ID NO:16) and an amino acid sequence (e.g., a fragment of the amino acid sequence) shown in FIG. 30 (SEQ ID NO:30), or a fragment of the fusion. In one embodiment, the TRIM33-RET fusion comprises an amino acid sequence substantially identical to the amino acid sequence (e.g., a fragment of the amino acid sequence) shown in FIG. 16 (SEQ ID NO:16) and the amino acid sequence (e.g., a fragment of the amino acid sequence) shown in FIG. 30 (SEQ ID NO:30), or a fragment thereof. In one embodiment, the TRIM33-RET fusion comprises an amino acid sequence at least 70%, at least 75%, at least 80%, at least 85%, at least 90%, at least 95%, at least 99%, at least 99.5 or greater, identical to the amino acid sequence (e.g., a fragment of the amino acid sequence) shown in FIG. 16 (SEQ ID NO:16) and the amino acid sequence (e.g., a fragment of the amino acid sequence) shown in FIG. 30 (SEQ ID NO:30). In one embodiment, the TRIM33-RET fusion comprises a sequence containing at least 10, 20, 50, 100, 500, 600, 700, 800, 900, 1000, or more amino acids of the amino acid sequence shown in FIG. 16 (SEQ ID NO:16) and FIG. 30 (SEQ ID NO:30). In one embodiment, the TRIM33-RET fusion comprises an amino acid sequence containing at least 5, 10, 20, 50, 100, 500, 600, 700, 800, 900, 1000, or more contiguous amino acids of the amino acid sequence shown in FIG. 16 (SEQ ID NO:28) and at least 5, 10, 20, 50, 100, 500, 600, 700, 800, 900, 1000, or more contiguous amino acids of the amino acid sequence shown in FIG. 30 (SEQ ID NO:30). In one embodiment, the 5' TRIM33-3' RET fusion polypeptide includes a RET receptor tyrosine kinase domain or a functional fragment thereof. In an embodiment, the 5'TRIM33-3'RET fusion polypeptide comprises sufficient RET and sufficient TRIM33 sequence such that it has kinase activity, e.g., has elevated activity, e.g., RET kinase activity, as compared with wild type RET, e.g., in a cell of a cancer referred to herein.

In another aspect, the invention features a TRIM33-RET fusion polypeptide (e.g., a purified TRIM33-RET fusion polypeptide), a biologically active or antigenic fragment thereof, as well as reagents (e.g., antibody molecules that bind to a TRIM33-RET fusion polypeptide), methods for modulating a TRIM33-RET polypeptide activity and detection of a TRIM33-RET polypeptide.

In one embodiment, the TRIM33-RET fusion polypeptide has at least one biological activity, e.g., an RET kinase activity. In one embodiment, at least one biological activity of the TRIM33-RET fusion polypeptide is reduced or inhibited by an anti-cancer drug, e.g., a kinase inhibitor (e.g., a multikinase inhibitor or an RET-specific inhibitor). In one embodiment, at least one biological activity of the TRIM33-RET fusion polypeptide is reduced or inhibited by an RET kinase inhibitor chosen from e.g., CEP-701 and CEP-751; 2-indolinone, e.g., RPI-1; and quinazoline, e.g., ZD6474; or TG101209.

In yet other embodiments, the TRIM33-RET fusion polypeptide is encoded by a nucleic acid molecule described herein. In one embodiment, the TRIM33-RET fusion polypeptide is encoded by an in-frame fusion of intron 14 of TRIM33 with intron 11 of RET. In another embodiment, the TRIM33-RET fusion polypeptide includes an amino acid sequence encoded by a nucleotide sequence comprising a fusion junction between the TRIM33 transcript and the RET transcript.

In certain embodiments, the TRIM33-RET fusion polypeptide comprises one or more of encoded exons 1-14 from TRIM33 and one or more of encoded exons 12-19 of RET. In certain embodiments, the TRIM33-RET fusion polypeptide comprises at least 1, 2, 3, 4, 5, 6, 7, 8, 9, 10, 11, 12, 13, 14 or more encoded exons from TRIM33 and at least 1, 2, 3, 4, 5, 6, 7, 8, 9 or more, encoded exons from RET. In certain embodiments, the TRIM33-RET fusion polypeptide comprises a fusion of encoded exon 14 from TRIM33 and encoded exon 12 from RET (or a fragment thereof). In other embodiments, the fusion comprises least 1, 2, 3, 4, 5, 6, 7, 8, 9, 10, 11, 12, 13, 14 encoded exons from TRIM33; and at least 1, 2, 3, 4, 5, 6, 7, 8, 9 encoded exons from RET. In certain embodiments, the TRIM33-RET fusion polypeptide comprises encoded exons 1-14 from TRIM33 and exons 12-19 of RET. In certain embodiments, the 5' TRIM33-3' RET fusion polypeptide comprises a fusion junction of the sequence of exon 14 from TRIM33 and the sequence of exon 12 from RET.

In certain embodiments, the TRIM33-RET fusion comprises the amino acid sequence corresponding to exon 14 or a fragment thereof from TRIM33, and the amino acid sequence corresponding to exon 12 or a fragment thereof from RET (e.g., as shown in FIG. 16 (SEQ ID NO:16) and FIG. 30 (SEQ ID NO:30)). In one embodiment, the TRIM33-RET fusion comprises at least 5, 10, 15, 20 or more amino acids from exon 14 of TRIM33 (e.g., from the amino acid sequence of TRIM33 preceding the fusion junction with RET, e.g., of the TRIM33 sequence shown in FIG. 16 (SEQ ID NO:16)), and at least 5, 10, 15, 20 or more amino acids from exon 12 of RET (e.g., from the amino acid sequence of RET following the fusion junction with TRIM33, e.g., of the RET sequence shown in FIG. 30 (SEQ ID NO:30)).

In one embodiment, the TRIM33-RET fusion polypeptide includes a RET tyrosine kinase domain or a functional fragment thereof. In a related aspect, the invention features TRIM33-RET fusion polypeptide or fragments operatively linked to heterologous polypeptides to form fusion proteins.

In another embodiment, the TRIM33-RET fusion polypeptide or fragment is a peptide, e.g., an immunogenic peptide or protein, that contains a fusion junction described herein. Such immunogenic peptides or proteins can be used to raise antibodies specific to the fusion protein. In other embodiments, such immunogenic peptides or proteins can be used for vaccine preparation. The vaccine preparation can include other components, e.g., an adjuvant.

In another aspect, the invention features antibody molecules that bind to a TRIM33-RET fusion polypeptide or fragment described herein. In embodiments, the antibody can distinguish wild type RET (or TRIM33) from TRIM33-RET.

Detection Reagents and Detection of Mutations

In another aspect, the invention features a detection reagent, e.g., a purified or an isolated preparation thereof. Detection reagents can distinguish a nucleic acid, or protein sequence, having a breakpoint, e.g., a TRIM33-RETbreakpoint; from a reference sequence. In one embodiment, the detection reagent detects (e.g., specifically detects) a TRIM33-RET fusion nucleic acid or a polypeptide (e.g., distinguishes a wild type RET or another RET fusion (or TRIM33) from a TRIM33-RET nucleic acid (e.g., as described herein in FIGS. 15A-15D (SEQ ID NO:15) and FIGS. 29A-29B (SEQ ID NO:29); or a TRIM33-RET polypeptide (e.g., as described herein in FIG. 16 (SEQ ID NO:16) or FIG. 30 (SEQ ID NO:30).

Detection reagents, e.g., nucleic acid-based detection reagents, can be used to identify mutations in a target nucleic acid, e.g., DNA, e.g., genomic DNA or cDNA, or RNA, e.g., in a sample, e.g., a sample of nucleic acid derived from a neoplastic or tumor cell, e.g., a melanocytic neoplasm, melanoma or metastatic cell. Detection reagents, e.g., antibody-based detection reagents, can be used to identify mutations in a target protein, e.g., in a sample, e.g., a sample of protein derived from, or produced by, a neoplastic or tumor cell, e.g., a melanocytic neoplasm, melanoma or metastatic cell.

Method of Treatment

RET (Rearranged during Transfection) is a receptor tyrosine kinase, primarily expressed in cells of the nervous system. It has been identified as a proto-oncogene that results in transformation of cells upon recombination with a partner gene (Takahashi M, Ritz J, Cooper G M (1985) Activation of a novel human transforming gene, ret, by DNA rearrangement. Cell 42(2):581-8). Sporadic RET mutations have been identified in cancers, and germline mutations in RET result in familial medullary thyroid carcinoma (FMTC) and multiple endocrine neoplasia type 2 (MEN2) (Mulligan L M, Eng C, Healey C S, et al. (1994) Specific mutations of the RET proto-oncogene are related to disease phenotype in MEN 2A and FMTC. Nat Genet 6(1):70-4). The alteration in this tumor results from a rearrangement targeting intron 11 of RET, generating a likely fusion with an unknown partner. The resulting fusion gene has also been subjected to a partial amplification. This particular alteration has not been previously described.

A different genetic rearrangement results in the KIF5B-RET fusion, which has recently been reported in non-small cell lung cancer (NSCLC) by several groups, who used either deep sequencing of genomes and transcriptomes or combined immunohistochemistry, FISH, and RT-PCR to uncover this novel variant (Ju Y S, Lee W C, Shin J Y, et al. (2012) A transforming KIF5B and RET gene fusion in lung adenocarcinoma revealed from whole-genome and transcriptome sequencing. Genome Res 22(3):436-45, Lipson D, Capelletti M, Yelensky R, et al. (2012) Identification of new ALK and RET gene fusions from colorectal and lung cancer biopsies. Nat Med 18(3):382-4, Takeuchi K, Soda M, Togashi Y, et al. (2012) RET, ROS1 and ALK fusions in lung cancer. Nat Med 18(3):378-81, Kohno T, Ichikawa H, Totoki Y, et al. (2012) KIF5B-RET fusions in lung adenocarcinoma. Nat Med 18(3):375-7). KIFSB-RET results from a pericentric inversion on chromosome 10, generating a fusion of the kinesin and coiled coil domains of KIF5B and the kinase domain of RET (Lipson D, et al. (2012) Identification of new ALK and RET gene fusions from colorectal and lung cancer biopsies. Nat Med 18(3):382-4). At least 5 different in-frame variants of the fusion have been identified (Lipson D, et al. (2012) Identification of new ALK and RET gene fusions from colorectal and lung cancer biopsies. Nat Med 18(3):382-4, Takeuchi K, et al. (2012) RET, ROS1 and ALK fusions in lung cancer. Nat Med 18(3):378-81). The rearrangement was found to be mutually exclusive with EGFR, KRAS, and ERBB2 mutations, as well as EML4-ALK and ROS1 translocations, supporting the hypothesis that KIF5B-RET is an oncogenic gene fusion. All four groups reported KIF5B-RET in approximately 1-2% of NSCLC, exclusively in adenocarcinomas. The rearrangement may be slightly more prevalent in patients of Asian descent, and may be correlated with younger patients, non-smokers, and patients with smaller tumors (Lipson D, et al. (2012) Identification of new ALK and RET gene fusions from colorectal and lung cancer biopsies. Nat Med 18(3):382-4, Takeuchi K, et al. (2012) RET, ROS1 and ALK fusions in lung cancer. Nat Med 18(3):378-81). KIF5B-RET fusion is expected to result in the activation of Ret kinase. The RET fusion present in this tumor may also result in Ret kinase activation.

Alterations in RET have been reported in several cancer types. Point mutations have been reported in as many as 50% of medullary thyroid cancer (MTC) (reviewed in Phay J E, Shah M H (2010) Targeting RET receptor tyrosine kinase activation in cancer. Clin Cancer Res 16(24):5936-41), and RET rearrangements are common in papillary thyroid carcinomas (PTC) (reviewed in Nikiforov Y E (2008) Thyroid carcinoma: molecular pathways and therapeutic targets. Mod Pathol 21 Suppl 2:S37-43). In PTC, the 3' kinase domain of RET is frequently fused with the 5' region of another unrelated gene (at least 11 different genes have been reported) to generate an activated fusion product known as RET/PTC (Nikiforov Y E (2008) Thyroid carcinoma: molecular pathways and therapeutic targets. Mod Pathol 21 Suppl 2:S37-43). Amplification of RET has been reported in radiation-associated thyroid cancer (Nakashima M, Takamura N, Namba H, et al. (2007) RET oncogene amplification in thyroid cancer: correlations with radiation-associated and high-grade malignancy. Hum Pathol 38(4): 621-8). The RET fusion and amplification present in this tumor has not been previously reported or characterized, nor has RET amplification been reported in lung adenocarcinoma (PubMed, May 2012), although RET amplifications have been reported in 2/178 (1%) lung squamous cell carcinoma cases in The Cancer Genome Atlas (TCGA cBio Cancer Genomics Portal, http://www.cbioportal.org/, May 2012). However, a different RET fusion, with the gene KIF5B, has recently been reported in approximately 1-2% of NSCLC. Introduction of the KIF5B-RET fusion gene to BA/F3 (Lipson D, et al. (2012) Identification of new ALK and RET gene fusions from colorectal and lung cancer biopsies. Nat Med 18(3):382-4, Takeuchi K, et al. (2012) RET, ROS1 and ALK fusions in lung cancer. Nat Med 18(3):378-81) and NIH3T3 cells (Kohno T, et al. (2012) KIF5B-RET fusions in lung adenocarcinoma. Nat Med 18(3):375-7) led to oncogenic transformation and IL-3 independent growth, presumably due to the activation of the Ret oncogene. Transfection with a "kinase-dead" version of KIF5B-RET did not lead to oncogenic transformation, supporting the hypothesis that KIF5B-RET fusion leads to Ret activation and tumorigenesis (Kohno T, Ichikawa H, Totoki Y, et al. (2012) KIFSB-RET fusions in lung adenocarcinoma. Nat Med 18(3):375-7).

Activated Ret is capable of signaling through multiple pathways, including MAPK, PI3K/AKT, and Ras/ERK, leading to increased cell proliferation. Several inhibitors of Ret can be used in the methods herein, including vandetinib (Caprelsa®), sunitinib (Sutent®), and sorafenib (Nexavar®). Treatment of KIF5B-RET transformed cells with vandetinib inhibited cell growth (Lipson D, et al. (2012) Identification of new ALK and RET gene fusions from colorectal and lung cancer biopsies. Nat Med 18(3):382-4, Takeuchi K, et al. (2012) RET, ROS1 and ALK fusions in lung cancer. Nat Med 18(3):378-81, Kohno T, et al. (2012) KIF5B-RET fusions in lung adenocarcinoma. Nat Med 18(3):375-7). Lipson et al also demonstrated that KIF5B-RET transformed cells are sensitive to sorafenib and sunitinib, but not to the Egfr inhibitor gefitinib (Lipson D, et al. (2012) Identification of new ALK and RET gene fusions from colorectal and lung cancer biopsies. Nat Med 18(3): 382-4). Vandetanib has been approved by the FDA for use in MTC, on the basis of a randomized Phase 3 study comparing vandetanib to placebo, which found a significant improvement in PFS for patients treated with vandetanib (Wells et al., 2010; ASCO 2010 Abstract 5503).

Vandetanib has been studied in lung cancer patients (Natale R B, Thongprasert S, Greco F A, et al. (2011) Phase III trial of vandetanib compared with erlotinib in patients with previously treated advanced non-small-cell lung cancer. J Clin Oncol 29(8):1059-66). Sunitinib and sorafenib have been tested in lung cancer, studies of each suggest that the drugs may have benefit in some NSCLC patients, and safe doses have been established (Gervais R, Hainsworth J D, Blais N, et al. (2011) Phase II study of sunitinib as maintenance therapy in patients with locally advanced or metastatic non-small cell lung cancer. Lung Cancer 74(3): 474-80, Spigel D R, Burris H A, Greco F A, et al. (2011) Randomized, double-blind, placebo-controlled, phase II trial of sorafenib and erlotinib or erlotinib alone in previously treated advanced non-small-cell lung cancer. J Clin Oncol 29(18):2582-9). Both sunitinib and sorafenib are currently being tested in Phase 2 and 3 trials in NSCLC. Other multi-kinase inhibitors that target Ret, including cabozantinib (XL-184), are also being tested in clinical trials.

Accordingly, in another aspect, a method of inhibiting, reducing, or treating a hyperproliferative disorder, e.g., a neoplasm (including benign, pre-malignant or malignant (e.g., a cancer), in a subject is provided. The method includes administering to the subject a preselected therapeutic agent, e.g., an anti-cancer agent (e.g., a kinase inhibitor), as a single agent, or in combination, in an amount sufficient to reduce, inhibit or treat the activity or expression of TRIM33-RET (e.g., a TRIM33-RET fusion described herein), thereby inhibiting, reducing, or treating the hyperproliferative disorder in the subject.

In one embodiment, the subject treated has a TRIM33-RET fusion; e.g., the subject has a tumor or cancer harboring a TRIM33-RET fusion. In other embodiments, the subject has been previously identified as having a TRIM33-RETfusion. In yet other embodiments, the subject has been previously identified as being likely or unlikely to respond to treatment with a protein kinase inhibitor, e.g., a subject that has previously participated in a clinical trial. In other embodiments, the subject has been previously identified as being likely or unlikely to respond to treatment with a protein kinase inhibitor, based on the presence of the TRIM33-RETfusion. In one embodiment, the subject is a mammal, e.g., a human. In one embodiment, the subject has, or at risk of having a cancer at any stage of disease. In other embodiments, the subject is a patient, e.g., a cancer patient.

In certain embodiments, the neoplasm or neoplastic cell is a benign, pre-malignant, malignant (cancer) or metastasis. In certain embodiments, the cancer is a solid tumor, a soft tissue tumor, or a metastatic lesion.

In one embodiment, the neoplasm or neoplastic cell is a benign, pre-malignant, malignant (cancer) or metastasis. In certain embodiments, the cancer is a solid tumor, a soft tissue tumor, or a metastatic lesion. In one embodiment, the cancer is an adenocarcinoma. In one embodiment, the cancer is a lung adenocarcinoma. In one embodiment, the cancer is chosen from a lung cancer, a pancreatic cancer, melanoma, a colorectal cancer, an esophageal-gastric cancer, a thyroid cancer, or an adenocarcinoma. In one embodiment, the cancer is a lung adenocarcinoma. In other embodiment, the lung cancer is chosen from one or more of the following: non-small cell lung cancer (NSCLC), small cell lung cancer (SCLC), squamous cell carcinoma (SCC), adenocarcinoma of the lung, bronchogenic carcinoma, or a combination thereof. In one embodiment, the lung cancer is NSCLC or SCC. In certain embodiments, the cancer is a renal cell carcinoma. In certain embodiments, the cancer is a soft tissue sarcoma. In certain embodiments, the cancer is a solid tumor. In certain embodiments, the cancer is a thyroid cancer, e.g., medullary thyroid cancer, papillary thyroid cancer, In one embodiment, the anti-cancer agent is a kinase inhibitor. For example, the kinase inhibitor is a multi-kinase inhibitor or a RET-specific inhibitor. In one embodiment, the kinase inhibitor is a RET inhibitor including, but not limited to, vandentanib, sorafenib, sunitinib, erlotinib, gefitinib, XL-184, pazopanib; CEP-701 and CEP-751; 2-indolinone, e.g., RPI-1; and quinazoline, e.g., ZD6474; or TG101209. In certain embodiments, the RET inhibitor is a RET inhibitor described herein.

FGFR1-NTM Fusions

In one embodiment, a fusion includes an in-frame fusion of an exon of fibroblast growth factor receptor 1 (FGFR1), e.g., one more exons of FGFR1 (e.g., exon 1 of FGFR1) or a fragment thereof, and an exon of NTM proto-oncogene (NTM), e.g., one or more exons of a NTM (e.g., exon 1 of NTM) or a fragment thereof. For example, the FGFR1-NTM fusion can include an in-frame fusion within an intron of FGFR1 (e.g., intron 1) or a fragment thereof, with an intron of NTM (e.g., intron 1) or a fragment thereof. In one embodiment, the fusion of the FGFR1-NTM fusion comprises the nucleotide sequence of: chromosome 8 at one or more of nucleotide 38,318,554 (plus or minus 10, 20, 30, 50, 60, 70, 80, 100 or more nucleotides) and chromosome 11 at one or more of nucleotide 131,271,869 (plus or minus 10, 20, 30, 50, 60, 70, 80, 100 or more nucleotides). In one embodiment, the FGFR1-NTM fusion is a translocation, e.g., a translocation of a portion of chromosome 8 or a portion of chromosome 11.

In certain embodiments, the FGFR1-NTM fusion is in a 5'-FGFR1 to 3'-NTM configuration (also referred to herein as "5'-FGFR1-NTM-3')." The term "fusion" or "fusion molecule" can refer to a polypeptide or a nucleic acid fusion, depending on the context. It may include a full-length sequence of a fusion or a fragment thereof, e.g., a fusion junction (e.g., a fragment including a portion of FGFR1 and a portion of NTM, e.g., a portion of the FGFR1-NTM fusion described herein). In one embodiment, the FGFR1-NTM fusion polypeptide includes a fragment of the amino acid sequence shown in FIG. 32 (SEQ ID NO:32) and a fragment of the amino acid sequence shown in FIG. 34 (SEQ ID NO:34), or an amino acid sequence substantially identical thereto. In another embodiment, the FGFR1-NTM fusion nucleic acid includes a fragment of the nucleotide sequence shown in FIGS. 31A-31C (SEQ ID NO:31) and a fragment of the nucleotide sequence shown in FIGS. 33A-33B (SEQ ID NO:33), or a nucleotide sequence substantially identical thereto. In one embodiment, the FGFR1-NTM fusion polypeptide comprises sufficient FGFR1 and sufficient NTM sequence such that the 5' FGFR1-3' NTM fusion has kinase activity, e.g., has elevated activity, e.g., FGFR1 tyrosine kinase activity, as compared with wild type FGFR1, e.g., in a cell of a cancer referred to herein (e.g., carcinoma, e.g., a urothelial (transitional cell) carcinoma).

In certain embodiments, the FGFR1-NTM fusion comprises exon 1 from FGFR1 and exon 1 of NTM (e.g., one or more of the exons shown in FIGS. 31A-31C (SEQ ID NO:31) and FIGS. 33A-33B (SEQ ID NO:33). In another embodiment, the FGFR1-NTM fusion comprises exon 1 of FGFR1 and exon 1 of NTM. In certain embodiments, the FGFR1-NTM fusion comprises at least one or more exons (or encoded exons) from FGFR1 and at least one or more exons (or encoded exons) from NTM (e.g., from the FGFR1 and NTM sequences shown in FIGS. 31A-31C and FIG. 32 (SEQ ID NO:31 and 32) and FIGS. 33A-33B and FIG. 34 (SEQ ID NOs:33 and 34).

In certain embodiments, the FGFR1-NTM fusion comprises exon 1 or a fragment thereof from FGFR1, and exon 1 or a fragment thereof from NTM (e.g., as shown in FIGS. 31A-31C (SEQ ID NO:31) and FIGS. 33A-33B (SEQ ID NO:33)). In one embodiment, the FGFR1-NTM fusion comprises at least 5, 10, 15, 20, 30, 40, 50 or more amino acids encoded by exon 1 of FGFR1 (e.g., from the amino acid sequence of FGFR1 as shown in FIG. 32 (SEQ ID NO:32) (e.g., from the amino acid sequence of FGFR1 preceding the fusion junction with NTM, and at least 5, 10, 15, 20, 30, 40, 50 or more amino acids encoded by exon 1 of NTM (e.g., from the amino acid sequence of NTM as shown in FIG. 34 (SEQ ID NO:34)). In another embodiment, the FGFR1-NTM fusion comprises at least 6, 12, 15, 20, 25, 50, 75, 100 or more nucleotides from exon 1 of FGFR1 (e.g., from the nucleotide sequence of FGFR1 as shown in FIGS. 31A-31C (SEQ ID NO:31) (e.g., from the nucleotide sequence of FGFR1 preceding the fusion junction with NTM); and at least 6, 12, 15, 20, 25, 50, 75, 100 or more nucleotides from exon 1 of NTM (e.g., from the nucleotide sequence of NTM as shown in FIGS. 33A-33B (SEQ ID NO:33)).

FGFR1-NTM Nucleic Acid Molecules

In one aspect, the invention features a nucleic acid molecule (e.g., an isolated or purified) nucleic acid molecule that includes a fragment of a FGFR1 gene and a fragment of a NTM gene. In one embodiment, the nucleotide sequence encodes a FGFR1-NTM fusion polypeptide that includes a FGFR1 tyrosine kinase domain or a functional fragment thereof. In another embodiment, the nucleotide sequence encodes a fragment of the NTM polypeptide including the amino acid sequence of SEQ ID NO:34 or a fragment thereof, or a sequence substantially identical thereto. In other embodiments, the nucleic acid molecule includes a fragment of the FGFR1 gene encoding the amino acid sequence of SEQ ID NO:32 or a fragment thereof, or a sequence substantially identical thereto. In yet other embodiments, the nucleic acid molecule includes a nucleotide sequence encoding the amino acid sequence shown in FIG. 32 (SEQ ID NO:32), or a fragment thereof, and the amino acid sequence shown in FIG. 34 (SEQ ID NO:34) or a fragment thereof, or a sequence substantially identical thereto.

In one embodiment, the nucleic acid molecule includes a fusion, e.g., an in-frame fusion, between an intron of FGFR1 (e.g., intron 1, or a fragment thereof), and an intron of NTM (e.g., intron 1, or a fragment thereof). The FGFR1-NTM fusion can comprise a fusion of the nucleotide sequence of: chromosome 8 at one or more of nucleotide 114,948,358 (plus or minus 10, 20, 30, 50, 60, 70, 80, 100 nucleotides) and chromosome 11 at one or more of nucleotide 131,271,869 (plus or minus 10, 20, 30, 50, 60, 70, 80, 100 nucleotides), or a fragment thereof. In one embodiment, the FGFR1-NTM fusion comprises a fusion of the nucleotide sequence of: chromosome 8 at one or more of nucleotide 114,948,358 (plus or minus 10, 20, 30, 50, 60, 70, 80, 100 nucleotides) and chromosome 11 at one or more of nucleotide 131,271,869 (plus or minus 10, 20, 30, 50, 60, 70, 80, 100 nucleotides), or a fragment thereof.

In another embodiment, the FGFR1-NTM fusion comprises a nucleotide sequence (e.g., a fragment of a nucleotide sequence) shown in FIGS. 31A-31C (SEQ ID NO:31) and a nucleotide sequence (e.g., a fragment of a nucleotide sequence) shown in FIGS. 33A-33B (SEQ ID NO:33), or a fragment of the fusion. In one embodiment, the FGFR1-NTM fusion comprises a nucleotide sequence substantially identical to the nucleotide sequence (e.g., a fragment of a nucleotide sequence) shown in FIGS. 31A-31C (SEQ ID NO:31) and the nucleotide sequence (e.g., a fragment of a nucleotide sequence) shown FIGS. 33A-33B (SEQ ID NO:33), or a fragment of the fusion. In one embodiment, the FGFR1-NTM fusion comprises a nucleotide sequence at least 70%, at least 75%, at least 80%, at least 85%, at least 90%, at least 95%, at least 99%, at least 99.5 or greater, identical to the nucleotide sequence (e.g., a fragment of a nucleotide sequence) shown in FIGS. 31A-31C (SEQ ID NO:31) and to the nucleotide sequence (e.g., a fragment of a nucleotide sequence) shown in FIGS. 33A-33B (SEQ ID NO:33). In one embodiment, the FGFR1-NTM fusion comprises a nucleotide sequence containing at least 25, 50, 100, 150, 200, 500, 1000, 1500, 2000, 2500, 3000, or more nucleotides of the nucleotide sequence shown in FIGS. 31A-31C (SEQ ID NO:31) and a nucleotide sequence containing at least 25, 50, 100, 150, 200, 500, 1000, 1500, 2000, 2500, 3000, or more nucleotides of the nucleotide sequence shown in FIGS. 33A-33B (SEQ ID NO:33). In one embodiment, the FGFR1-NTM fusion comprises a nucleotide sequence containing at least 25, 50, 100, 150, 200, 500, 1000, 1500, 2000, 2500, 3000, or more contiguous nucleotides of the nucleotide sequence shown in FIGS. 31A-31C (SEQ ID NO:31) and a nucleotide sequence containing at least 25, 50, 100, 150, 200, 500, 1000, 1500, 2000, 2500, 3000, or more nucleotides of the nucleotide sequence shown in FIGS. 33A-33B (SEQ ID NO:33).

In another embodiment, the nucleic acid molecule includes a fusion, e.g., an in-frame fusion, of at least exon 1 of FGFR1 or a fragment thereof (e.g., exon 1 of FGFR1 or a fragment thereof), and at least exon 1 or a fragment thereof (e.g., exon 1 of NTM or a fragment thereof). In yet other embodiments, the nucleic acid molecule includes a fragment the nucleotide sequence shown in FIGS. 31A-31C (SEQ ID NO:31) and a fragment of the nucleotide sequence shown in FIGS. 33A-33B (SEQ ID NO:33) or a fragment of the fusion, or a sequence substantially identical thereto.

In one embodiment, the nucleic acid molecule is complementary to at least a portion of a nucleotide sequence disclosed herein, e.g., is capable of hybridizing under a stringency condition described herein to SEQ ID NO:31 and/or SEQ ID NO:33, or a fragment thereof. In yet another embodiment, the nucleic acid molecule hybridizes to a nucleotide sequence that is complementary to at least a portion of a nucleotide sequence disclosed herein, e.g., is capable of hybridizing under a stringency condition to a nucleotide sequence complementary to SEQ ID NO:31 and/or SEQ ID NO:33, or a fragment thereof. The nucleotide sequence of a cDNA encoding an exemplary 5' FGFR1-3' NTM fusion is shown in at least exon 1 (e.g., exon 1) of SEQ ID NO:31 and at least exon 1 (e.g., exon 1) of SEQ ID NO:21, and the predicted amino acid sequence is shown in the corresponding encoded exons of SEQ ID NO:32 and the corresponding encoded exons of SEQ ID NO:34, respectively.

In an embodiment the FGFR1-NTM nucleic acid molecule comprises sufficient FGFR1 and sufficient NTM sequence such that the encoded 5' FGFR1-3' NTM fusion has kinase activity, e.g., has elevated activity, e.g., FGFR1 kinase activity, as compared with wild type FGFR1, e.g., in a cell of a cancer referred to herein. In certain embodiments, the 5' FGFR1-3' NTM fusion comprises exon 1 from FGFR1 and exon 1 from NTM. In certain embodiments, the FGFR1-NTM fusion comprises at least 1 or more exons from FGFR1 and at least 1 or more, exons from NTM. In certain embodiments, the FGFR1-NTM fusion comprises a fusion of exon 1 from FGFR1 and exon 1 from NTM. In another embodiment, the FGFR1-NTM fusion comprises at least 1 exon from FGFR1; and at least 1 exon from NTM.

In one embodiment, the nucleic acid molecule includes a nucleotide sequence that has an in-frame fusion of intron 1 of FGFR1 (e.g., NM_015850) with intron 1 of NTM (e.g., NM_016522). In another embodiment, the nucleic acid molecule includes a nucleotide sequence that includes a breakpoint. For example, the nucleic acid molecule includes a nucleotide sequence that includes the fusion junction between the FGFR1 gene and the NTM gene, e.g., the breakpoint between intron 1 of FGFR1 and intron 1 of NTM. In other embodiments, the nucleic acid molecules includes a nucleotide sequence of one or more of nucleotide 114, 948,358 of chromosome 8 coupled to (e.g., directly or indirectly juxtaposed to) one or more of nucleotide 131,271, 869 of chromosome 11. In one embodiment, the nucleic acid molecule includes the nucleotide sequence of: chromosome 8 at one or more of nucleotide 114,948,358 plus or minus 10, 20, 30, 40 50, 60, 80, 100, 150 nucleotides and chromosome 11 at one or more of nucleotide 131,271,869 plus or minus 10, 20, 30, 40 50, 60, 80, 100, 150 nucleotides (corresponding to the breakpoint of a FGFR1-NTM fusion), or a fragment thereof, or a sequence substantially identical thereto. In one embodiment, the nucleic acid molecule is complementary to at least a portion of a nucleotide sequence disclosed herein, e.g., is capable of hybridizing under a stringency condition described herein to SEQ ID NO:31 and/or SEQ ID NO:33 or a fragment thereof. In yet other embodiment, the nucleic acid molecule hybridizes to a nucleotide sequence that is complementary to at least a portion of a nucleotide sequence disclosed herein, e.g., is capable of hybridizing under a stringency condition described herein to a nucleotide sequence complementary to SEQ ID NO:31 or 33 or a fragment thereof.

In another embodiment, the FGFR1-NTM fusion nucleic acid comprises at least 6, 12, 15, 20, 25, 50, 75, 100 or more nucleotides from exon 1 of FGFR1 (e.g., from the nucleotide sequence of FGFR1 preceding the fusion junction with NTM, e.g., of the FGFR1 sequence shown in FIGS. 31A-31C (SEQ ID NO:31)), and at least 6, 12, 15, 20, 25, 50, 75, 100 or more nucleotides from exon 1 of NTM (e.g., from the nucleotide sequence of NTM following the fusion junction with FGFR1, e.g., of the NTM sequence shown in FIGS. 33A-33B (SEQ ID NO:33)).

In other embodiments, the nucleic acid molecule includes a nucleotide sequence encoding a FGFR1-NTM fusion polypeptide that includes a fragment of a FGFR1 gene and a fragment of an NTM gene. In one embodiment, the nucleotide sequence encodes a FGFR1-NTM fusion polypeptide that includes e.g., an FGFR1 tyrosine kinase domain or a functional fragment thereof. In yet other embodiments, the nucleic acid molecule includes a nucleotide sequence encoding the amino acid sequence (e.g., a fragment of the amino acid sequence) shown in FIG. 32 (e.g., SEQ ID NO:32) and a nucleotide sequence encoding the amino acid sequence (e.g., a fragment of the amino acid sequence) shown in FIG. 34 (e.g., SEQ ID NO:34), or a fragment of the fusion, or a sequence substantially identical thereto. In one embodiment, the encoded FGFR1-NTM fusion polypeptide includes an FGFR1 tyrosine kinase domain or a functional fragment thereof.

In a related aspect, the invention features nucleic acid constructs that include the FGFR1-NTMnucleic acid molecules described herein. In certain embodiments, the nucleic acid molecules are operatively linked to a native or a heterologous regulatory sequence. Also included are vectors and host cells that include the FGFR1-NTM nucleic acid molecules described herein, e.g., vectors and host cells suitable for producing the nucleic acid molecules and polypeptides described herein.

In a related aspect, methods of producing the nucleic acid molecules and polypeptides described herein are also described.

In another aspect, the invention features nucleic acid molecules that reduce or inhibit the expression of a nucleic acid molecule that encodes a FGFR1-NTM fusion described herein. Examples of such nucleic acid molecules include, for example, antisense molecules, ribozymes, RNAi, triple helix molecules that hybridize to a nucleic acid encoding FGFR1-NTM, or a transcription regulatory region of FGFR1-NTM, and blocks or reduces mRNA expression of FGFR1-NTM.

Nucleic Acid Detection and Capturing Reagents

The invention also features a nucleic acid molecule, e.g., nucleic acid fragment, suitable as probe, primer, bait or library member that includes, flanks, hybridizes to, which are useful for identifying, or are otherwise based on, the FGFR1-NTM fusions described herein. In certain embodiments, the probe, primer or bait molecule is an oligonucleotide that allows capture, detection or isolation of a FGFR1-NTM fusion nucleic acid molecule described herein. The oligonucleotide can comprise a nucleotide sequence substantially complementary to a fragment of the FGFR1-NTM fusion nucleic acid molecules described herein. The sequence identity between the nucleic acid fragment, e.g., the oligonucleotide, and the target FGFR1-NTMsequence need not be exact, so long as the sequences are sufficiently complementary to allow the capture, detection or isolation of the target sequence. In one embodiment, the nucleic acid fragment is a probe or primer that includes an oligonucleotide between about 5 and 25, e.g., between 10 and 20, or 10 and 15 nucleotides in length. In other embodiments, the nucleic acid fragment is a bait that includes an oligonucleotide between about 100 to 300 nucleotides, 130 and 230 nucleotides, or 150 and 200 nucleotides, in length.

In one embodiment, the nucleic acid fragment can be used to identify or capture, e.g., by hybridization, a FGFR1-NTM fusion. For example, the nucleic acid fragment can be a probe, a primer, or a bait, for use in identifying or capturing, e.g., by hybridization, a FGFR1-NTM fusion described herein. In one embodiment, the nucleic acid fragment can be useful for identifying or capturing a FGFR1-NTM breakpoint, e.g., the nucleotide sequence of: chromosome 8 at nucleotide 114,948,358 plus or minus 10, 20, 30, 40 50, 60, 80, 100, 150 nucleotides and chromosome 11 at nucleotide 131,271,869 plus or minus 10, 20, 30, 40 50, 60, 80, 100, 150 nucleotides.

In one embodiment, the nucleic acid fragment hybridizes to a nucleotide sequence within a chromosomal rearrangement that creates an in-frame fusion of intron 1 of FGFR1 with intron 1 of NTM. In one embodiment, the nucleic acid fragment hybridizes to a nucleotide sequence in the region In other embodiments, the nucleic acid molecules includes a nucleotide sequence in the region of nucleotides 38,318, 554 of chromosome 8 coupled to (e.g., juxtaposed to) nucleotides in the region of nucleotides 131,271,869 of chromosome 11. In one embodiment, the nucleic acid fragment hybridizes to a nucleotide sequence that includes a breakpoint, e.g., the nucleotide sequence of: chromosome 8 at nucleotide 114,948,358 plus or minus 10, 20, 30, 40 50, 60, 80, 100, 150 or more nucleotides and chromosome 11 at nucleotide 131,271,869 plus or minus 10, 20, 30, 40 50, 60, 80, 100, 150 or more nucleotides. For example, the nucleic acid fragment can hybridize to a nucleotide sequence that includes the fusion junction between the FGFR1 gene and the NTM gene, e.g., a nucleotide sequence that includes a portion of a nucleotide sequence within introns 14 of a FGFR1 gene and 11 of a NTM gene.

In another embodiment, the nucleic acid fragment hybridizes to a nucleotide sequence that comprises at least 6, 12, 15, 20, 25, 50, 75, 100, 150 or more nucleotides from exon 1 of FGFR1 (e.g., from the nucleotide sequence of FGFR1 preceding the fusion junction with NTM, e.g., of the FGFR1 sequence shown in FIGS. 31A-31C (SEQ ID NO:31)), and at least 6, 12, 15, 20, 25, 50, 75, 100, 150 or more nucleotides from exon 1 of NTM (e.g., from the nucleotide sequence of NTM following the fusion junction with FGFR1, e.g., of the NTM sequence shown in FIGS. 33A-33B (SEQ ID NO:33)).

The probes or primers described herein can be used, for example, for FISH detection or PCR amplification. In one exemplary embodiment where detection is based on PCR, amplification of the FGFR1-NTM fusion junction fusion junction can be performed using a primer or a primer pair, e.g., for amplifying a sequence flanking the fusion junctions described herein, e.g., the mutations or the junction of a chromosomal rearrangement described herein, e.g., FGFR1-NTM.

In one embodiment, a pair of isolated oligonucleotide primers can amplify a region containing or adjacent to a position in the FGFR1-NTM fusion. For example, forward primers can be designed to hybridize to a nucleotide sequence within FGFR1 genomic or mRNA sequence (e.g., a nucleotide sequence within exon 1 of FGFR1 of SEQ ID NO:31), and the reverse primers can be designed to hybridize to a nucleotide sequence of NTM (e.g., a nucleotide sequence within exon 1 of NTM, of SEQ ID NO:33).

In another embodiment, the nucleic acid fragments can be used to identify, e.g., by hybridization, a FGFR1-NTM fusion. In one embodiment, the nucleic acid fragment hybridizes to a nucleotide sequence that includes a fusion junction between the FGFR1 transcript and the NTM transcript.

In other embodiments, the nucleic acid fragment includes a bait that comprises a nucleotide sequence that hybridizes to a FGFR1-NTM fusion nucleic acid molecule described herein, and thereby allows the capture or isolation said nucleic acid molecule. In one embodiment, a bait is suitable for solution phase hybridization. In other embodiments, a bait includes a binding entity, e.g., an affinity tag, that allows capture and separation, e.g., by binding to a binding entity, of a hybrid formed by a bait and a nucleic acid hybridized to the bait.

In other embodiments, the nucleic acid fragment includes a library member comprising a FGFR1-NTMnucleic acid molecule described herein. In one embodiment, the library member includes a rearrangement that results in a FGFR1-NTM fusion described herein.

The nucleic acid fragment can be detectably labeled with, e.g., a radiolabel, a fluorescent label, a bioluminescent label, a chemiluminescent label, an enzyme label, a binding pair label, or can include an affinity tag; a tag, or identifier (e.g., an adaptor, barcode or other sequence identifier).

FGFR1-NTM Fusion Polypeptides

In another embodiment, the FGFR1-NTM fusion comprises an amino acid sequence (e.g., a fragment of the amino acid sequence) shown in FIG. 32 (SEQ ID NO:32) and an amino acid sequence (e.g., a fragment of the amino acid sequence) shown in FIG. 34 (SEQ ID NO:34), or a fragment of the fusion. In one embodiment, the FGFR1-NTM fusion comprises an amino acid sequence substantially identical to the amino acid sequence (e.g., a fragment of the amino acid sequence) shown in FIG. 32 (SEQ ID NO:32) and the amino acid sequence (e.g., a fragment of the amino acid sequence) shown in FIG. 34 (SEQ ID NO:34), or a fragment thereof. In one embodiment, the FGFR1-NTM fusion comprises an amino acid sequence at least 70%, at least 75%, at least 80%, at least 85%, at least 90%, at least 95%, at least 99%, at least 99.5 or greater, identical to the amino acid sequence (e.g., a fragment of the amino acid sequence) shown in FIG. 32 (SEQ ID NO:32) and the amino acid sequence (e.g., a fragment of the amino acid sequence) shown in FIG. 34 (SEQ ID NO:34). In one embodiment, the FGFR1-NTM fusion comprises a sequence containing at least 10, 20, 50, 100, 500, 600, 700, 800, 900, 1000, or more amino acids of the amino acid sequence shown in FIG. 32 (SEQ ID NO:32) and FIG. 34 (SEQ ID NO:34). In one embodiment, the FGFR1-NTM fusion comprises an amino acid sequence containing at least 5, 10, 20, 50, 100, 500, 600, 700, 800, 900, 1000, or more contiguous amino acids of the amino acid sequence shown in FIG. 32 (SEQ ID NO:32) and at least 5, 10, 20, 50, 100, 500, 600, 700, 800, 900, 1000, or more contiguous amino acids of the amino acid sequence shown in FIG. 34 (SEQ ID NO:34). In one embodiment, the FGFR1-NTM fusion polypeptide includes a FGFR1 receptor tyrosine kinase domain or a functional fragment thereof. In an embodiment, the FGFR1-NTM fusion polypeptide comprises sufficient NTM and sufficient FGFR1 sequence such that it has kinase activity, e.g., has elevated activity, e.g., FGFR1 kinase activity, as compared with wild type FGFR1, e.g., in a cell of a cancer referred to herein.

In another aspect, the invention features a FGFR1-NTM fusion polypeptide (e.g., a purified FGFR1-NTM fusion polypeptide), a biologically active or antigenic fragment thereof, as well as reagents (e.g., antibody molecules that bind to a FGFR1-NTM fusion polypeptide), methods for modulating a FGFR1-NTM polypeptide activity and detection of a FGFR1-NTM polypeptide.

In one embodiment, the FGFR1-NTM fusion polypeptide has at least one biological activity, e.g., an FGFR1 kinase activity. In one embodiment, at least one biological activity of the FGFR1-NTM fusion polypeptide is reduced or inhibited by an anti-cancer drug, e.g., a kinase inhibitor (e.g., a multikinase inhibitor or an FGFR1-specific inhibitor). In one embodiment, at least one biological activity of the FGFR1-NTM fusion polypeptide is reduced or inhibited by an FGFR1 kinase inhibitor chosen from e.g., ponatinib (AP24534); PD173074; AZD4547; BGJ398 (NVP-BGJ398); and TSU-68 (SU6668).

In yet other embodiments, the FGFR1-NTM fusion polypeptide is encoded by a nucleic acid molecule described herein. In one embodiment, the FGFR1-NTM fusion polypeptide is encoded by an in-frame fusion of intron 1 of FGFR1 with intron 1 of NTM. In another embodiment, the FGFR1-NTM fusion polypeptide includes an amino acid sequence encoded by a nucleotide sequence comprising a fusion junction between the FGFR1 transcript and the NTM transcript.

In certain embodiments, the FGFR1-NTM fusion polypeptide comprises one or more of encoded exons 1 from FGFR1 and one or more of encoded exons 1-7 of NTM. In certain embodiments, the FGFR1-NTM fusion polypeptide comprises at least 1 or more encoded exons from FGFR1 and at least 1, 2, 3, 4, 5, 6, 7 or more, encoded exons from NTM. In certain embodiments, the FGFR1-NTM fusion polypeptide comprises a fusion of encoded exon 1 from FGFR1 and encoded exon 1 from NTM (or a fragment thereof). In other embodiments, the fusion comprises least 1 encoded exon from FGFR1; and at least 1, 2, 3, 4, 5, 6, 7 encoded exons from NTM. In certain embodiments, the FGFR1-NTM fusion polypeptide comprises encoded exon 1 from FGFR1 and exons 1-7 of NTM. In certain embodiments, the 5' FGFR1-3' NTM fusion polypeptide comprises a fusion junction of the sequence of exon 1 from FGFR1 and the sequence of exon 1 from NTM.

In certain embodiments, the FGFR1-NTM fusion comprises the amino acid sequence corresponding to exon 1 or a fragment thereof from FGFR1, and the amino acid sequence corresponding to exon 1 or a fragment thereof from NTM (e.g., as shown in FIG. 32 (SEQ ID NO:32) and FIG. 34 (SEQ ID NO:34)). In one embodiment, the FGFR1-NTM fusion comprises at least 5, 10, 15, 20 or more amino acids from exon 1 of FGFR1 (e.g., from the amino acid sequence of FGFR1 preceding the fusion junction with NTM, e.g., of the FGFR1 sequence shown in FIG. 32 (SEQ ID NO:32)), and at least 5, 10, 15, 20 or more amino acids from exon 1 of NTM (e.g., from the amino acid sequence of NTM following the fusion junction with FGFR1, e.g., of the NTM sequence shown in FIG. 34 (SEQ ID NO:34)).

In one embodiment, the FGFR1-NTM fusion polypeptide includes a FGFR1 tyrosine kinase domain or a functional fragment thereof. In a related aspect, the invention features FGFR1-NTM fusion polypeptide or fragments operatively linked to heterologous polypeptides to form fusion proteins.

In another embodiment, the FGFR1-NTM fusion polypeptide or fragment is a peptide, e.g., an immunogenic peptide or protein, that contains a fusion junction described herein. Such immunogenic peptides or proteins can be used to raise antibodies specific to the fusion protein. In other embodiments, such immunogenic peptides or proteins can be used for vaccine preparation. The vaccine preparation can include other components, e.g., an adjuvant.

In another aspect, the invention features antibody molecules that bind to a FGFR1-NTM fusion polypeptide or fragment described herein. In embodiments, the antibody can distinguish wild type NTM (or FGFR1) from FGFR1-NTM.

Detection Reagents and Detection of Mutations

In another aspect, the invention features a detection reagent, e.g., a purified or an isolated preparation thereof. Detection reagents can distinguish a nucleic acid, or protein sequence, having a breakpoint, e.g., a FGFR1-NTM breakpoint; from a reference sequence. In one embodiment, the detection reagent detects (e.g., specifically detects) a FGFR1-NTM fusion nucleic acid or a polypeptide (e.g., distinguishes a wild type NTM or another NTM fusion (or FGFR1) from a FGFR1-NTM nucleic acid (e.g., as described herein in FIGS. 31A-31C (SEQ ID NO:31) and FIGS. 33A-33B (SEQ ID NO:33); or a FGFR1-NTM polypeptide (e.g., as described herein in FIG. 32 (SEQ ID NO:32) and FIG. 34 (SEQ ID NO:34).

Detection reagents, e.g., nucleic acid-based detection reagents, can be used to identify mutations in a target nucleic acid, e.g., DNA, e.g., genomic DNA or cDNA, or RNA, e.g., in a sample, e.g., a sample of nucleic acid derived from a neoplastic or tumor cell, e.g., a melanocytic neoplasm, melanoma or metastatic cell. Detection reagents, e.g., antibody-based detection reagents, can be used to identify mutations in a target protein, e.g., in a sample, e.g., a sample of protein derived from, or produced by, a neoplastic or tumor cell, e.g., a melanocytic neoplasm, melanoma or metastatic cell.

Method of Treatment

The FGFR1 gene encodes Fgfr1, which plays key roles in regulation of the cell cycle, angiogenesis, and is an upstream regulator of the RAS, MAPK, and Akt signaling pathways (Turner N, Grose R (2010) Fibroblast growth factor signalling: from development to cancer. Nat Rev Cancer 10(2): 116-29). FGFR1 oncogenic fusions have been frequently reported in myeloproliferative neoplasms, often as the result of a t(8; 13)(p11;q12) rearrangement (reviewed in Chase A, Bryant C, Score J, et al. (2012) Ponatinib as targeted therapy for FGFR1 fusions associated with the 8p11 myeloproliferative syndrome. Haematologica ePub August 2012). FGFR1 oncogenic fusions have also been reported in glioblastoma (Singh D, Chan J M, Zoppoli P, et al. (2012) Transforming fusions of FGFR and TACC genes in human glioblastoma. Science 337(6099):1231-5) and rhabdomyosarcoma (Liu J, Guzman M A, Pezanowski D, et al. (2011) FOXO1-FGFR1 fusion and amplification in a solid variant of alveolar rhabdomyosarcoma. Mod Pathol 24(10):1327-35), but have not been observed in urothelial carcinoma (UC). The FGFR1 fusion seen in this tumor has not been previously reported in the literature, and the functional consequences are therefore uncertain. FGFR1 mutations are rare in (UC) (di Martino E, Tomlinson D C, Knowles M A (2012) A Decade of FGF Receptor Research in Bladder Cancer: Past, Present, and Future Challenges. Adv Urol 2012:429213); no mutations in UC have been reported in the COSMIC database (September 2012). However, FGFR1 is frequently overexpressed in urothelial carcinoma, and has been associated with MAPK pathway activation and the epithelial-mesenchymal transition (EMT) (Tomlinson D C, Lamont F R, Shnyder S D, et al. (2009) Fibroblast growth factor receptor 1 promotes proliferation and survival via activation of the mitogen-activated protein kinase pathway in bladder cancer. Cancer Res 69(11):4613-20, Tomlinson D C, Baxter E W, Loadman P M, et al. (2012) FGFR1-induced epithelial to mesenchymal transition through MAPK/PLC/COX-2-mediated mechanisms. PLoS ONE 7(6):e38972, di Martino E, Tomlinson D C, Knowles M A (2012) A Decade of FGF Receptor Research in Bladder Cancer: Past, Present, and Future Challenges. Adv Urol 2012:429213). Currently, there are no FDA-approved therapies targeting FGFR1 amplification; however, several tyrosine kinase inhibitors, including ponatinib (AP24534) and dovitinib (TKI-258) have shown efficacy in preclinical studies of tumors with FGFR1 fusions (Chase A, Bryant C, Score J, et al. (2012) Ponatinib as targeted therapy for FGFR1 fusions associated with the 8p11 myeloproliferative syndrome. Haematologica ePub August 2012, Wasag B, Lierman E, Meeus P, et al. (2011) The kinase inhibitor TKI258 is active against the novel CUX1-FGFR1 fusion detected in a patient with T-lymphoblastic leukemia/lymphoma and t(7; 8)(q22; p11). Haematologica 96(6):922-6). Preclinical studies also suggest that FGFR1 fusions may activate Src kinase; cells expressing FGFR1 fusions were sensitivity to treatment with dasatinib, a tyrosine kinase inhibitor that targets Src (Ren M, Qin H, Ren R, et al. (2011) Src activation plays an important key role in lymphomagenesis induced by FGFR1 fusion kinases. Cancer Res 71(23):7312-22). Inhibition of Hsp90 in cells bearing FGFR1 fusion is another area of study (Jin Y, Zhen Y, Haugsten E M, et al. (2011) The driver of malignancy in KG-la leukemic cells, FGFR1OP2-FGFR1, encodes an HSP90 addicted oncoprotein. Cell Signal 23(11):1758-66).

Accordingly, in another aspect, a method of inhibiting, reducing, or treating a hyperproliferative disorder, e.g., a neoplasm (including benign, pre-malignant or malignant (e.g., a cancer), in a subject is provided. The method includes administering to the subject a preselected therapeutic agent, e.g., an anti-cancer agent (e.g., an inhibitor), as a single agent, or in combination, in an amount sufficient to reduce, inhibit or treat the activity or expression of FGFR1-NTM (e.g., a FGFR1-NTM fusion described herein), thereby inhibiting, reducing, or treating the hyperproliferative disorder in the subject.

In one embodiment, the subject treated has a FGFR1-NTM fusion; e.g., the subject has a tumor or cancer harboring a FGFR1-NTM fusion. In other embodiments, the subject has been previously identified as having a FGFR1-NTM fusion. In yet other embodiments, the subject has been previously identified as being likely or unlikely to respond to treatment with a protein kinase inhibitor, e.g., a subject that has previously participated in a clinical trial. In other embodiments, the subject has been previously identified as being likely or unlikely to respond to treatment with a protein kinase inhibitor, based on the presence of the FGFR1-NTM fusion. In one embodiment, the subject is a mammal, e.g., a human. In one embodiment, the subject has, or at risk of having a cancer at any stage of disease. In other embodiments, the subject is a patient, e.g., a cancer patient.

In certain embodiments, the neoplasm or neoplastic cell is a benign, pre-malignant, malignant (cancer) or metastasis. In certain embodiments, the cancer is a solid tumor, a soft tissue tumor, or a metastatic lesion.

In one embodiment, the neoplasm or neoplastic cell is a benign, pre-malignant, malignant (cancer) or metastasis. In certain embodiments, the cancer is a solid tumor, a soft tissue tumor, or a metastatic lesion. In one embodiment, the cancer is an urothelial (transitional cell) carcinoma. In one embodiment, the cancer is chosen from a lung cancer, a pancreatic cancer, melanoma, a colorectal cancer, an esophageal-gastric cancer, a thyroid cancer, or an adenocarcinoma. In other embodiment, the lung cancer is chosen from one or more of the following: non-small cell lung cancer (NSCLC), small cell lung cancer (SCLC), squamous cell carcinoma (SCC), adenocarcinoma of the lung, bronchogenic carcinoma, or a combination thereof. In one embodiment, the lung cancer is NSCLC or SCC.

In one embodiment, the anti-cancer agent is a kinase inhibitor. For example, the kinase inhibitor is a multi-kinase inhibitor or a FGFR1-specific inhibitor. In one embodiment, the kinase inhibitor is a FGFR1 inhibitor including, but not limited to, ponatinib (AP24534); PD173074; AZD4547; BGJ398 (NVP-BGJ398); and TSU-68 (SU6668). In certain embodiments, the FGFR1 inhibitor is a FGFR1 inhibitor described herein.

TTC23-IGF1R Fusions

In one embodiment, a fusion includes an in-frame fusion of an exon of tetratricopeptide repeat domain 23 (TTC23), e.g., one more exons of TTC23 (e.g., one or more of exons 1-7 of TTC23) or a fragment thereof, and an exon of insulin-like growth factor 1 receptor (IGF1R), e.g., one or more exons of an IGF1R (e.g., one or more of exons 4-21 of IGF1R) or a fragment thereof. For example, the TTC23-IGF1R fusion can include an in-frame fusion within an intron of TTC23 (e.g., intron 7) or a fragment thereof, with an intron of IGF1R (e.g., intron 3) or a fragment thereof. In one embodiment, the fusion of the TTC23-IGF1R fusion comprises the nucleotide sequence of: chromosome 15 at one or more of nucleotide 99,434,631 (plus or minus 10, 20, 30, 50, 60, 70, 80, 100 or more nucleotides) and chromosome 15 at one or more of nucleotide 99,751,103 (plus or minus 10, 20, 30, 50, 60, 70, 80, 100 or more nucleotides). In one embodiment, the TTC23-IGF1R fusion is an inversion, e.g., an inversion of a portion of chromosome 15.

In certain embodiments, the TTC23-IGF1R fusion is in a 5'-TTC23 to 3'-IGF1R configuration (also referred to herein as "5'-TTC23-IGF1R-3')." The term "fusion" or "fusion molecule" can refer to a polypeptide or a nucleic acid fusion, depending on the context. It may include a full-length sequence of a fusion or a fragment thereof, e.g., a fusion junction (e.g., a fragment including a portion of TTC23 and a portion of IGF1R, e.g., a portion of the TTC23-IGF1R fusion described herein). In one embodiment, the TTC23-IGF1R fusion polypeptide includes a fragment of the amino acid sequence shown in FIG. 36 (SEQ ID NO:36) and a fragment of the amino acid sequence shown in FIG. 38 (SEQ ID NO:38), or an amino acid sequence substantially identical thereto. In another embodiment, the TTC23-IGF1R fusion nucleic acid includes a fragment of the nucleotide sequence shown in FIGS. 35A-35B (SEQ ID NO:35) and a fragment of the nucleotide sequence shown in FIGS. 37A-37E (SEQ ID NO:37), or a nucleotide sequence substantially identical thereto. In one embodiment, the TTC23-IGF1R fusion polypeptide comprises sufficient TTC23 and sufficient IGF1R sequence such that the 5' TTC23-3' IGF1R fusion has kinase activity, e.g., has elevated activity, e.g., IGF1R tyrosine kinase activity, as compared with wild type IGF1R, e.g., in a cell of a cancer referred to herein (e.g., ovarian epithelial carcinoma).

In certain embodiments, the TTC23-IGF1R fusion comprises one or more (or all of) exons 1-7 from TTC23 and one or more (or all of) exons 4-21 of IGF1R (e.g., one or more of the exons shown in FIGS. 35A-35B (SEQ ID NO:35) and FIGS. 37A-37E (SEQ ID NO:37). In another embodiment, the TTC23-IGF1R fusion comprises one or more (or all of) exons 1-7 of TTC23 and one or more (or all of) exons 4-21 of IGF1R. In certain embodiments, the TTC23-IGF1R fusion comprises at least 1, 2, 3, 4, 5, 6, 7 or more exons (or encoded exons) from TTC23 and at least 1, 2, 3, 4, 5, 6, 7, 8, 9, 10, 11, 12, 13, 14, 15, 16, 17 or more exons (or encoded exons) from IGF1R (e.g., from the TTC23 and IGF1R sequences shown in FIGS. 35A-35B and FIG. 36 (SEQ ID NO:35 and 36) and FIGS. 37A-37E and FIG. 38 (SEQ ID NOs:37 and 38)).

In certain embodiments, the TTC23-IGF1R fusion comprises exon 7 or a fragment thereof from TTC23, and exon 4 or a fragment thereof from IGF1R (e.g., as shown in FIGS. 35A-35B (SEQ ID NO:35) and FIGS. 37A-37E (SEQ ID NO:37)). In one embodiment, the TTC23-IGF1R fusion comprises at least 5, 10, 15, 20, 30, 40, 50 or more amino acids from exon 7 of TTC23 (e.g., from the amino acid sequence of TTC23 as shown in FIG. 36 (SEQ ID NO:36) (e.g., from the amino acid sequence of TTC23 preceding the fusion junction with IGF1R, and at least 5, 10, 15, 20, 30, 40, 50 or more amino acids from exon 4 of IGF1R (e.g., from the amino acid sequence of IGF1R as shown in FIG. 38 (SEQ ID NO:38)). In another embodiment, the TTC23-

IGF1R fusion comprises at least 6, 12, 15, 20, 25, 50, 75, 100 or more nucleotides from exon 7 of TTC23 (e.g., from the nucleotide sequence of TTC23 as shown in FIGS. 35A-35B (SEQ ID NO:35) (e.g., from the nucleotide sequence of TTC23 preceding the fusion junction with IGF1R); and at least 6, 12, 15, 20, 25, 50, 75, 100 or more nucleotides from exon 4 of IGF1R (e.g., from the nucleotide sequence of IGF1R as shown in FIGS. 37A-37E (SEQ ID NO:37).

TTC23-IGF1R Nucleic Acid Molecules

In one aspect, the invention features a nucleic acid molecule (e.g., an isolated or purified) nucleic acid molecule that includes a fragment of a TTC23 gene and a fragment of am IGF1R gene. In one embodiment, the nucleotide sequence encodes a TTC23-IGF1R fusion polypeptide that includes an IGF1R tyrosine kinase domain or a functional fragment thereof. In another embodiment, the nucleotide sequence encodes a fragment of the IGF1R polypeptide including the amino acid sequence of SEQ ID NO:38 or a fragment thereof, or a sequence substantially identical thereto. In other embodiments, the nucleic acid molecule includes a fragment of the TTC23 gene encoding the amino acid sequence of SEQ ID NO:36 or a fragment thereof, or a sequence substantially identical thereto. In yet other embodiments, the nucleic acid molecule includes a nucleotide sequence encoding the amino acid sequence shown in FIG. 36 (SEQ ID NO:36), or a fragment thereof, and the amino acid sequence shown in FIG. 38 (SEQ ID NO:38) or a fragment thereof, or a sequence substantially identical thereto.

In one embodiment, the nucleic acid molecule includes a fusion, e.g., an in-frame fusion, between an intron of TTC23 (e.g., intron 7, or a fragment thereof), and an intron of IGF1R (e.g., intron 3, or a fragment thereof). The TTC23-IGF1R fusion can comprise a fusion of the nucleotide sequence of: chromosome 15 at one or more of nucleotide 99,434,631 (plus or minus 10, 20, 30, 50, 60, 70, 80, 100 nucleotides) and chromosome 15 at one or more of nucleotide 99,751,103 (plus or minus 10, 20, 30, 50, 60, 70, 80, 100 nucleotides), or a fragment thereof. In one embodiment, the TTC23-IGF1R fusion comprises a fusion of the nucleotide sequence of: chromosome 15 at one or more of nucleotide 99,434,631 (plus or minus 10, 20, 30, 50, 60, 70, 80, 100 nucleotides) and chromosome 15 at one or more of nucleotide 99,751,103 (plus or minus 10, 20, 30, 50, 60, 70, 80, 100 nucleotides), or a fragment thereof.

In another embodiment, the TTC23-IGF1R fusion comprises a nucleotide sequence (e.g., a fragment of a nucleotide sequence) shown in FIGS. 35A-35B (SEQ ID NO:35) and a nucleotide sequence (e.g., a fragment of a nucleotide sequence) shown in FIGS. 37A-37E (SEQ ID NO:37), or a fragment of the fusion. In one embodiment, the TTC23-IGF1R fusion comprises a nucleotide sequence substantially identical to the nucleotide sequence (e.g., a fragment of a nucleotide sequence) shown in FIGS. 35A-35B (SEQ ID NO:35) and the nucleotide sequence (e.g., a fragment of a nucleotide sequence) shown FIGS. 37A-37E (SEQ ID NO:37), or a fragment of the fusion. In one embodiment, the TTC23-IGF1R fusion comprises a nucleotide sequence at least 70%, at least 75%, at least 80%, at least 85%, at least 90%, at least 95%, at least 99%, at least 99.5 or greater, identical to the nucleotide sequence (e.g., a fragment of a nucleotide sequence) shown in FIGS. 35A-35C (SEQ ID NO:35) and to the nucleotide sequence (e.g., a fragment of a nucleotide sequence) shown in FIGS. 37A-37C (SEQ ID NO:37). In one embodiment, the TTC23-IGF1R fusion comprises a nucleotide sequence containing at least 25, 50, 100, 150, 200, 500, 1000, 1500, 2000, 2500, 3000, or more nucleotides of the nucleotide sequence shown in FIGS. 35A-35B (SEQ ID NO:35) and a nucleotide sequence containing at least 25, 50, 100, 150, 200, 500, 1000, 1500, 2000, 2500, 3000, or more nucleotides of the nucleotide sequence shown in FIGS. 37A-37E (SEQ ID NO:37). In one embodiment, the TTC23-IGF1R fusion comprises a nucleotide sequence containing at least 25, 50, 100, 150, 200, 500, 1000, 1500, 2000, 2500, 3000, or more contiguous nucleotides of the nucleotide sequence shown in FIGS. 35A-35B (SEQ ID NO:35) and a nucleotide sequence containing at least 25, 50, 100, 150, 200, 500, 1000, 1500, 2000, 2500, 3000, or more nucleotides of the nucleotide sequence shown in FIGS. 37A-37E (SEQ ID NO:37).

In another embodiment, the nucleic acid molecule includes a fusion, e.g., an in-frame fusion, of at least exon 7 of TTC23 or a fragment thereof (e.g., one or more of exons 1-7 of TTC23 or a fragment thereof), and at least exon 4 or a fragment thereof (e.g., one or more of exons exons 4-21 of IGF1R or a fragment thereof). In yet other embodiments, the nucleic acid molecule includes a fragment the nucleotide sequence shown in FIGS. 35A-35B (SEQ ID NO:35) and a fragment of the nucleotide sequence shown in FIGS. 37A-37E (SEQ ID NO:37) or a fragment of the fusion, or a sequence substantially identical thereto.

In one embodiment, the nucleic acid molecule is complementary to at least a portion of a nucleotide sequence disclosed herein, e.g., is capable of hybridizing under a stringency condition described herein to SEQ ID NO:35 and/or SEQ ID NO:37, or a fragment thereof. In yet another embodiment, the nucleic acid molecule hybridizes to a nucleotide sequence that is complementary to at least a portion of a nucleotide sequence disclosed herein, e.g., is capable of hybridizing under a stringency condition to a nucleotide sequence complementary to SEQ ID NO:35 and/or SEQ ID NO:37, or a fragment thereof. The nucleotide sequence of a cDNA encoding an exemplary 5' TTC23-3' IGF1R fusion is shown in at least exon 7 (e.g., exons 1-7) of SEQ ID NO:35 and at least exon 4 (e.g., exons 4-21) of SEQ ID NO:37, and the predicted amino acid sequence is shown in the corresponding encoded exons of SEQ ID NO:36 and the corresponding encoded exons of SEQ ID NO:38, respectively.

In an embodiment the TTC23-IGF1R nucleic acid molecule comprises sufficient TTC23 and sufficient IGF1R sequence such that the encoded 5' TTC23-3' IGF1R fusion has kinase activity, e.g., has elevated activity, e.g., IGF1R kinase activity, as compared with wild type IGF1R, e.g., in a cell of a cancer referred to herein. In certain embodiments, the 5' TTC23-3' IGF1R fusion comprises exons 1-7 from TTC23 and exon exons 4-21 from IGF1R. In certain embodiments, the TTC23-IGF1R fusion comprises at least 1, 2, 3, 4, 5, 6, 7 or more exons from TTC23 and at least 1, 2, 3, 4, 5, 6, 7, 8, 9, 10, 11, 12, 13, 14, 15, 16, 17 or more, exons from IGF1R. In certain embodiments, the TTC23-IGF1R fusion comprises a fusion of exon 7 from TTC23 and exon 4 from IGF1R. In another embodiment, the TTC23-IGF1R fusion comprises at least 1, 2, 3, 4, 5, 6, 7 exons from TTC23; and at least 1, 2, 3, 4, 5, 6, 7, 8, 9, 10, 11, 12, 13, 14, 15, 16, 17 exons from IGF1R.

In one embodiment, the nucleic acid molecule includes a nucleotide sequence that has an in-frame fusion of intron 7 of TTC23 (e.g., NM_022905) with intron 3 of IGF1R (e.g., NM_000875). In another embodiment, the nucleic acid molecule includes a nucleotide sequence that includes a breakpoint. For example, the nucleic acid molecule includes a nucleotide sequence that includes the fusion junction between the TTC23 gene and the IGF1R gene, e.g., the breakpoint between intron 7 of TTC23 and intron 11 of IGF1R. In other embodiments, the nucleic acid molecules includes a nucleotide sequence of one or more of nucleotide 99,434,631 of chromosome 15 coupled to (e.g., directly or indirectly juxtaposed to) one or more of nucleotide 99,751, 103 of chromosome 15. In one embodiment, the nucleic acid molecule includes the nucleotide sequence of: chromosome 15 at one or more of nucleotide 99,434,631 plus or minus 10, 20, 30, 40 50, 60, 80, 100, 150 nucleotides and chromosome 15 at one or more of nucleotide 99,751,103 plus or minus 10, 20, 30, 40 50, 60, 80, 100, 150 nucleotides (corresponding to the breakpoint of a TTC23-IGF1R fusion), or a fragment thereof, or a sequence substantially identical thereto. In one embodiment, the nucleic acid molecule is complementary to at least a portion of a nucleotide sequence disclosed herein, e.g., is capable of hybridizing under a stringency condition described herein to SEQ ID NO:35 and/or SEQ ID NO:37 or a fragment thereof. In yet other embodiment, the nucleic acid molecule hybridizes to a nucleotide sequence that is complementary to at least a portion of a nucleotide sequence disclosed herein, e.g., is capable of hybridizing under a stringency condition described herein to a nucleotide sequence complementary to SEQ ID NO:35 or 37 or a fragment thereof.

In another embodiment, the TTC23-IGF1R fusion nucleic acid comprises at least 6, 12, 15, 20, 25, 50, 75, 100 or more nucleotides from exon 7 of TTC23 (e.g., from the nucleotide sequence of TTC23 preceding the fusion junction with IGF1R, e.g., of the TTC23 sequence shown in FIGS. 35A-35B (SEQ ID NO:35)), and at least 6, 12, 15, 20, 25, 50, 75, 100 or more nucleotides from exon 4 of IGF1R (e.g., from the nucleotide sequence of IGF1R following the fusion junction with TTC23, e.g., of the IGF1R sequence shown in FIGS. 37A-37E (SEQ ID NO:37)).

In other embodiments, the nucleic acid molecule includes a nucleotide sequence encoding a TTC23-IGF1R fusion polypeptide that includes a fragment of a TTC23 gene and a fragment of an IGF1R gene. In one embodiment, the nucleotide sequence encodes a TTC23-IGF1R fusion polypeptide that includes e.g., an IGF1R tyrosine kinase domain or a functional fragment thereof. In yet other embodiments, the nucleic acid molecule includes a nucleotide sequence encoding the amino acid sequence (e.g., a fragment of the amino acid sequence) shown in FIG. 36 (e.g., SEQ ID NO:36) and a nucleotide sequence encoding the amino acid sequence (e.g., a fragment of the amino acid sequence) shown in FIG. 38 (e.g., SEQ ID NO:38), or a fragment of the fusion, or a sequence substantially identical thereto. In one embodiment, the encoded TTC23-IGF1R fusion polypeptide includes an IGF1R tyrosine kinase domain or a functional fragment thereof.

In a related aspect, the invention features nucleic acid constructs that include the TTC23-IGF1R nucleic acid molecules described herein. In certain embodiments, the nucleic acid molecules are operatively linked to a native or a heterologous regulatory sequence. Also included are vectors and host cells that include the TTC23-IGF1R nucleic acid molecules described herein, e.g., vectors and host cells suitable for producing the nucleic acid molecules and polypeptides described herein.

In a related aspect, methods of producing the nucleic acid molecules and polypeptides described herein are also described.

In another aspect, the invention features nucleic acid molecules that reduce or inhibit the expression of a nucleic acid molecule that encodes a TTC23-IGF1R fusion described herein. Examples of such nucleic acid molecules include, for example, antisense molecules, ribozymes, RNAi, triple helix molecules that hybridize to a nucleic acid encoding TTC23-IGF1R, or a transcription regulatory region of TTC23-IGF1R, and blocks or reduces mRNA expression of TTC23-IGF1R.

Nucleic Acid Detection and Capturing Reagents

The invention also features a nucleic acid molecule, e.g., nucleic acid fragment, suitable as probe, primer, bait or library member that includes, flanks, hybridizes to, which are useful for identifying, or are otherwise based on, the TTC23-IGF1R fusions described herein. In certain embodiments, the probe, primer or bait molecule is an oligonucleotide that allows capture, detection or isolation of a TTC23-IGF1R fusion nucleic acid molecule described herein. The oligonucleotide can comprise a nucleotide sequence substantially complementary to a fragment of the TTC23-IGF1R fusion nucleic acid molecules described herein. The sequence identity between the nucleic acid fragment, e.g., the oligonucleotide, and the target TTC23-IGF1R sequence need not be exact, so long as the sequences are sufficiently complementary to allow the capture, detection or isolation of the target sequence. In one embodiment, the nucleic acid fragment is a probe or primer that includes an oligonucleotide between about 5 and 25, e.g., between 10 and 20, or 10 and 15 nucleotides in length. In other embodiments, the nucleic acid fragment is a bait that includes an oligonucleotide between about 100 to 300 nucleotides, 130 and 230 nucleotides, or 150 and 200 nucleotides, in length.

In one embodiment, the nucleic acid fragment can be used to identify or capture, e.g., by hybridization, a TTC23-IGF1R fusion. For example, the nucleic acid fragment can be a probe, a primer, or a bait, for use in identifying or capturing, e.g., by hybridization, a TTC23-IGF1R fusion described herein. In one embodiment, the nucleic acid fragment can be useful for identifying or capturing a TTC23-IGF1R breakpoint, e.g., the nucleotide sequence of: chromosome 15 at nucleotide 99,434,631 plus or minus 10, 20, 30, 40, 50, 60, 80, 100, 150 nucleotides and chromosome 15 at nucleotide 99,751,103 plus or minus 10, 20, 30, 40 50, 60, 80, 100, 150 nucleotides.

In one embodiment, the nucleic acid fragment hybridizes to a nucleotide sequence within a chromosomal rearrangement that creates an in-frame fusion of intron 7 of TTC23 with intron 11 of IGF1R. In one embodiment, the nucleic acid fragment hybridizes to a nucleotide sequence in the region In other embodiments, the nucleic acid molecules includes a nucleotide sequence in the region of nucleotides 99,434,631 of chromosome 15 coupled to (e.g., juxtaposed to) nucleotides in the region of nucleotides 99,751,103 of chromosome 15. In one embodiment, the nucleic acid fragment hybridizes to a nucleotide sequence that includes a breakpoint, e.g., the nucleotide sequence of: chromosome 15 at nucleotide 99,434,631 plus or minus 10, 20, 30, 40 50, 60, 80, 100, 150 or more nucleotides and chromosome 15 at nucleotide 99,751,103 plus or minus 10, 20, 30, 40 50, 60, 80, 100, 150 or more nucleotides. For example, the nucleic acid fragment can hybridize to a nucleotide sequence that includes the fusion junction between the TTC23 gene and the IGF1R gene, e.g., a nucleotide sequence that includes a portion of a nucleotide sequence within introns 5 of a TTC23 gene and 11 of an IGF1R gene.

In another embodiment, the nucleic acid fragment hybridizes to a nucleotide sequence that comprises at least 6, 12, 15, 20, 25, 50, 75, 100, 150 or more nucleotides from exon 7 of TTC23 (e.g., from the nucleotide sequence of TTC23 preceding the fusion junction with IGF1R, e.g., of the TTC23 sequence shown in FIGS. 35A-35B (SEQ ID NO:35)), and at least 6, 12, 15, 20, 25, 50, 75, 100, 150 or more nucleotides from exon 4 of IGF1R (e.g., from the nucleotide sequence of IGF1R following the fusion junction with TTC23, e.g., of the IGF1R sequence shown in FIGS. 37A-37E (SEQ ID NO:37)).

The probes or primers described herein can be used, for example, for FISH detection or PCR amplification. In one exemplary embodiment where detection is based on PCR, amplification of the TTC23-IGF1R fusion junction fusion junction can be performed using a primer or a primer pair, e.g., for amplifying a sequence flanking the fusion junctions described herein, e.g., the mutations or the junction of a chromosomal rearrangement described herein, e.g., TTC23-IGF1R.

In one embodiment, a pair of isolated oligonucleotide primers can amplify a region containing or adjacent to a position in the TTC23-IGF1R fusion. For example, forward primers can be designed to hybridize to a nucleotide sequence within TTC23 genomic or mRNA sequence (e.g., a nucleotide sequence within exon 7 of TTC23 of SEQ ID NO:35), and the reverse primers can be designed to hybridize to a nucleotide sequence of IGF1R (e.g., a nucleotide sequence within exon 4 of IGF1R, of SEQ ID NO:37).

In another embodiment, the nucleic acid fragments can be used to identify, e.g., by hybridization, a TTC23-IGF1R fusion. In one embodiment, the nucleic acid fragment hybridizes to a nucleotide sequence that includes a fusion junction between the TTC23 transcript and the IGF1R transcript.

In other embodiments, the nucleic acid fragment includes a bait that comprises a nucleotide sequence that hybridizes to a TTC23-IGF1R fusion nucleic acid molecule described herein, and thereby allows the capture or isolation said nucleic acid molecule. In one embodiment, a bait is suitable for solution phase hybridization. In other embodiments, a bait includes a binding entity, e.g., an affinity tag, that allows capture and separation, e.g., by binding to a binding entity, of a hybrid formed by a bait and a nucleic acid hybridized to the bait.

In other embodiments, the nucleic acid fragment includes a library member comprising a TTC23-IGF1R nucleic acid molecule described herein. In one embodiment, the library member includes a rearrangement that results in a TTC23-IGF1R fusion described herein.

The nucleic acid fragment can be detectably labeled with, e.g., a radiolabel, a fluorescent label, a bioluminescent label, a chemiluminescent label, an enzyme label, a binding pair label, or can include an affinity tag; a tag, or identifier (e.g., an adaptor, barcode or other sequence identifier).

TTC23-IGF1R Fusion Polypeptides

In another embodiment, the TTC23-IGF1R fusion comprises an amino acid sequence (e.g., a fragment of the amino acid sequence) shown in FIG. 36 (SEQ ID NO:36) and an amino acid sequence (e.g., a fragment of the amino acid sequence) shown in FIG. 38 (SEQ ID NO:38), or a fragment of the fusion. In one embodiment, the TTC23-IGF1R fusion comprises an amino acid sequence substantially identical to the amino acid sequence (e.g., a fragment of the amino acid sequence) shown in FIG. 36 (SEQ ID NO:36) and the amino acid sequence (e.g., a fragment of the amino acid sequence) shown in FIG. 38 (SEQ ID NO:38), or a fragment thereof. In one embodiment, the TTC23-IGF1R fusion comprises an amino acid sequence at least 70%, at least 75%, at least 80%, at least 85%, at least 90%, at least 95%, at least 99%, at least 99.5 or greater, identical to the amino acid sequence (e.g., a fragment of the amino acid sequence) shown in FIG. 36 (SEQ ID NO:36) and the amino acid sequence (e.g., a fragment of the amino acid sequence) shown in FIG. 38 (SEQ ID NO:38). In one embodiment, the TTC23-IGF1R fusion comprises a sequence containing at least 10, 20, 50, 100, 500, 600, 700, 800, 900, 1000, or more amino acids of the amino acid sequence shown in FIG. 36 (SEQ ID NO:36) and FIG. 38 (SEQ ID NO:38). In one embodiment, the TTC23-IGF1R fusion comprises an amino acid sequence containing at least 5, 10, 20, 50, 100, 500, 600, 700, 800, 900, 1000, or more contiguous amino acids of the amino acid sequence shown in FIG. 36 (SEQ ID NO:36) and at least 5, 10, 20, 50, 100, 500, 600, 700, 800, 900, 1000, or more contiguous amino acids of the amino acid sequence shown in FIG. 38 (SEQ ID NO:38). In one embodiment, the 5"TTC23-3' IGF1R fusion polypeptide includes an IGF1R receptor tyrosine kinase domain or a functional fragment thereof. In an embodiment, the 5'TTC23-3'IGF1R fusion polypeptide comprises sufficient IGF1R and sufficient TTC23 sequence such that it has kinase activity, e.g., has elevated activity, e.g., IGF1R kinase activity, as compared with wild type IGF1R, e.g., in a cell of a cancer referred to herein.

In another aspect, the invention features a TTC23-IGF1R fusion polypeptide (e.g., a purified TTC23-IGF1R fusion polypeptide), a biologically active or antigenic fragment thereof, as well as reagents (e.g., antibody molecules that bind to a TTC23-IGF1R fusion polypeptide), methods for modulating a TTC23-IGF1R polypeptide activity and detection of a TTC23-IGF1R polypeptide.

In one embodiment, the TTC23-IGF1R fusion polypeptide has at least one biological activity, e.g., an IGF1R kinase activity. In one embodiment, at least one biological activity of the TTC23-IGF1R fusion polypeptide is reduced or inhibited by an anti-cancer drug, e.g., a kinase inhibitor (e.g., a multikinase inhibitor or an IGF1R-specific inhibitor). In one embodiment, at least one biological activity of the TTC23-IGF1R fusion polypeptide is reduced or inhibited by an IGF1R kinase inhibitor chosen from e.g., NVP-ADW742; BMS-754807; or AG-1024.

In yet other embodiments, the TTC23-IGF1R fusion polypeptide is encoded by a nucleic acid molecule described herein. In one embodiment, the TTC23-IGF1R fusion polypeptide is encoded by an in-frame fusion of intron 7 of TTC23 with intron 11 of IGF1R (e.g., a sequence on chromosome 15). In another embodiment, the TTC23-IGF1R fusion polypeptide includes an amino acid sequence encoded by a nucleotide sequence comprising a fusion junction between the TTC23 transcript and the IGF1R transcript.

In certain embodiments, the TTC23-IGF1R fusion polypeptide comprises one or more of encoded exons 1-7 from TTC23 and one or more of encoded exon exons 4-21 of IGF1R. In certain embodiments, the TTC23-IGF1R fusion polypeptide comprises at least 1, 2, 3, 4, 5, 6, 7 or more encoded exons from TTC23 and at least 1, 2, 3, 4, 5, 6, 7, 8, 9, 10, 11, 12, 13, 14, 15, 16, 17 or more, encoded exons from IGF1R. In certain embodiments, the TTC23-IGF1R fusion polypeptide comprises a fusion of encoded exon 7 from TTC23 and encoded exon 4 from IGF1R (or a fragment thereof). In other embodiments, the fusion comprises least 1, 2, 3, 4, 5, 6, 7 encoded exons from TTC23; and at least 1, 2, 3, 4, 5, 6, 7, 8, 9, 10, 11, 12, 13, 14, 15, 16, 17 encoded exons from IGF1R. In certain embodiments, the TTC23-IGF1R fusion polypeptide comprises encoded exons 1-7 from TTC23 and exon exons 4-21 of IGF1R. In certain embodiments, the 5' TTC23-3' IGF1R fusion polypeptide comprises a fusion junction of the sequence of exon 7 from TTC23 and the sequence of exon 4 from IGF1R.

In certain embodiments, the TTC23-IGF1R fusion comprises the amino acid sequence corresponding to exon 7 or a fragment thereof from TTC23, and the amino acid sequence corresponding to exon 4 or a fragment thereof from IGF1R (e.g., as shown in FIG. 36 (SEQ ID NO:36) and FIG. 38 (SEQ ID NO:38)). In one embodiment, the TTC23-IGF1R fusion comprises at least 5, 10, 15, 20 or more amino acids from exon 7 of TTC23 (e.g., from the amino acid sequence of TTC23 preceding the fusion junction with IGF1R, e.g., of the TTC23 sequence shown in FIG. 36 (SEQ ID NO:36)), and at least 5, 10, 15, 20 or more amino acids from exon 4 of IGF1R (e.g., from the amino acid sequence of IGF1R following the fusion junction with TTC23, e.g., of the IGF1R sequence shown in FIG. 38 (SEQ ID NO:38)).

In one embodiment, the TTC23-IGF1R fusion polypeptide includes an IGF1R tyrosine kinase domain or a functional fragment thereof. In a related aspect, the invention features TTC23-IGF1R fusion polypeptide or fragments operatively linked to heterologous polypeptides to form fusion proteins.

In another embodiment, the TTC23-IGF1R fusion polypeptide or fragment is a peptide, e.g., an immunogenic peptide or protein, that contains a fusion junction described herein. Such immunogenic peptides or proteins can be used to raise antibodies specific to the fusion protein. In other embodiments, such immunogenic peptides or proteins can be used for vaccine preparation. The vaccine preparation can include other components, e.g., an adjuvant.

In another aspect, the invention features antibody molecules that bind to a TTC23-IGF1R fusion polypeptide or fragment described herein. In embodiments, the antibody can distinguish wild type IGF1R (or TTC23) from TTC23-IGF1R.

Detection Reagents and Detection of Mutations

In another aspect, the invention features a detection reagent, e.g., a purified or an isolated preparation thereof. Detection reagents can distinguish a nucleic acid, or protein sequence, having a breakpoint, e.g., a TTC23-IGF1R breakpoint; from a reference sequence. In one embodiment, the detection reagent detects (e.g., specifically detects) a TTC23-IGF1R fusion nucleic acid or a polypeptide (e.g., distinguishes a wild type IGF1R or another IGF1R fusion (or TTC23) from a TTC23-IGF1R nucleic acid (e.g., as described herein in FIGS. 35A-35B (SEQ ID NO:35) and FIGS. 37A-37E (SEQ ID NO:37); or a TTC23-IGF1R polypeptide (e.g., as described herein in FIG. 36 (SEQ ID NO:36) or FIG. 38 (SEQ ID NO:38).

Detection reagents, e.g., nucleic acid-based detection reagents, can be used to identify mutations in a target nucleic acid, e.g., DNA, e.g., genomic DNA or cDNA, or RNA, e.g., in a sample, e.g., a sample of nucleic acid derived from a neoplastic or tumor cell, e.g., a melanocytic neoplasm, melanoma or metastatic cell. Detection reagents, e.g., antibody-based detection reagents, can be used to identify mutations in a target protein, e.g., in a sample, e.g., a sample of protein derived from, or produced by, a neoplastic or tumor cell, e.g., a melanocytic neoplasm, melanoma or metastatic cell.

Method of Treatment

In a related aspect, a method of inhibiting, reducing, or treating a hyperproliferative disorder, e.g., a neoplasm (including benign, pre-malignant or malignant (e.g., a cancer), in a subject is provided. The method includes administering to the subject a preselected therapeutic agent, e.g., an anti-cancer agent (e.g., a kinase inhibitor), as a single agent, or in combination, in an amount sufficient to reduce, inhibit or treat the activity or expression of TTC23-IGF1R (e.g., a TTC23-IGF1R fusion described herein), thereby inhibiting, reducing, or treating the hyperproliferative disorder in the subject.

In one embodiment, the subject treated has a TTC23-IGF1R fusion; e.g., the subject has a tumor or cancer harboring a TTC23-IGF1R fusion. In other embodiments, the subject has been previously identified as having a TTC23-IGF1R fusion. In yet other embodiments, the subject has been previously identified as being likely or unlikely to respond to treatment with a protein kinase inhibitor, e.g., a subject that has previously participated in a clinical trial. In other embodiments, the subject has been previously identified as being likely or unlikely to respond to treatment with a protein kinase inhibitor, based on the presence of the TTC23-IGF1R fusion. In one embodiment, the subject is a mammal, e.g., a human. In one embodiment, the subject has, or at risk of having a cancer at any stage of disease. In other embodiments, the subject is a patient, e.g., a cancer patient.

In certain embodiments, the neoplasm or neoplastic cell is a benign, pre-malignant, malignant (cancer) or metastasis. In certain embodiments, the cancer is a solid tumor, a soft tissue tumor, or a metastatic lesion.

In one embodiment, the neoplasm or neoplastic cell is a benign, pre-malignant, malignant (cancer) or metastasis. In certain embodiments, the cancer is a solid tumor, a soft tissue tumor, or a metastatic lesion. In one embodiment, the cancer is an ovarian epithelial carcinoma. In one embodiment, the cancer is chosen from a lung cancer, a pancreatic cancer, melanoma, a colorectal cancer, an esophageal-gastric cancer, a thyroid cancer, or an adenocarcinoma. In one embodiment, the cancer is a lung adenocarcinoma. In other embodiment, the lung cancer is chosen from one or more of the following: non-small cell lung cancer (NSCLC), small cell lung cancer (SCLC), squamous cell carcinoma (SCC), adenocarcinoma of the lung, bronchogenic carcinoma, or a combination thereof. In one embodiment, the lung cancer is NSCLC or SCC.

In one embodiment, the anti-cancer agent is a kinase inhibitor. For example, the kinase inhibitor is a multi-kinase inhibitor or an IGF1R-specific inhibitor. In one embodiment, the kinase inhibitor is an IGF1R inhibitor including, but not limited to, NVP-ADW742; BMS-754807; or AG-1024. In certain embodiments, the IGFR1 inhibitor is an IGFR1 inhibitor described herein.

MCDF2-ALK Fusions

In one embodiment, a fusion includes an in-frame fusion of an exon of multiple coagulation factor deficiency 2 (MCDF2), e.g., one more exons of MCDF2 (e.g., one or more of exon 1 of MCDF2) or a fragment thereof, and an exon of anaplastic lymphoma receptor tyrosine kinase (ALK), e.g., one or more exons of an ALK (e.g., one or more of exons 20-29 of ALK) or a fragment thereof. For example, the MCDF2-ALK fusion can include an in-frame fusion within an intron of MCDF2 (e.g., intron 1) or a fragment thereof, with an intron of ALK (e.g., intron 19) or a fragment thereof. In one embodiment, the fusion of the MCDF2-ALK fusion comprises the nucleotide sequence of: chromosome 2 at one or more of nucleotide 47,148,685 (plus or minus 10, 20, 30, 50, 60, 70, 80, 100 or more nucleotides) and chromosome 2 at one or more of nucleotide 29,447,936 (plus or minus 10, 20, 30, 50, 60, 70, 80, 100 or more nucleotides).

In certain embodiments, the MCDF2-ALK fusion is in a 5'-MCDF2 to 3'-ALK configuration (also referred to herein as "5'-MCDF2-ALK-3'"). The term "fusion" or "fusion molecule" can refer to a polypeptide or a nucleic acid fusion, depending on the context. It may include a full-length sequence of a fusion or a fragment thereof, e.g., a fusion junction (e.g., a fragment including a portion of MCDF2 and a portion of ALK, e.g., a portion of the MCDF2-ALK fusion described herein). In one embodiment, the MCDF2-ALK fusion polypeptide includes a fragment of the amino acid sequence shown in FIG. 60 (SEQ ID NO:60) and a fragment of the amino acid sequence shown in FIG. 62A (SEQ ID NO:62), or an amino acid sequence substantially identical thereto. In another embodiment, the MCDF2-ALK fusion nucleic acid includes a fragment of the nucleotide sequence shown in FIGS. 59A-59B (SEQ ID NO:59) and a fragment of the nucleotide sequence shown in FIGS. 61A-61C (SEQ ID NO:61), or a nucleotide sequence substantially identical thereto. In one embodiment, the MCDF2-ALK fusion polypeptide comprises sufficient MCDF2 and sufficient ALK sequence such that the 5' MCDF2-3' ALK fusion has kinase activity, e.g., has elevated activity, e.g., ALK tyrosine kinase activity, as compared with wild type ALK, e.g., in a cell of a cancer referred to herein (e.g., lung adenocarcinoma).

In certain embodiments, the MCDF2-ALK fusion comprises one or more (or all of) exon 1 from MCDF2 and one or more (or all of) exons 20-29 of ALK (e.g., one or more of the exons shown in FIGS. 59A-59B (SEQ ID NO:59) and FIGS. 61A-61C (SEQ ID NO:61). In another embodiment, the MCDF2-ALK fusion comprises one or more (or all of) exon 1 of MCDF2 and one or more (or all of) exons 20-29 of ALK. In certain embodiments, the MCDF2-ALK fusion comprises at least 1 or more exons (or encoded exons) from MCDF2 and at least 1, 2, 3, 4, 5, 6, 7, 8, 9 or more exons (or encoded exons) from ALK (e.g., from the MCDF2 and ALK sequences shown in FIGS. 59A-59B and FIG. 60 (SEQ ID NO:59 and 60) and FIGS. 61A-61C and FIG. 62 (SEQ ID NOs:61 and 62)).

In certain embodiments, the MCDF2-ALK fusion comprises exon 1 or a fragment thereof from MCDF2, and exon 20 or a fragment thereof from ALK (e.g., as shown in FIGS. 59A-59B (SEQ ID NO:59) and FIGS. 61A-61C (SEQ ID NO:61)). In one embodiment, the MCDF2-ALK fusion comprises at least 5, 10, 15, 20, 30, 40, 50 or more amino acids from exon 1 of MCDF2 (e.g., from the amino acid sequence of MCDF2 as shown in FIG. 60 (SEQ ID NO:60) (e.g., from the amino acid sequence of MCDF2 preceding the fusion junction with ALK, and at least 5, 10, 15, 20, 30, 40, 50 or more amino acids from exon 20 of ALK (e.g., from the amino acid sequence of ALK as shown in FIG. 62 (SEQ ID NO:62)). In another embodiment, the MCDF2-ALK fusion comprises at least 6, 12, 15, 20, 25, 50, 75, 100 or more nucleotides from exon 1 of MCDF2 (e.g., from the nucleotide sequence of MCDF2 as shown in FIGS. 59A-59B (SEQ ID NO:59) (e.g., from the nucleotide sequence of MCDF2 preceding the fusion junction with ALK); and at least 6, 12, 15, 20, 25, 50, 75, 100 or more nucleotides from exon 20 of ALK (e.g., from the nucleotide sequence of ALK as shown in FIGS. 61A-61C (SEQ ID NO:61).

MCDF2-ALK Nucleic Acid Molecules

In one aspect, the invention features a nucleic acid molecule (e.g., an isolated or purified) nucleic acid molecule that includes a fragment of a MCDF2 gene and a fragment of am ALK gene. In one embodiment, the nucleotide sequence encodes a MCDF2-ALK fusion polypeptide that includes an ALK tyrosine kinase domain or a functional fragment thereof. In another embodiment, the nucleotide sequence encodes a fragment of the ALK polypeptide including the amino acid sequence of SEQ ID NO:62 or a fragment thereof, or a sequence substantially identical thereto. In other embodiments, the nucleic acid molecule includes a fragment of the MCDF2 gene encoding the amino acid sequence of SEQ ID NO:60 or a fragment thereof, or a sequence substantially identical thereto. In yet other embodiments, the nucleic acid molecule includes a nucleotide sequence encoding the amino acid sequence shown in FIG. 60 (SEQ ID NO:60), or a fragment thereof, and the amino acid sequence shown in FIG. 62 (SEQ ID NO:62) or a fragment thereof, or a sequence substantially identical thereto.

In one embodiment, the nucleic acid molecule includes a fusion, e.g., an in-frame fusion, between an intron of MCDF2 (e.g., intron 1, or a fragment thereof), and an intron of ALK (e.g., intron 19, or a fragment thereof). The MCDF2-ALK fusion can comprise a fusion of the nucleotide sequence of: chromosome 2 at one or more of nucleotide 47,148,685 (plus or minus 10, 20, 30, 50, 60, 70, 80, 100 nucleotides) and chromosome 2 at one or more of nucleotide 29,447,936 (plus or minus 10, 20, 30, 50, 60, 70, 80, 100 nucleotides), or a fragment thereof. In one embodiment, the MCDF2-ALK fusion comprises a fusion of the nucleotide sequence of: chromosome 2 at one or more of nucleotide 47,148,685 (plus or minus 10, 20, 30, 50, 60, 70, 80, 100 nucleotides) and chromosome 2 at one or more of nucleotide 29,447,936 (plus or minus 10, 20, 30, 50, 60, 70, 80, 100 nucleotides), or a fragment thereof.

In another embodiment, the MCDF2-ALK fusion comprises a nucleotide sequence (e.g., a fragment of a nucleotide sequence) shown in FIGS. 59A-59B (SEQ ID NO:59) and a nucleotide sequence (e.g., a fragment of a nucleotide sequence) shown in FIGS. 61A-61C (SEQ ID NO:61), or a fragment of the fusion. In one embodiment, the MCDF2-ALK fusion comprises a nucleotide sequence substantially identical to the nucleotide sequence (e.g., a fragment of a nucleotide sequence) shown in FIGS. 59A-59B (SEQ ID NO:59) and the nucleotide sequence (e.g., a fragment of a nucleotide sequence) shown FIGS. 61A-61C (SEQ ID NO:61), or a fragment of the fusion. In one embodiment, the MCDF2-ALK fusion comprises a nucleotide sequence at least 70%, at least 75%, at least 80%, at least 85%, at least 90%, at least 95%, at least 99%, at least 99.5 or greater, identical to the nucleotide sequence (e.g., a fragment of a nucleotide sequence) shown in FIGS. 59A-59B (SEQ ID NO:59) and to the nucleotide sequence (e.g., a fragment of a nucleotide sequence) shown in FIGS. 61A-61C (SEQ ID NO:61). In one embodiment, the MCDF2-ALK fusion comprises a nucleotide sequence containing at least 25, 50, 100, 150, 200, 500, 1000, 1500, 2000, 2500, 3000, or more nucleotides of the nucleotide sequence shown in FIGS. 59A-59C (SEQ ID NO:59) and a nucleotide sequence containing at least 25, 50, 100, 150, 200, 500, 1000, 1500, 2000, 2500, 3000, or more nucleotides of the nucleotide sequence shown in FIGS. 61A-61C (SEQ ID NO:61). In one embodiment, the MCDF2-ALK fusion comprises a nucleotide sequence containing at least 25, 50, 100, 150, 200, 500, 1000, 1500, 2000, 2500, 3000, or more contiguous nucleotides of the nucleotide sequence shown in FIGS. 59A-59B (SEQ ID NO:59) and a nucleotide sequence containing at least 25, 50, 100, 150, 200, 500, 1000, 1500, 2000, 2500, 3000, or more nucleotides of the nucleotide sequence shown in FIGS. 61A-61C (SEQ ID NO:61).

In another embodiment, the nucleic acid molecule includes a fusion, e.g., an in-frame fusion, of at least exon 1 of MCDF2 or a fragment thereof (e.g., one or more of exon 1 of MCDF2 or a fragment thereof), and at least exon 20 or a fragment thereof (e.g., one or more of exons exons 20-29 of ALK or a fragment thereof). In yet other embodiments, the nucleic acid molecule includes a fragment the nucleotide sequence shown in FIGS. 59A-59B (SEQ ID NO:59) and a fragment of the nucleotide sequence shown in FIGS. 61A-61C (SEQ ID NO:61) or a fragment of the fusion, or a sequence substantially identical thereto.

In one embodiment, the nucleic acid molecule is complementary to at least a portion of a nucleotide sequence disclosed herein, e.g., is capable of hybridizing under a stringency condition described herein to SEQ ID NO:59 and/or SEQ ID NO:61, or a fragment thereof. In yet another embodiment, the nucleic acid molecule hybridizes to a nucleotide sequence that is complementary to at least a portion of a nucleotide sequence disclosed herein, e.g., is capable of hybridizing under a stringency condition to a nucleotide sequence complementary to SEQ ID NO:59 and/or SEQ ID NO:61, or a fragment thereof. The nucleotide sequence of a cDNA encoding an exemplary 5' MCDF2-3' ALK fusion is shown in at least exon 1 (e.g., exon 1) of SEQ ID NO:59 and at least exon 20 (e.g., exons 20-29) of SEQ ID NO:61, and the predicted amino acid sequence is shown in the corresponding encoded exons of SEQ ID NO:60 and the corresponding encoded exons of SEQ ID NO:62, respectively.

In an embodiment the MCDF2-ALK nucleic acid molecule comprises sufficient MCDF2 and sufficient ALK sequence such that the encoded 5' MCDF2-3' ALK fusion has kinase activity, e.g., has elevated activity, e.g., ALK kinase activity, as compared with wild type ALK, e.g., in a cell of a cancer referred to herein. In certain embodiments, the 5' MCDF2-3' ALK fusion comprises exon 1 from MCDF2 and exon exons 20-29 from ALK. In certain embodiments, the MCDF2-ALK fusion comprises at least 1 or more exons from MCDF2 and at least 1, 2, 3, 4, 5, 6, 7, 8, 9 or more, exons from ALK. In certain embodiments, the MCDF2-ALK fusion comprises a fusion of exon 1 from MCDF2 and exon 20 from ALK. In another embodiment, the MCDF2-ALK fusion comprises at least 1 exons from MCDF2; and at least 1, 2, 3, 4, 5, 6, 7, 8, 9 exons from ALK.

In one embodiment, the nucleic acid molecule includes a nucleotide sequence that has an in-frame fusion of intron 1 of MCDF2 (e.g., NM_001171508) with intron 19 of ALK (e.g., NM_004304). In another embodiment, the nucleic acid molecule includes a nucleotide sequence that includes a breakpoint. For example, the nucleic acid molecule includes a nucleotide sequence that includes the fusion junction between the MCDF2 gene and the ALK gene, e.g., the breakpoint between intron 1 of MCDF2 and intron 19 of ALK. In other embodiments, the nucleic acid molecules includes a nucleotide sequence of one or more of nucleotide 47,148,685 of chromosome 2 coupled to (e.g., directly or indirectly juxtaposed to) one or more of nucleotide 29,447,936 of chromosome 2. In one embodiment, the nucleic acid molecule includes the nucleotide sequence of: chromosome 2 at one or more of nucleotide 47,148,685 plus or minus 10, 20, 30, 40 50, 60, 80, 100, 150 nucleotides and chromosome 2 at one or more of nucleotide 29,447,936 plus or minus 10, 20, 30, 40 50, 60, 80, 100, 150 nucleotides (corresponding to the breakpoint of a MCDF2-ALKfusion), or a fragment thereof, or a sequence substantially identical thereto. In one embodiment, the nucleic acid molecule is complementary to at least a portion of a nucleotide sequence disclosed herein, e.g., is capable of hybridizing under a stringency condition described herein to SEQ ID NO:59 and/or SEQ ID NO:61 or a fragment thereof. In yet other embodiment, the nucleic acid molecule hybridizes to a nucleotide sequence that is complementary to at least a portion of a nucleotide sequence disclosed herein, e.g., is capable of hybridizing under a stringency condition described herein to a nucleotide sequence complementary to SEQ ID NO:59 or 61 or a fragment thereof.

In another embodiment, the MCDF2-ALK fusion nucleic acid comprises at least 6, 12, 15, 20, 25, 50, 75, 100 or more nucleotides from exon 1 of MCDF2 (e.g., from the nucleotide sequence of MCDF2 preceding the fusion junction with ALK, e.g., of the MCDF2 sequence shown in FIGS. 59A-59B (SEQ ID NO:59)), and at least 6, 12, 15, 20, 25, 50, 75, 100 or more nucleotides from exon 20 of ALK (e.g., from the nucleotide sequence of ALK following the fusion junction with MCDF2, e.g., of the ALK sequence shown in FIGS. 61A-61C (SEQ ID NO:61)).

In other embodiments, the nucleic acid molecule includes a nucleotide sequence encoding a MCDF2-ALK fusion polypeptide that includes a fragment of a MCDF2 gene and a fragment of an ALK gene. In one embodiment, the nucleotide sequence encodes a MCDF2-ALK fusion polypeptide that includes e.g., an ALK tyrosine kinase domain or a functional fragment thereof. In yet other embodiments, the nucleic acid molecule includes a nucleotide sequence encoding the amino acid sequence (e.g., a fragment of the amino acid sequence) shown in FIG. 60 (e.g., SEQ ID NO:60) and a nucleotide sequence encoding the amino acid sequence (e.g., a fragment of the amino acid sequence) shown in FIG. 62 (e.g., SEQ ID NO:62), or a fragment of the fusion, or a sequence substantially identical thereto. In one embodiment, the encoded MCDF2-ALK fusion polypeptide includes an ALK tyrosine kinase domain or a functional fragment thereof.

In a related aspect, the invention features nucleic acid constructs that include the MCDF2-ALK nucleic acid molecules described herein. In certain embodiments, the nucleic acid molecules are operatively linked to a native or a heterologous regulatory sequence. Also included are vectors and host cells that include the MCDF2-ALK nucleic acid molecules described herein, e.g., vectors and host cells suitable for producing the nucleic acid molecules and polypeptides described herein.

In a related aspect, methods of producing the nucleic acid molecules and polypeptides described herein are also described.

In another aspect, the invention features nucleic acid molecules that reduce or inhibit the expression of a nucleic acid molecule that encodes a MCDF2-ALK fusion described herein. Examples of such nucleic acid molecules include, for example, antisense molecules, ribozymes, RNAi, triple helix molecules that hybridize to a nucleic acid encoding MCDF2-ALK, or a transcription regulatory region of MCDF2-ALK, and blocks or reduces mRNA expression of MCDF2-ALK.

Nucleic Acid Detection and Capturing Reagents

The invention also features a nucleic acid molecule, e.g., nucleic acid fragment, suitable as probe, primer, bait or library member that includes, flanks, hybridizes to, which are useful for identifying, or are otherwise based on, the MCDF2-ALKfusions described herein. In certain embodiments, the probe, primer or bait molecule is an oligonucleotide that allows capture, detection or isolation of a MCDF2-ALK fusion nucleic acid molecule described herein. The oligonucleotide can comprise a nucleotide sequence substantially complementary to a fragment of the MCDF2-ALK fusion nucleic acid molecules described herein. The sequence identity between the nucleic acid fragment, e.g., the oligonucleotide, and the target MCDF2-ALK sequence need not be exact, so long as the sequences are sufficiently complementary to allow the capture, detection or isolation of the target sequence. In one embodiment, the nucleic acid fragment is a probe or primer that includes an oligonucleotide between about 5 and 25, e.g., between 10 and 20, or 10 and 15 nucleotides in length. In other embodiments, the nucleic acid fragment is a bait that includes an oligonucleotide between about 100 to 300 nucleotides, 130 and 230 nucleotides, or 150 and 200 nucleotides, in length.

In one embodiment, the nucleic acid fragment can be used to identify or capture, e.g., by hybridization, a MCDF2-ALKfusion. For example, the nucleic acid fragment can be a probe, a primer, or a bait, for use in identifying or capturing, e.g., by hybridization, a MCDF2-ALK fusion described herein. In one embodiment, the nucleic acid fragment can be useful for identifying or capturing a MCDF2-ALK breakpoint, e.g., the nucleotide sequence of: chromosome 2 at nucleotide 47,148,685 plus or minus 10, 20, 30, 40 50, 60, 80, 100, 150 nucleotides and chromosome 2 at nucleotide 29,447,936 plus or minus 10, 20, 30, 40 50, 60, 80, 100, 150 nucleotides.

In one embodiment, the nucleic acid fragment hybridizes to a nucleotide sequence within a chromosomal rearrangement that creates an in-frame fusion of intron 1 of MCDF2 with intron 19 of ALK. In one embodiment, the nucleic acid fragment hybridizes to a nucleotide sequence in the region In other embodiments, the nucleic acid molecules includes a nucleotide sequence in the region of nucleotides 47,148, 685 of chromosome 2 coupled to (e.g., juxtaposed to) nucleotides in the region of nucleotides 29,447,936 of chromosome 2. In one embodiment, the nucleic acid fragment hybridizes to a nucleotide sequence that includes a breakpoint, e.g., the nucleotide sequence of: chromosome 2 at nucleotide 47,148,685 plus or minus 10, 20, 30, 40 50, 60, 80, 100, 150 or more nucleotides and chromosome 2 at nucleotide 29,447,936 plus or minus 10, 20, 30, 40 50, 60, 80, 100, 150 or more nucleotides. For example, the nucleic acid fragment can hybridize to a nucleotide sequence that includes the fusion junction between the MCDF2 gene and the ALK gene, e.g., a nucleotide sequence that includes a portion of a nucleotide sequence within intron 1 of a MCDF2 gene and 19 of an ALK gene.

In another embodiment, the nucleic acid fragment hybridizes to a nucleotide sequence that comprises at least 6, 12, 15, 20, 25, 50, 75, 100, 150 or more nucleotides from exon 1 of MCDF2 (e.g., from the nucleotide sequence of MCDF2 preceding the fusion junction with ALK, e.g., of the MCDF2 sequence shown in FIGS. 59A-59B (SEQ ID NO:59)), and at least 6, 12, 15, 20, 25, 50, 75, 100, 150 or more nucleotides from exon 20 of ALK (e.g., from the nucleotide sequence of ALK following the fusion junction with MCDF2, e.g., of the ALK sequence shown in FIGS. 61A-61C (SEQ ID NO:61)).

The probes or primers described herein can be used, for example, for FISH detection or PCR amplification. In one exemplary embodiment where detection is based on PCR, amplification of the MCDF2-ALK fusion junction fusion junction can be performed using a primer or a primer pair, e.g., for amplifying a sequence flanking the fusion junctions described herein, e.g., the mutations or the junction of a chromosomal rearrangement described herein, e.g., MCDF2-ALK.

In one embodiment, a pair of isolated oligonucleotide primers can amplify a region containing or adjacent to a position in the MCDF2-ALKfusion. For example, forward primers can be designed to hybridize to a nucleotide sequence within MCDF2 genomic or mRNA sequence (e.g., a nucleotide sequence within exon 1 of MCDF2 of SEQ ID NO:59), and the reverse primers can be designed to hybridize to a nucleotide sequence of ALK (e.g., a nucleotide sequence within exon 20 of ALK, of SEQ ID NO:61).

In another embodiment, the nucleic acid fragments can be used to identify, e.g., by hybridization, a MCDF2-ALKfusion. In one embodiment, the nucleic acid fragment hybridizes to a nucleotide sequence that includes a fusion junction between the MCDF2 transcript and the ALK transcript.

In other embodiments, the nucleic acid fragment includes a bait that comprises a nucleotide sequence that hybridizes to a MCDF2-ALK fusion nucleic acid molecule described herein, and thereby allows the capture or isolation said nucleic acid molecule. In one embodiment, a bait is suitable for solution phase hybridization. In other embodiments, a bait includes a binding entity, e.g., an affinity tag, that allows capture and separation, e.g., by binding to a binding entity, of a hybrid formed by a bait and a nucleic acid hybridized to the bait.

In other embodiments, the nucleic acid fragment includes a library member comprising a MCDF2-ALK nucleic acid molecule described herein. In one embodiment, the library member includes a rearrangement that results in a MCDF2-ALK fusion described herein.

The nucleic acid fragment can be detectably labeled with, e.g., a radiolabel, a fluorescent label, a bioluminescent label, a chemiluminescent label, an enzyme label, a binding pair label, or can include an affinity tag; a tag, or identifier (e.g., an adaptor, barcode or other sequence identifier).

MCDF2-ALK Fusion Polypeptides

In another embodiment, the MCDF2-ALK fusion comprises an amino acid sequence (e.g., a fragment of the amino acid sequence) shown in FIG. 60 (SEQ ID NO:60) and an amino acid sequence (e.g., a fragment of the amino acid sequence) shown in FIG. 62 (SEQ ID NO:62), or a fragment of the fusion. In one embodiment, the MCDF2-ALK fusion comprises an amino acid sequence substantially identical to the amino acid sequence (e.g., a fragment of the amino acid sequence) shown in FIG. 60 (SEQ ID NO:60) and the amino acid sequence (e.g., a fragment of the amino acid sequence) shown in FIG. 62 (SEQ ID NO:62), or a fragment thereof. In one embodiment, the MCDF2-ALK fusion comprises an amino acid sequence at least 70%, at least 75%, at least 80%, at least 85%, at least 90%, at least 95%, at least 99%, at least 99.5 or greater, identical to the amino acid sequence (e.g., a fragment of the amino acid sequence) shown in FIG. 60 (SEQ ID NO:60) and the amino acid sequence (e.g., a fragment of the amino acid sequence) shown in FIG. 62 (SEQ ID NO:62). In one embodiment, the MCDF2-ALK fusion comprises a sequence containing at least 10, 20, 50, 100, 500, 600, 700, 800, 900, 1000, or more amino acids of the amino acid sequence shown in FIG. 60 (SEQ ID NO:60) and FIG. 62 (SEQ ID NO:62). In one embodiment, the MCDF2-ALK fusion comprises an amino acid sequence containing at least 5, 10, 20, 50, 100, 500, 600, 700, 800, 900, 1000, or more contiguous amino acids of the amino acid sequence shown in FIG. 60 (SEQ ID NO:60) and at least 5, 10, 20, 50, 100, 500, 600, 700, 800, 900, 1000, or more contiguous amino acids of the amino acid sequence shown in FIG. 62 (SEQ ID NO:62). In one embodiment, the 5' MCDF2-3' ALK fusion polypeptide includes an ALK receptor tyrosine kinase domain or a functional fragment thereof. In an embodiment, the 5'MCDF2-3'ALK fusion polypeptide comprises sufficient ALK and sufficient MCDF2 sequence such that it has kinase activity, e.g., has elevated activity, e.g., ALK kinase activity, as compared with wild type ALK, e.g., in a cell of a cancer referred to herein.

In another aspect, the invention features a MCDF2-ALK fusion polypeptide (e.g., a purified MCDF2-ALK fusion polypeptide), a biologically active or antigenic fragment thereof, as well as reagents (e.g., antibody molecules that bind to a MCDF2-ALK fusion polypeptide), methods for modulating a MCDF2-ALK polypeptide activity and detection of a MCDF2-ALK polypeptide.

In one embodiment, the MCDF2-ALK fusion polypeptide has at least one biological activity, e.g., an ALK kinase activity. In one embodiment, at least one biological activity of the MCDF2-ALK fusion polypeptide is reduced or inhibited by an anti-cancer drug, e.g., a kinase inhibitor (e.g., a multikinase inhibitor or an ALK-specific inhibitor). In one embodiment, at least one biological activity of the MCDF2-ALK fusion polypeptide is reduced or inhibited by an ALK kinase inhibitor chosen from e.g., TAE-684 (also referred to herein as "NVP-TAE694"), PF02341066 (also referred to herein as "crizotinib" or "1066"), AF-802, LDK-378, ASP-3026, CEP-37440, CEP-28122, CEP-108050 and AP26113. Additional examples of ALK kinase inhibitors are described in examples 3-39 of WO 2005016894 by Garcia-Echeverria C, et al.

In yet other embodiments, the MCDF2-ALK fusion polypeptide is encoded by a nucleic acid molecule described herein. In one embodiment, the MCDF2-ALK fusion polypeptide is encoded by an in-frame fusion of intron 1 of MCDF2 with intron 19 of ALK (e.g., a sequence on chromosome 2). In another embodiment, the MCDF2-ALK fusion polypeptide includes an amino acid sequence encoded by a nucleotide sequence comprising a fusion junction between the MCDF2 transcript and the ALK transcript.

In certain embodiments, the MCDF2-ALK fusion polypeptide comprises one or more of encoded exon 1 from MCDF2 and one or more of encoded exon exons 20-29 of ALK. In certain embodiments, the MCDF2-ALK fusion polypeptide comprises at least 1 or more encoded exons from MCDF2 and at least 1, 2, 3, 4, 5, 6, 7, 8, 9 or more, encoded exons from ALK. In certain embodiments, the MCDF2-ALK fusion polypeptide comprises a fusion of encoded exon 1 from MCDF2 and encoded exon 20 from ALK (or a fragment thereof). In other embodiments, the fusion comprises least 1 encoded exon from MCDF2; and at least 1, 2, 3, 4, 5, 6, 7, 8, 9 encoded exons from ALK. In certain embodiments, the MCDF2-ALK fusion polypeptide comprises encoded exon 1 from MCDF2 and exon exons 20-29 of ALK. In certain embodiments, the 5' MCDF2-3' ALK fusion polypeptide comprises a fusion junction of the sequence of exon 1 from MCDF2 and the sequence of exon 20 from ALK.

In certain embodiments, the MCDF2-ALK fusion comprises the amino acid sequence corresponding to exon 1 or a fragment thereof from MCDF2, and the amino acid sequence corresponding to exon 20 or a fragment thereof from ALK (e.g., as shown in FIG. 60 (SEQ ID NO:60) and FIG. 62 (SEQ ID NO:62)). In one embodiment, the MCDF2-ALK fusion comprises at least 5, 10, 15, 20 or more amino acids from exon 1 of MCDF2 (e.g., from the amino acid sequence of MCDF2 preceding the fusion junction with ALK, e.g., of the MCDF2 sequence shown in FIG. 60 (SEQ ID NO:60)), and at least 5, 10, 15, 20 or more amino acids from exon 20 of ALK (e.g., from the amino acid sequence of ALK following the fusion junction with MCDF2, e.g., of the ALK sequence shown in FIG. 62 (SEQ ID NO:62)).

In one embodiment, the MCDF2-ALK fusion polypeptide includes an ALK tyrosine kinase domain or a functional fragment thereof. In a related aspect, the invention features a MCDF2-ALK fusion polypeptide or fragments operatively linked to heterologous polypeptides to form fusion proteins.

In another embodiment, the MCDF2-ALK fusion polypeptide or fragment is a peptide, e.g., an immunogenic peptide or protein, that contains a fusion junction described herein. Such immunogenic peptides or proteins can be used to raise antibodies specific to the fusion protein. In other embodiments, such immunogenic peptides or proteins can be used for vaccine preparation. The vaccine preparation can include other components, e.g., an adjuvant.

In another aspect, the invention features antibody molecules that bind to a MCDF2-ALK fusion polypeptide or fragment described herein. In embodiments, the antibody can distinguish wild type ALK (or MCDF2) from MCDF2-ALK.

Detection Reagents and Detection of Mutations

In another aspect, the invention features a detection reagent, e.g., a purified or an isolated preparation thereof. Detection reagents can distinguish a nucleic acid, or protein sequence, having a breakpoint, e.g., a MCDF2-ALK breakpoint; from a reference sequence. In one embodiment, the detection reagent detects (e.g., specifically detects) a MCDF2-ALK fusion nucleic acid or a polypeptide (e.g., distinguishes a wild type ALK or another ALK fusion (or MCDF2) from a MCDF2-ALK nucleic acid (e.g., as described herein in FIGS. 59A-59B (SEQ ID NO:59) and FIGS. 61A-61C (SEQ ID NO:61); or a MCDF2-ALK polypeptide (e.g., as described herein in FIG. 60 (SEQ ID NO:60) and FIG. 62 (SEQ ID NO:62).

Detection reagents, e.g., nucleic acid-based detection reagents, can be used to identify mutations in a target nucleic acid, e.g., DNA, e.g., genomic DNA or cDNA, or RNA, e.g., in a sample, e.g., a sample of nucleic acid derived from a neoplastic or tumor cell, e.g., a melanocytic neoplasm, melanoma or metastatic cell. Detection reagents, e.g., antibody-based detection reagents, can be used to identify mutations in a target protein, e.g., in a sample, e.g., a sample of protein derived from, or produced by, a neoplastic or tumor cell, e.g., a melanocytic neoplasm, melanoma or metastatic cell.

Method of Treatment

In a related aspect, a method of inhibiting, reducing, or treating a hyperproliferative disorder, e.g., a neoplasm (including benign, pre-malignant or malignant (e.g., a cancer), in a subject is provided. The method includes administering to the subject a preselected therapeutic agent, e.g., an anti-cancer agent (e.g., a kinase inhibitor), as a single agent, or in combination, in an amount sufficient to reduce, inhibit or treat the activity or expression of MCDF2-ALK (e.g., a MCDF2-ALK fusion described herein), thereby inhibiting, reducing, or treating the hyperproliferative disorder in the subject.

In one embodiment, the subject treated has a MCDF2-ALKfusion; e.g., the subject has a tumor or cancer harboring a MCDF2-ALKfusion. In other embodiments, the subject has been previously identified as having a MCDF2-ALK-fusion. In yet other embodiments, the subject has been previously identified as being likely or unlikely to respond to treatment with a protein kinase inhibitor, e.g., a subject that has previously participated in a clinical trial. In other embodiments, the subject has been previously identified as being likely or unlikely to respond to treatment with a protein kinase inhibitor, based on the presence of the MCDF2-ALKfusion. In one embodiment, the subject is a mammal, e.g., a human. In one embodiment, the subject has, or at risk of having a cancer at any stage of disease. In other embodiments, the subject is a patient, e.g., a cancer patient.

In certain embodiments, the neoplasm or neoplastic cell is a benign, pre-malignant, malignant (cancer) or metastasis. In certain embodiments, the cancer is a solid tumor, a soft tissue tumor, or a metastatic lesion.

In one embodiment, the neoplasm or neoplastic cell is a benign, pre-malignant, malignant (cancer) or metastasis. In certain embodiments, the cancer is a solid tumor, a soft tissue tumor, or a metastatic lesion. In an embodiment, the cancer is a lung adenocarcinoma. In one embodiment, the cancer is chosen from a lung cancer, a pancreatic cancer, melanoma, a colorectal cancer, an esophageal-gastric cancer, a thyroid cancer, or an adenocarcinoma. In one embodiment, the cancer is a lung adenocarcinoma. In other embodiment, the lung cancer is chosen from one or more of the following: non-small cell lung cancer (NSCLC), small cell lung cancer (SCLC), squamous cell carcinoma (SCC), adenocarcinoma of the lung, bronchogenic carcinoma, or a combination thereof. In one embodiment, the lung cancer is NSCLC or SCC.

In one embodiment, the anti-cancer agent is a kinase inhibitor. For example, the kinase inhibitor is a multi-kinase inhibitor or an ALK-specific inhibitor. In one embodiment, the kinase inhibitor is an ALK inhibitor including, but not limited to, TAE-684 (also referred to herein as "NVP-TAE694"), PF02341066 (also referred to herein as "crizotinib" or "1066"), AF-802, LDK-378, ASP-3026, CEP-37440, CEP-28122, CEP-108050 and AP26113. Additional examples of ALK kinase inhibitors are described in examples 3-39 of WO 2005016894 by Garcia-Echeverria C, et al. In certain embodiments, the ALK inhibitor is an ALK inhibitor described herein.

RANBP17-FGFR3 Fusions

In one embodiment, a fusion includes an in-frame fusion of an exon of RAN binding protein 17 (RANBP17), e.g., one more exons of RANBP17 (e.g., one or more of exons 1-28 of RANBP17) or a fragment thereof, and an exon of fibroblast growth factor receptor 3 (FGFR3), e.g., one or more exons of an FGFR3 (e.g., one or more of exons 14-18 of FGFR3) or a fragment thereof. For example, the RANBP17-FGFR3 fusion can include an in-frame fusion within an intron of RANBP17 (e.g., intron 28) or a fragment thereof, with an intron of FGFR3 (e.g., intron 13) or a fragment thereof. In one embodiment, the fusion of the RANBP17-FGFR3 fusion comprises the nucleotide sequence of: chromosome 5 at one or more of nucleotide 170,726,887 (plus or minus 10, 20, 30, 50, 60, 70, 80, 100 or more nucleotides) and chromosome 4 at one or more of nucleotide 1,807,497 (plus or minus 10, 20, 30, 50, 60, 70, 80, 100 or more nucleotides).

In certain embodiments, the RANBP17-FGFR3 fusion is in a 5'-RANBP17 to 3'-FGFR3 configuration (also referred to herein as "5'-RANBP17-FGFR3-3')." The term "fusion" or "fusion molecule" can refer to a polypeptide or a nucleic acid fusion, depending on the context. It may include a full-length sequence of a fusion or a fragment thereof, e.g., a fusion junction (e.g., a fragment including a portion of RANBP17 and a portion of FGFR3, e.g., a portion of the RANBP17-FGFR3 fusion described herein). In one embodiment, the RANBP17-FGFR3 fusion polypeptide includes a fragment of the amino acid sequence shown in FIG. 64 (SEQ ID NO:64) and a fragment of the amino acid sequence shown in FIG. 4 (SEQ ID NO:4), or an amino acid sequence substantially identical thereto. In another embodiment, the RANBP17-FGFR3 fusion nucleic acid includes a fragment of the nucleotide sequence shown in FIGS. 63A-63B (SEQ ID NO:63) and a fragment of the nucleotide sequence shown in FIGS. 3A-3B (SEQ ID NO:3), or a nucleotide sequence substantially identical thereto. In one embodiment, the RANBP17-FGFR3 fusion polypeptide comprises sufficient RANBP17 and sufficient FGFR3 sequence such that the 5' RANBP17-3' FGFR3 fusion has kinase activity, e.g., has elevated activity, e.g., FGFR3 tyrosine kinase activity, as compared with wild type FGFR3, e.g., in a cell of a cancer referred to herein (e.g., breast carcinoma).

In certain embodiments, the RANBP17-FGFR3 fusion comprises one or more (or all of) exons 1-28 from RANBP17 and one or more (or all of) exons 14-18 of FGFR3 (e.g., one or more of the exons shown in FIGS. 63A-63B (SEQ ID NO:63) and FIGS. 3A-3C (SEQ ID NO:3). In another embodiment, the RANBP17-FGFR3 fusion comprises one or more (or all of) exons 1-28 of RANBP17 and one or more (or all of) exons 14-18 of FGFR3. In certain embodiments, the RANBP17-FGFR3 fusion comprises at least 1, 2, 3, 4, 5, 6, 7, 8, 9, 10, 11, 12, 13, 14, 15, 16, 17, 18, 19, 20, 21, 22, 23, 24, 25, 26, 27, 28 or more exons (or encoded exons) from RANBP17 and at least 1, 2, 3, 4 or more exons (or encoded exons) from FGFR3 (e.g., from the RANBP17 and FGFR3 sequences shown in FIGS. 63A-63B and FIG. 64 (SEQ ID NO:63 and 64) and FIGS. 3A-3B and FIG. 4 (SEQ ID NOs:3 and 4)).

In certain embodiments, the RANBP17-FGFR3 fusion comprises exons 1-28 or a fragment thereof from RANBP17, and exon 14 or a fragment thereof from FGFR3 (e.g., as shown in FIGS. 63A-63B (SEQ ID NO:63) and FIGS. 3A-3B (SEQ ID NO:3)). In one embodiment, the RANBP17-FGFR3 fusion comprises at least 5, 10, 15, 20, 30, 40, 50 or more amino acids from exons 1-28 of RANBP17 (e.g., from the amino acid sequence of RANBP17 as shown in FIG. 64 (SEQ ID NO:64) (e.g., from the amino acid sequence of RANBP17 preceding the fusion junction with FGFR3, and at least 5, 10, 15, 20, 30, 40, 50 or more amino acids from exon 14 of FGFR3 (e.g., from the amino acid sequence of FGFR3 as shown in FIG. 4 (SEQ ID NO:4)). In another embodiment, the RANBP17-FGFR3 fusion comprises at least 6, 12, 15, 20, 25, 50, 75, 100 or more nucleotides from exons 1-28 of RANBP17 (e.g., from the nucleotide sequence of RANBP17 as shown in FIGS. 63A-63B (SEQ ID NO:63) (e.g., from the nucleotide sequence of RANBP17 preceding the fusion junction with FGFR3); and at least 6, 12, 15, 20, 25, 50, 75, 100 or more nucleotides from exon 14 of FGFR3 (e.g., from the nucleotide sequence of FGFR3 as shown in FIGS. 3A-3B (SEQ ID NO:3).

RANBP17-FGFR3 Nucleic Acid Molecules

In one aspect, the invention features a nucleic acid molecule (e.g., an isolated or purified) nucleic acid molecule that includes a fragment of a RANBP17 gene and a fragment of am FGFR3 gene. In one embodiment, the nucleotide sequence encodes a RANBP17-FGFR3 fusion polypeptide that includes an FGFR3 tyrosine kinase domain or a functional fragment thereof. In another embodiment, the nucleotide sequence encodes a fragment of the FGFR3 polypeptide including the amino acid sequence of SEQ ID NO:4 or a fragment thereof, or a sequence substantially identical thereto. In other embodiments, the nucleic acid molecule includes a fragment of the RANBP17 gene encoding the amino acid sequence of SEQ ID NO:64 or a fragment thereof, or a sequence substantially identical thereto. In yet other embodiments, the nucleic acid molecule includes a nucleotide sequence encoding the amino acid sequence shown in FIG. 64 (SEQ ID NO:64), or a fragment thereof, and the amino acid sequence shown in FIG. 4 (SEQ ID NO:4) or a fragment thereof, or a sequence substantially identical thereto.

In one embodiment, the nucleic acid molecule includes a fusion, e.g., an in-frame fusion, between an intron of RANBP17 (e.g., intron 28, or a fragment thereof), and an intron of FGFR3 (e.g., intron 13, or a fragment thereof). The RANBP17-FGFR3 fusion can comprise a fusion of the nucleotide sequence of: chromosome 5 at one or more of nucleotide 170,726,887 (plus or minus 10, 20, 30, 50, 60, 70, 80, 100 nucleotides) and chromosome 4 at one or more of nucleotide 1,807,497 (plus or minus 10, 20, 30, 50, 60, 70, 80, 100 nucleotides), or a fragment thereof. In one embodiment, the RANBP17-FGFR3 fusion comprises a fusion of the nucleotide sequence of: chromosome 5 at one or more of nucleotide 170,726,887 (plus or minus 10, 20, 30, 50, 60, 70, 80, 100 nucleotides) and chromosome 4 at one or more of nucleotide 1,807,497 (plus or minus 10, 20, 30, 50, 60, 70, 80, 100 nucleotides), or a fragment thereof.

In another embodiment, the RANBP17-FGFR3 fusion comprises a nucleotide sequence (e.g., a fragment of a nucleotide sequence) shown in FIGS. 63A-63B (SEQ ID NO:63) and a nucleotide sequence (e.g., a fragment of a nucleotide sequence) shown in FIGS. 3A-3B (SEQ ID NO:3), or a fragment of the fusion. In one embodiment, the RANBP17-FGFR3 fusion comprises a nucleotide sequence substantially identical to the nucleotide sequence (e.g., a fragment of a nucleotide sequence) shown in FIGS. 63A-63B (SEQ ID NO:63) and the nucleotide sequence (e.g., a fragment of a nucleotide sequence) shown FIGS. 3A-3B (SEQ ID NO:3), or a fragment of the fusion. In one embodiment, the RANBPI7-FGFR3 fusion comprises a nucleotide sequence at least 70%, at least 75%, at least 80%, at least 85%, at least 90%, at least 95%, at least 99%, at least 99.5 or greater, identical to the nucleotide sequence (e.g., a fragment of a nucleotide sequence) shown in FIGS. 63A-63B (SEQ ID NO:63) and to the nucleotide sequence (e.g., a fragment of a nucleotide sequence) shown in FIGS. 3A-3B (SEQ ID NO:3). In one embodiment, the RANBP17-FGFR3 fusion comprises a nucleotide sequence containing at least 25, 50, 100, 150, 200, 500, 1000, 1500, 2000, 2500, 3000, or more nucleotides of the nucleotide sequence shown in FIGS. 63A-63B (SEQ ID NO:63) and a nucleotide sequence containing at least 25, 50, 100, 150, 200, 500, 1000, 1500, 2000, 2500, 3000, or more nucleotides of the nucleotide sequence shown in FIGS. 3A-3B (SEQ ID NO:3). In one embodiment, the RANBP17-FGFR3 fusion comprises a nucleotide sequence containing at least 25, 50, 100, 150, 200, 500, 1000, 1500, 2000, 2500, 3000, or more contiguous nucleotides of the nucleotide sequence shown in FIGS. 63A-63B (SEQ ID NO:63) and a nucleotide sequence containing at least 25, 50, 100, 150, 200, 500, 1000, 1500, 2000, 2500, 3000, or more nucleotides of the nucleotide sequence shown in FIGS. 3A-3B (SEQ ID NO:3).

In another embodiment, the nucleic acid molecule includes a fusion, e.g., an in-frame fusion, of at least exons 1-28 of RANBP17 or a fragment thereof (e.g., one or more of exons 1-28 of RANBP17 or a fragment thereof), and at least exon 14 or a fragment thereof (e.g., one or more of exons exons 14-18 of FGFR3 or a fragment thereof). In yet other embodiments, the nucleic acid molecule includes a fragment the nucleotide sequence shown in FIGS. 63A-63B (SEQ ID NO:63) and a fragment of the nucleotide sequence shown in FIGS. 3A-3B (SEQ ID NO:3) or a fragment of the fusion, or a sequence substantially identical thereto.

In one embodiment, the nucleic acid molecule is complementary to at least a portion of a nucleotide sequence disclosed herein, e.g., is capable of hybridizing under a stringency condition described herein to SEQ ID NO:63 and/or SEQ ID NO:3, or a fragment thereof. In yet another embodiment, the nucleic acid molecule hybridizes to a nucleotide sequence that is complementary to at least a portion of a nucleotide sequence disclosed herein, e.g., is capable of hybridizing under a stringency condition to a nucleotide sequence complementary to SEQ ID NO:63 and/or SEQ ID NO:3, or a fragment thereof. The nucleotide sequence of a cDNA encoding an exemplary 5' RANBP17-3' FGFR3 fusion is shown in at least exons 1-28 (e.g., exons 1-28) of SEQ ID NO:63 and at least exon 14 (e.g., exons 14-18) of SEQ ID NO:3, and the predicted amino acid sequence is shown in the corresponding encoded exons of SEQ ID NO:64 and the corresponding encoded exons of SEQ ID NO:4, respectively.

In an embodiment the RANBP17-FGFR3 nucleic acid molecule comprises sufficient RANBP17 and sufficient FGFR3 sequence such that the encoded 5' RANBP17-3' FGFR3 fusion has kinase activity, e.g., has elevated activity, e.g., FGFR3 kinase activity, as compared with wild type FGFR3, e.g., in a cell of a cancer referred to herein. In certain embodiments, the 5' RANBP17-3' FGFR3 fusion comprises exons 1-28 from RANBP17 and exon exons 14-18 from FGFR3. In certain embodiments, the RANBP17-FGFR3 fusion comprises at least 1, 2, 3, 4, 5, 6, 7, 8, 9, 10, 11, 12, 13, 14, 15,16, 17, 18, 19, 20, 21, 22, 23, 24, 25, 26, 27, 28 or more exons from RANBP17 and at least 1, 2, 3, 4 or more, exons from FGFR3. In certain embodiments, the RANBP17-FGFR3 fusion comprises a fusion of exons 1-28 from RANBP17 and exon 14 from FGFR3. In another embodiment, the RANBP17-FGFR3 fusion comprises at least 1, 2, 3, 4, 5, 6, 7, 8, 9, 10, 11, 12, 13, 14, 15,16, 17, 18, 19, 20, 21, 22, 23, 24, 25, 26, 27, 28 exons from RANBP17; and at least 1, 2, 3, 4 exons from FGFR3.

In one embodiment, the nucleic acid molecule includes a nucleotide sequence that has an in-frame fusion of intron 28 of RANBP17 (e.g., NM_022897) with intron 13 of FGFR3 (e.g., NM_000142). In another embodiment, the nucleic acid molecule includes a nucleotide sequence that includes a breakpoint. For example, the nucleic acid molecule includes a nucleotide sequence that includes the fusion junction between the RANBP17 gene and the FGFR3 gene, e.g., the breakpoint between intron 28 of RANBP17 and intron 13 of FGFR3. In other embodiments, the nucleic acid molecules includes a nucleotide sequence of one or more of nucleotide 170,726,887 of chromosome 5 coupled to (e.g., directly or indirectly juxtaposed to) one or more of nucleotide 1,807, 497 of chromosome 4. In one embodiment, the nucleic acid molecule includes the nucleotide sequence of: chromosome 5 at one or more of nucleotide 170,726,887 plus or minus 10, 20, 30, 40 50, 60, 80, 100, 150 nucleotides and chromosome 4 at one or more of nucleotide 1,807,497 plus or minus 10, 20, 30, 40 50, 60, 80, 100, 150 nucleotides (corresponding to the breakpoint of a RANBP17-FGFR3 fusion), or a fragment thereof, or a sequence substantially identical thereto. In one embodiment, the nucleic acid molecule is complementary to at least a portion of a nucleotide sequence disclosed herein, e.g., is capable of hybridizing under a stringency condition described herein to SEQ ID NO:63 and/or SEQ ID NO:3 or a fragment thereof. In yet other embodiment, the nucleic acid molecule hybridizes to a nucleotide sequence that is complementary to at least a portion of a nucleotide sequence disclosed herein, e.g., is capable of hybridizing under a stringency condition described herein to a nucleotide sequence complementary to SEQ ID NO:63 or 3 or a fragment thereof.

In another embodiment, the RANBP17-FGFR3 fusion nucleic acid comprises at least 6, 12, 15, 20, 25, 50, 75, 100 or more nucleotides from exons 1-28 of RANBP17 (e.g., from the nucleotide sequence of RANBP17 preceding the fusion junction with FGFR3, e.g., of the RANBP17 sequence shown in FIGS. 63A-63B (SEQ ID NO:63)), and at least 6, 12, 15, 20, 25, 50, 75, 100 or more nucleotides from exon 14 of FGFR3 (e.g., from the nucleotide sequence of FGFR3 following the fusion junction with RANBP17, e.g., of the FGFR3 sequence shown in FIGS. 3A-3B (SEQ ID NO:3)).

In other embodiments, the nucleic acid molecule includes a nucleotide sequence encoding a RANBP17-FGFR3 fusion polypeptide that includes a fragment of a RANBP17 gene and a fragment of an FGFR3 gene. In one embodiment, the nucleotide sequence encodes a RANBP17-FGFR3 fusion polypeptide that includes e.g., an FGFR3 tyrosine kinase domain or a functional fragment thereof. In yet other embodiments, the nucleic acid molecule includes a nucleotide sequence encoding the amino acid sequence (e.g., a fragment of the amino acid sequence) shown in FIG. 64 (e.g., SEQ ID NO:64) and a nucleotide sequence encoding the amino acid sequence (e.g., a fragment of the amino acid sequence) shown in FIG. 4 (e.g., SEQ ID NO:4), or a fragment of the fusion, or a sequence substantially identical thereto. In one embodiment, the encoded RANBP17-FGFR3 fusion polypeptide includes an FGFR3 tyrosine kinase domain or a functional fragment thereof.

In a related aspect, the invention features nucleic acid constructs that include the RANBP17-FGFR3 nucleic acid molecules described herein. In certain embodiments, the nucleic acid molecules are operatively linked to a native or a heterologous regulatory sequence. Also included are vectors and host cells that include the RANBP17-FGFR3 nucleic acid molecules described herein, e.g., vectors and host cells suitable for producing the nucleic acid molecules and polypeptides described herein.

In a related aspect, methods of producing the nucleic acid molecules and polypeptides described herein are also described.

In another aspect, the invention features nucleic acid molecules that reduce or inhibit the expression of a nucleic acid molecule that encodes a RANBP17-FGFR3 fusion described herein. Examples of such nucleic acid molecules include, for example, antisense molecules, ribozymes, RNAi, triple helix molecules that hybridize to a nucleic acid encoding RANBP17-FGFR3, or a transcription regulatory region of RANBP17-FGFR3, and blocks or reduces mRNA expression of RANBP17-FGFR3.

Nucleic Acid Detection and Capturing Reagents

The invention also features a nucleic acid molecule, e.g., nucleic acid fragment, suitable as probe, primer, bait or library member that includes, flanks, hybridizes to, which are useful for identifying, or are otherwise based on, the RANBP17-FGFR3 fusions described herein. In certain embodiments, the probe, primer or bait molecule is an oligonucleotide that allows capture, detection or isolation of a RANBP17-FGFR3 fusion nucleic acid molecule described herein. The oligonucleotide can comprise a nucleotide sequence substantially complementary to a fragment of the RANBP17-FGFR3 fusion nucleic acid molecules described herein. The sequence identity between the nucleic acid fragment, e.g., the oligonucleotide, and the target RANBP17-FGFR3 sequence need not be exact, so long as the sequences are sufficiently complementary to allow the capture, detection or isolation of the target sequence. In one embodiment, the nucleic acid fragment is a probe or primer that includes an oligonucleotide between about 5 and 25, e.g., between 10 and 20, or 10 and 15 nucleotides in length. In other embodiments, the nucleic acid fragment is a bait that includes an oligonucleotide between about 100 to 300 nucleotides, 130 and 230 nucleotides, or 150 and 200 nucleotides, in length.

In one embodiment, the nucleic acid fragment can be used to identify or capture, e.g., by hybridization, a RANBP17-FGFR3 fusion. For example, the nucleic acid fragment can be a probe, a primer, or a bait, for use in identifying or capturing, e.g., by hybridization, a RANBP17-FGFR3 fusion described herein. In one embodiment, the nucleic acid fragment can be useful for identifying or capturing a RANBP17-FGFR3 breakpoint, e.g., the nucleotide sequence of: chromosome 5 at nucleotide 170,726,887 plus or minus 10, 20, 30, 40 50, 60, 80, 100, 150 nucleotides and chromosome 4 at nucleotide 1,807,497 plus or minus 10, 20, 30, 40 50, 60, 80, 100, 150 nucleotides.

In one embodiment, the nucleic acid fragment hybridizes to a nucleotide sequence within a chromosomal rearrangement that creates an in-frame fusion of intron 28 of RANBP17 with intron 13 of FGFR3. In one embodiment, the nucleic acid fragment hybridizes to a nucleotide sequence in the region In other embodiments, the nucleic acid molecules includes a nucleotide sequence in the region of nucleotides 170,726,887 of chromosome 5 coupled to (e.g., juxtaposed to) nucleotides in the region of nucleotides 1,807,497 of chromosome 4. In one embodiment, the nucleic acid fragment hybridizes to a nucleotide sequence that includes a breakpoint, e.g., the nucleotide sequence of: chromosome 5 at nucleotide 170,726,887 plus or minus 10, 20, 30, 40 50, 60, 80, 100, 150 or more nucleotides and chromosome 4 at nucleotide 1,807,497 plus or minus 10, 20, 30, 40 50, 60, 80, 100, 150 or more nucleotides. For example, the nucleic acid fragment can hybridize to a nucleotide sequence that includes the fusion junction between the RANBP17 gene and the FGFR3 gene, e.g., a nucleotide sequence that includes a portion of a nucleotide sequence within intron 28 of a RANBP17 gene and 13 of an FGFR3 gene.

In another embodiment, the nucleic acid fragment hybridizes to a nucleotide sequence that comprises at least 6, 12, 15, 20, 25, 50, 75, 100, 150 or more nucleotides from exons 1-28 of RANBP17 (e.g., from the nucleotide sequence of RANBP17 preceding the fusion junction with FGFR3, e.g., of the RANBP17 sequence shown in FIGS. 63A-63B (SEQ ID NO:63)), and at least 6, 12, 15, 20, 25, 50, 75, 100, 150 or more nucleotides from exon 14 of FGFR3 (e.g., from the nucleotide sequence of FGFR3 following the fusion junction with RANBP17, e.g., of the FGFR3 sequence shown in FIGS. 3A-3B (SEQ ID NO:3)).

The probes or primers described herein can be used, for example, for FISH detection or PCR amplification. In one exemplary embodiment where detection is based on PCR, amplification of the RANBP17-FGFR3 fusion junction fusion junction can be performed using a primer or a primer pair, e.g., for amplifying a sequence flanking the fusion junctions described herein, e.g., the mutations or the junction of a chromosomal rearrangement described herein, e.g., RANBP17-FGFR3.

In one embodiment, a pair of isolated oligonucleotide primers can amplify a region containing or adjacent to a position in the RANBP17-FGFR3 fusion. For example, forward primers can be designed to hybridize to a nucleotide sequence within RANBP17 genomic or mRNA sequence (e.g., a nucleotide sequence within exons 1-28 of RANBP17 of SEQ ID NO:63), and the reverse primers can be designed to hybridize to a nucleotide sequence of FGFR3 (e.g., a nucleotide sequence within exon 14 of FGFR3, of SEQ ID NO:3).

In another embodiment, the nucleic acid fragments can be used to identify, e.g., by hybridization, a RANBP17-FGFR3 fusion. In one embodiment, the nucleic acid fragment hybridizes to a nucleotide sequence that includes a fusion junction between the RANBP17 transcript and the FGFR3 transcript.

In other embodiments, the nucleic acid fragment includes a bait that comprises a nucleotide sequence that hybridizes to a RANBP17-FGFR3 fusion nucleic acid molecule described herein, and thereby allows the capture or isolation said nucleic acid molecule. In one embodiment, a bait is suitable for solution phase hybridization. In other embodiments, a bait includes a binding entity, e.g., an affinity tag, that allows capture and separation, e.g., by binding to a binding entity, of a hybrid formed by a bait and a nucleic acid hybridized to the bait.

In other embodiments, the nucleic acid fragment includes a library member comprising a RANBP17-FGFR3 nucleic acid molecule described herein. In one embodiment, the library member includes a rearrangement that results in a RANBP17-FGFR3 fusion described herein.

The nucleic acid fragment can be detectably labeled with, e.g., a radiolabel, a fluorescent label, a bioluminescent label, a chemiluminescent label, an enzyme label, a binding pair label, or can include an affinity tag; a tag, or identifier (e.g., an adaptor, barcode or other sequence identifier).

RANBP17-FGFR3 Fusion Polypeptides

In another embodiment, the RANBP17-FGFR3 fusion comprises an amino acid sequence (e.g., a fragment of the amino acid sequence) shown in FIG. 64 (SEQ ID NO:64) and an amino acid sequence (e.g., a fragment of the amino acid sequence) shown in FIG. 4 (SEQ ID NO:4), or a fragment of the fusion. In one embodiment, the RANBP17-FGFR3 fusion comprises an amino acid sequence substantially identical to the amino acid sequence (e.g., a fragment of the amino acid sequence) shown in FIG. 64 (SEQ ID NO:64) and the amino acid sequence (e.g., a fragment of the amino acid sequence) shown in FIG. 4 (SEQ ID NO:4), or a fragment thereof. In one embodiment, the RANBP17-FGFR3 fusion comprises an amino acid sequence at least 70%, at least 75%, at least 80%, at least 85%, at least 90%, at least 95%, at least 99%, at least 99.5 or greater, identical to the amino acid sequence (e.g., a fragment of the amino acid sequence) shown in FIG. 64 (SEQ ID NO:64) and the amino acid sequence (e.g., a fragment of the amino acid sequence) shown in FIG. 4 (SEQ ID NO:4). In one embodiment, the RANBP17-FGFR3 fusion comprises a sequence containing at least 10, 20, 50, 100, 500, 600, 700, 800, 900, 1000, or more amino acids of the amino acid sequence shown in FIG. 64 (SEQ ID NO:64) and FIG. 4 (SEQ ID NO:4). In one embodiment, the RANBP17-FGFR3 fusion comprises an amino acid sequence containing at least 5, 10, 20, 50, 100, 500, 600, 700, 800, 900, 1000, or more contiguous amino acids of the amino acid sequence shown in FIG. 64 (SEQ ID NO:64) and at least 5, 10, 20, 50, 100, 500, 600, 700, 800, 900, 1000, or more contiguous amino acids of the amino acid sequence shown in FIG. 4 (SEQ ID NO:4). In one embodiment, the 5' RANBP17-3' FGFR3 fusion polypeptide includes an FGFR3 receptor tyrosine kinase domain or a functional fragment thereof. In an embodiment, the 5'RANBP17-3'FGFR3 fusion polypeptide comprises sufficient FGFR3 and sufficient RANBP17 sequence such that it has kinase activity, e.g., has elevated activity, e.g., FGFR3 kinase activity, as compared with wild type FGFR3, e.g., in a cell of a cancer referred to herein.

In another aspect, the invention features a RANBP17-FGFR3 fusion polypeptide (e.g., a purified RANBP17-FGFR3 fusion polypeptide), a biologically active or antigenic fragment thereof, as well as reagents (e.g., antibody molecules that bind to a RANBP17-FGFR3 fusion polypeptide), methods for modulating a RANBP17-FGFR3 polypeptide activity and detection of a RANBP17-FGFR3 polypeptide.

In one embodiment, the RANBP17-FGFR3 fusion polypeptide has at least one biological activity, e.g., an FGFR3 kinase activity. In one embodiment, at least one biological activity of the RANBP17-FGFR3 fusion polypeptide is reduced or inhibited by an anti-cancer drug, e.g., a kinase inhibitor (e.g., a multikinase inhibitor or an FGFR3-specific inhibitor). In one embodiment, at least one biological activity of the RANBP17-FGFR3 fusion polypeptide is reduced or inhibited by an FGFR3 kinase inhibitor chosen from e.g., TKI258; AP24534; AZD4547; FP-1039; XL9999; or BGJ398 (NVP-BGJ398).

In yet other embodiments, the RANBP17-FGFR3 fusion polypeptide is encoded by a nucleic acid molecule described herein. In one embodiment, the RANBP17-FGFR3 fusion polypeptide is encoded by an in-frame fusion of intron 28 of RANBP17 with intron 13 of FGFR3 (e.g., a sequence on chromosome 5). In another embodiment, the RANBP17-FGFR3 fusion polypeptide includes an amino acid sequence encoded by a nucleotide sequence comprising a fusion junction between the RANBP17 transcript and the FGFR3 transcript.

In certain embodiments, the RANBP17-FGFR3 fusion polypeptide comprises one or more of encoded exons 1-28 from RANBP17 and one or more of encoded exon exons 14-18 of FGFR3. In certain embodiments, the RANBP17-FGFR3 fusion polypeptide comprises at least 1, 2, 3, 4, 5, 6, 7, 8, 9, 10, 11, 12, 13, 14, 15, 16, 17, 18, 19, 20, 21, 22, 23, 24, 25, 26, 27, 28 or more encoded exons from RANBP17 and at least 1, 2, 3, 4 or more, encoded exons from FGFR3. In certain embodiments, the RANBP17-FGFR3 fusion polypeptide comprises a fusion of encoded exons 1-28 from RANBP17 and encoded exon 14 from FGFR3 (or a fragment thereof). In other embodiments, the fusion comprises least 1, 2, 3, 4, 5, 6, 7, 8, 9, 10, 11, 12, 13, 14, 15, 16, 17, 18, 19, 20, 21, 22, 23, 24, 25, 26, 27, 28 encoded exons from RANBP17; and at least 1, 2, 3, 4 encoded exons from FGFR3. In certain embodiments, the RANBP17-FGFR3 fusion polypeptide comprises encoded exons 1-28 from RANBP17 and exon exons 14-18 of FGFR3. In certain embodiments, the 5' RANBP17-3' FGFR3 fusion polypeptide comprises a fusion junction of the sequence of exons 1-28 from RANBP17 and the sequence of exon 14 from FGFR3.

In certain embodiments, the RANBP17-FGFR3 fusion comprises the amino acid sequence corresponding to exons 1-28 or a fragment thereof from RANBP17, and the amino acid sequence corresponding to exon 14 or a fragment thereof from FGFR3 (e.g., as shown in FIG. 64 (SEQ ID NO:64) and FIG. 4 (SEQ ID NO:4)). In one embodiment, the RANBP17-FGFR3 fusion comprises at least 5, 10, 15, 20 or more amino acids from exons 1-28 of RANBP17 (e.g., from the amino acid sequence of RANBP17 preceding the fusion junction with FGFR3, e.g., of the RANBP17 sequence shown in FIG. 64 (SEQ ID NO:64)), and at least 5, 10, 15, 20 or more amino acids from exon 14 of FGFR3 (e.g., from the amino acid sequence of FGFR3 following the fusion junction with RANBP17, e.g., of the FGFR3 sequence shown in FIG. 4 (SEQ ID NO:4)).

In one embodiment, the RANBP17-FGFR3 fusion polypeptide includes an FGFR3 tyrosine kinase domain or a functional fragment thereof. In a related aspect, the invention features RANBP17-FGFR3 fusion polypeptide or fragments operatively linked to heterologous polypeptides to form fusion proteins.

In another embodiment, the RANBP17-FGFR3 fusion polypeptide or fragment is a peptide, e.g., an immunogenic peptide or protein, that contains a fusion junction described herein. Such immunogenic peptides or proteins can be used to raise antibodies specific to the fusion protein. In other embodiments, such immunogenic peptides or proteins can be used for vaccine preparation. The vaccine preparation can include other components, e.g., an adjuvant.

In another aspect, the invention features antibody molecules that bind to a RANBP17-FGFR3 fusion polypeptide or fragment described herein. In embodiments, the antibody can distinguish wild type FGFR3 (or RANBP17) from RANBP17-FGFR3.

Detection Reagents and Detection of Mutations

In another aspect, the invention features a detection reagent, e.g., a purified or an isolated preparation thereof. Detection reagents can distinguish a nucleic acid, or protein sequence, having a breakpoint, e.g., a RANBP17-FGFR3 breakpoint; from a reference sequence. In one embodiment, the detection reagent detects (e.g., specifically detects) a RANBP17-FGFR3 fusion nucleic acid or a polypeptide (e.g., distinguishes a wild type FGFR3 or another FGFR3 fusion (or RANBP17) from a RANBP17-FGFR3 nucleic acid (e.g., as described herein in FIGS. 63A-63B (SEQ ID NO:63) and FIGS. 3A-3B (SEQ ID NO:3); or a RANBP17-FGFR3 polypeptide (e.g., as described herein in FIG. 64 (SEQ ID NO:64) and FIG. 4 (SEQ ID NO:4).

Detection reagents, e.g., nucleic acid-based detection reagents, can be used to identify mutations in a target nucleic acid, e.g., DNA, e.g., genomic DNA or cDNA, or RNA, e.g., in a sample, e.g., a sample of nucleic acid derived from a neoplastic or tumor cell, e.g., a melanocytic neoplasm, melanoma or metastatic cell. Detection reagents, e.g., antibody-based detection reagents, can be used to identify mutations in a target protein, e.g., in a sample, e.g., a sample of protein derived from, or produced by, a neoplastic or tumor cell, e.g., a melanocytic neoplasm, melanoma or metastatic cell.

Method of Treatment

In a related aspect, a method of inhibiting, reducing, or treating a hyperproliferative disorder, e.g., a neoplasm (including benign, pre-malignant or malignant (e.g., a cancer), in a subject is provided. The method includes administering to the subject a preselected therapeutic agent, e.g., an anti-cancer agent (e.g., a kinase inhibitor), as a single agent, or in combination, in an amount sufficient to reduce, inhibit or treat the activity or expression of RANBP17-FGFR3 (e.g., a RANBP17-FGFR3 fusion described herein), thereby inhibiting, reducing, or treating the hyperproliferative disorder in the subject.

In one embodiment, the subject treated has a RANBP17-FGFR3 fusion; e.g., the subject has a tumor or cancer harboring a RANBP17-FGFR3 fusion. In other embodiments, the subject has been previously identified as having a RANBP17-FGFR3 fusion. In yet other embodiments, the subject has been previously identified as being likely or unlikely to respond to treatment with a protein kinase inhibitor, e.g., a subject that has previously participated in a clinical trial. In other embodiments, the subject has been previously identified as being likely or unlikely to respond to treatment with a protein kinase inhibitor, based on the presence of the RANBP17-FGFR3 fusion. In one embodiment, the subject is a mammal, e.g., a human. In one embodiment, the subject has, or at risk of having a cancer at any stage of disease. In other embodiments, the subject is a patient, e.g., a cancer patient.

In certain embodiments, the neoplasm or neoplastic cell is a benign, pre-malignant, malignant (cancer) or metastasis. In certain embodiments, the cancer is a solid tumor, a soft tissue tumor, or a metastatic lesion.

In one embodiment, the neoplasm or neoplastic cell is a benign, pre-malignant, malignant (cancer) or metastasis. In certain embodiments, the cancer is a solid tumor, a soft tissue tumor, or a metastatic lesion. In an embodiment, the cancer is a breast carcinoma. In one embodiment, the cancer is chosen from a lung cancer, a pancreatic cancer, melanoma, a colorectal cancer, an esophageal-gastric cancer, a thyroid cancer, or an adenocarcinoma. In one embodiment, the cancer is a lung adenocarcinoma. In other embodiment, the lung cancer is chosen from one or more of the following: non-small cell lung cancer (NSCLC), small cell lung cancer (SCLC), squamous cell carcinoma (SCC), adenocarcinoma of the lung, bronchogenic carcinoma, or a combination thereof. In one embodiment, the lung cancer is NSCLC or SCC.

In one embodiment, the anti-cancer agent is a kinase inhibitor. For example, the kinase inhibitor is a multi-kinase inhibitor or an FGFR3-specific inhibitor. In one embodiment, the kinase inhibitor is an FGFR3 inhibitor including, but not limited to, TKI258; AP24534; AZD4547; FP-1039; XL9999; or BGJ398 (NVP-BGJ398). In certain embodiments, the FGFR3 inhibitor is a FGFR3 inhibitor described herein.

NUMA1-ERBB4 Fusions

In one embodiment, a fusion includes an in-frame fusion of an exon of nuclear mitotic apparatus protein 1 is a structural protein of the nucleus (NUMA1), e.g., one more exons of NUMA1 (e.g., one or more of exons 1-13 of NUMA1) or a fragment thereof, and an exon of tyrosine kinase-type cell surface receptor HER4 (ERBB4), e.g., one or more exons of an ERBB4 (e.g., one or more of exons 18-28 of ERBB4) or a fragment thereof. For example, the NUMA1-ERBB4 fusion can include an in-frame fusion within an intron of NUMA1 (e.g., intron 13) or a fragment thereof, with an intron of ERBB4 (e.g., intron 28) or a fragment thereof. In one embodiment, the fusion of the NUMA1-ERBB4 fusion comprises the nucleotide sequence of: chromosome 11 at one or more of nucleotide 71,727,864 (plus or minus 10, 20, 30, 50, 60, 70, 80, 100 or more nucleotides) and chromosome 2 at one or more of nucleotide 212,495,208 (plus or minus 10, 20, 30, 50, 60, 70, 80, 100 or more nucleotides).

In certain embodiments, the NUMA1-ERBB4 fusion is in a 5'-NUMA1 to 3'-ERBB4 configuration (also referred to herein as "5'-NUMA1-ERBB4-3')." The term "fusion" or "fusion molecule" can refer to a polypeptide or a nucleic acid fusion, depending on the context. It may include a full-length sequence of a fusion or a fragment thereof, e.g., a fusion junction (e.g., a fragment including a portion of NUMA1 and a portion of ERBB4, e.g., a portion of the NUMA1-ERBB4 fusion described herein). In one embodiment, the NUMA1-ERBB4 fusion polypeptide includes a fragment of the amino acid sequence shown in FIG. 66 (SEQ ID NO:66) and a fragment of the amino acid sequence shown in FIG. 28 (SEQ ID NO:28), or an amino acid sequence substantially identical thereto. In another embodiment, the NUMA1-ERBB4 fusion nucleic acid includes a fragment of the nucleotide sequence shown in FIGS. 65A-65C (SEQ ID NO:65) and a fragment of the nucleotide sequence shown in FIGS. 27A-27E (SEQ ID NO:27), or a nucleotide sequence substantially identical thereto. In one embodiment, the NUMA1-ERBB4 fusion polypeptide comprises sufficient NUMA1 and sufficient ERBB4 sequence such that the 5' NUMA1-3' ERBB4 fusion has kinase activity, e.g., has elevated activity, e.g., ERBB4 tyrosine kinase activity, as compared with wild type ERBB4, e.g., in a cell of a cancer referred to herein (e.g., pancreas ductal adenocarcinoma).

In certain embodiments, the NUMA1-ERBB4 fusion comprises one or more (or all of) exons 1-13 from NUMA1 and one or more (or all of) exons 18-28 of ERBB4 (e.g., one or more of the exons shown in FIGS. 65A-65C (SEQ ID NO:65) and FIGS. 27A-27E (SEQ ID NO:27). In another embodiment, the NUMA1-ERBB4 fusion comprises one or more (or all of) exons 1-13 of NUMA1 and one or more (or all of) exons 18-28 of ERBB4. In certain embodiments, the NUMA1-ERBB4 fusion comprises at least 1, 2, 3, 4, 5, 6, 7, 8, 9, 10, 11, 12, 13 or more exons (or encoded exons) from NUMA1 and at least 1, 2, 3, 4, 5, 6, 7, 8, 9, 10 or more exons (or encoded exons) from ERBB4 (e.g., from the NUMA1 and ERBB4 sequences shown in FIGS. 65A-65C and FIG. 66 (SEQ ID NO:65 and 66) and FIGS. 27A-27E and FIG. 28 (SEQ ID NOs:27 and 28)).

In certain embodiments, the NUMA1-ERBB4 fusion comprises exons 1-13 or a fragment thereof from NUMA1, and exon 18 or a fragment thereof from ERBB4 (e.g., as shown in FIGS. 65A-65C (SEQ ID NO:65) and FIGS. 27A-27E (SEQ ID NO:27)). In one embodiment, the NUMA1-ERBB4 fusion comprises at least 5, 10, 15, 20, 30, 40, 50 or more amino acids from exons 1-13 of NUMA1 (e.g., from the amino acid sequence of NUMA1 as shown in FIG. 66 (SEQ ID NO:66) (e.g., from the amino acid sequence of NUMA1 preceding the fusion junction with ERBB4, and at least 5, 10, 15, 20, 30, 40, 50 or more amino acids from exon 18 of ERBB4 (e.g., from the amino acid sequence of ERBB4 as shown in FIG. 28 (SEQ ID NO:28)). In another embodiment, the NUMA1-ERBB4 fusion comprises at least 6, 12, 15, 20, 25, 50, 75, 100 or more nucleotides from exons 1-13 of NUMA1 (e.g., from the nucleotide sequence of NUMA1 as shown in FIGS. 65A-65C (SEQ ID NO:65) (e.g., from the nucleotide sequence of NUMA1 preceding the fusion junction with ERBB4); and at least 6, 12, 15, 20, 25, 50, 75, 100 or more nucleotides from exon 18 of ERBB4 (e.g., from the nucleotide sequence of ERBB4 as shown in FIGS. 27A-27E (SEQ ID NO:27).

NUMA1-ERBB4 Nucleic Acid Molecules

In one aspect, the invention features a nucleic acid molecule (e.g., an isolated or purified) nucleic acid molecule that includes a fragment of a NUMA1 gene and a fragment of am ERBB4 gene. In one embodiment, the nucleotide sequence encodes a NUMA1-ERBB4 fusion polypeptide that includes an ERBB4 tyrosine kinase domain or a functional fragment thereof. In another embodiment, the nucleotide sequence encodes a fragment of the ERBB4 polypeptide including the amino acid sequence of SEQ ID NO:28 or a fragment thereof, or a sequence substantially identical thereto. In other embodiments, the nucleic acid molecule includes a fragment of the NUMA1 gene encoding the amino acid sequence of SEQ ID NO:66 or a fragment thereof, or a sequence substantially identical thereto. In yet other embodiments, the nucleic acid molecule includes a nucleotide sequence encoding the amino acid sequence shown in FIG. 66 (SEQ ID NO:66), or a fragment thereof, and the amino acid sequence shown in FIG. 28 (SEQ ID NO:28) or a fragment thereof, or a sequence substantially identical thereto.

In one embodiment, the nucleic acid molecule includes a fusion, e.g., an in-frame fusion, between an intron of NUMA1 (e.g., intron 13, or a fragment thereof), and an intron of ERBB4 (e.g., intron 13, or a fragment thereof). The NUMA1-ERBB4 fusion can comprise a fusion of the nucleotide sequence of: chromosome 11 at one or more of nucleotide 71,727,864 (plus or minus 10, 20, 30, 50, 60, 70, 80, 100 nucleotides) and chromosome 2 at one or more of nucleotide 212,495,208 (plus or minus 10, 20, 30, 50, 60, 70, 80, 100 nucleotides), or a fragment thereof. In one embodiment, the NUMA1-ERBB4 fusion comprises a fusion of the nucleotide sequence of: chromosome 11 at one or more of nucleotide 71,727,864 (plus or minus 10, 20, 30, 50, 60, 70, 80, 100 nucleotides) and chromosome 2 at one or more of nucleotide 212,495,208 (plus or minus 10, 20, 30, 50, 60, 70, 80, 100 nucleotides), or a fragment thereof.

In another embodiment, the NUMA1-ERBB4 fusion comprises a nucleotide sequence (e.g., a fragment of a nucleotide sequence) shown in FIGS. 65A-65C (SEQ ID NO:65) and a nucleotide sequence (e.g., a fragment of a nucleotide sequence) shown in FIGS. 27A-27E (SEQ ID NO:27), or a fragment of the fusion. In one embodiment, the NUMA1-ERBB4 fusion comprises a nucleotide sequence substantially identical to the nucleotide sequence (e.g., a fragment of a nucleotide sequence) shown in FIGS. 65A-65C (SEQ ID NO:65) and the nucleotide sequence (e.g., a fragment of a nucleotide sequence) shown FIGS. 27A-27E (SEQ ID NO:27), or a fragment of the fusion. In one embodiment, the NUMA1-ERBB4 fusion comprises a nucleotide sequence at least 70%, at least 75%, at least 80%, at least 85%, at least 90%, at least 95%, at least 99%, at least 99.5 or greater, identical to the nucleotide sequence (e.g., a fragment of a nucleotide sequence) shown in FIGS. 65A-65C (SEQ ID NO:65) and to the nucleotide sequence (e.g., a fragment of a nucleotide sequence) shown in FIGS. 27A-27E (SEQ ID NO:27). In one embodiment, the NUMA1-ERBB4 fusion comprises a nucleotide sequence containing at least 25, 50, 100, 150, 200, 500, 1000, 1500, 2000, 2500, 3000, or more nucleotides of the nucleotide sequence shown in FIGS. 65A-65C (SEQ ID NO:65) and a nucleotide sequence containing at least 25, 50, 100, 150, 200, 500, 1000, 1500, 2000, 2500, 3000, or more nucleotides of the nucleotide sequence shown in FIGS. 27A-27E (SEQ ID NO:27). In one embodiment, the NUMA1-ERBB4 fusion comprises a nucleotide sequence containing at least 25, 50, 100, 150, 200, 500, 1000, 1500, 2000, 2500, 3000, or more contiguous nucleotides of the nucleotide sequence shown in FIGS. 65A-65C (SEQ ID NO:65) and a nucleotide sequence containing at least 25, 50, 100, 150, 200, 500, 1000, 1500, 2000, 2500, 3000, or more nucleotides of the nucleotide sequence shown in FIGS. 27A-27E (SEQ ID NO:27).

In another embodiment, the nucleic acid molecule includes a fusion, e.g., an in-frame fusion, of at least exons 1-13 of NUMA1 or a fragment thereof (e.g., one or more of exons 1-13 of NUMA1 or a fragment thereof), and at least exon 18 or a fragment thereof (e.g., one or more of exons exons 18-28 of ERBB4 or a fragment thereof). In yet other embodiments, the nucleic acid molecule includes a fragment the nucleotide sequence shown in FIGS. 65A-65C (SEQ ID NO:65) and a fragment of the nucleotide sequence shown in FIGS. 27A-27E (SEQ ID NO:27) or a fragment of the fusion, or a sequence substantially identical thereto.

In one embodiment, the nucleic acid molecule is complementary to at least a portion of a nucleotide sequence disclosed herein, e.g., is capable of hybridizing under a stringency condition described herein to SEQ ID NO:65 and/or SEQ ID NO:27, or a fragment thereof. In yet another embodiment, the nucleic acid molecule hybridizes to a nucleotide sequence that is complementary to at least a portion of a nucleotide sequence disclosed herein, e.g., is capable of hybridizing under a stringency condition to a nucleotide sequence complementary to SEQ ID NO:65 and/or SEQ ID NO:27, or a fragment thereof. The nucleotide sequence of a cDNA encoding an exemplary 5' NUMA1-3' ERBB4 fusion is shown in at least exons 1-13 (e.g., exons 1-13) of SEQ ID NO:65 and at least exon 18 (e.g., exons 18-28) of SEQ ID NO:27, and the predicted amino acid sequence is shown in the corresponding encoded exons of SEQ ID NO:66 and the corresponding encoded exons of SEQ ID NO:28, respectively.

In an embodiment the NUMA1-ERBB4 nucleic acid molecule comprises sufficient NUMA1 and sufficient ERBB4 sequence such that the encoded 5' NUMA1-3' ERBB4 fusion has kinase activity, e.g., has elevated activity, e.g., ERBB4 kinase activity, as compared with wild type ERBB4, e.g., in a cell of a cancer referred to herein. In certain embodiments, the 5' NUMA1-3' ERBB4 fusion comprises exons 1-13 from NUMA1 and exon exons 18-28 from ERBB4. In certain embodiments, the NUMA1-ERBB4 fusion comprises at least 1, 2, 3, 4, 5, 6, 7, 8, 9, 10, 11, 12, 13 or more exons from NUMA1 and at least 1, 2, 3, 4, 5, 6, 7, 8, 9, 10 or more, exons from ERBB4. In certain embodiments, the NUMA1-ERBB4 fusion comprises a fusion of exons 1-13 from NUMA1 and exon 18 from ERBB4. In another embodiment, the NUMA1-ERBB4 fusion comprises at least 1, 2, 3, 4, 5, 6, 7, 8, 9, 10, 11, 12, 13 exons from NUMA1; and at least 1, 2, 3, 4, 5, 6, 7, 8, 9, 10 exons from ERBB4.

In one embodiment, the nucleic acid molecule includes a nucleotide sequence that has an in-frame fusion of intron 13 of NUMA1 (e.g., NM_006185) with intron 13 of ERBB4 (e.g., NM_005235). In another embodiment, the nucleic acid molecule includes a nucleotide sequence that includes a breakpoint. For example, the nucleic acid molecule includes a nucleotide sequence that includes the fusion junction between the NUMA1 gene and the ERBB4 gene, e.g., the breakpoint between intron 13 of NUMA1 and intron 13 of ERBB4. In other embodiments, the nucleic acid molecules includes a nucleotide sequence of one or more of nucleotide 71,727,864 of chromosome 11 coupled to (e.g., directly or indirectly juxtaposed to) one or more of nucleotide 212,495, 208 of chromosome 2. In one embodiment, the nucleic acid molecule includes the nucleotide sequence of: chromosome 11 at one or more of nucleotide 71,727,864 plus or minus 10, 20, 30, 40 50, 60, 80, 100, 150 nucleotides and chromosome 2 at one or more of nucleotide 212,495,208 plus or minus 10, 20, 30, 40 50, 60, 80, 100, 150 nucleotides (corresponding to the breakpoint of a NUMA1-ERBB4 fusion), or a fragment thereof, or a sequence substantially identical thereto. In one embodiment, the nucleic acid molecule is complementary to at least a portion of a nucleotide sequence disclosed herein, e.g., is capable of hybridizing under a stringency condition described herein to SEQ ID NO:65 and/or SEQ ID NO:27 or a fragment thereof. In yet other embodiment, the nucleic acid molecule hybridizes to a nucleotide sequence that is complementary to at least a portion of a nucleotide sequence disclosed herein, e.g., is capable of hybridizing under a stringency condition described herein to a nucleotide sequence complementary to SEQ ID NO:65 or 27 or a fragment thereof.

In another embodiment, the NUMA1-ERBB4 fusion nucleic acid comprises at least 6, 12, 15, 20, 25, 50, 75, 100 or more nucleotides from exons 1-13 of NUMA1 (e.g., from the nucleotide sequence of NUMA1 preceding the fusion junction with ERBB4, e.g., of the NUMA1 sequence shown in FIGS. 65A-65C (SEQ ID NO:65)), and at least 6, 12, 15, 20, 25, 50, 75, 100 or more nucleotides from exon 18 of ERBB4 (e.g., from the nucleotide sequence of ERBB4 following the fusion junction with NUMA1, e.g., of the ERBB4 sequence shown in FIGS. 27A-27E (SEQ ID NO:27)).

In other embodiments, the nucleic acid molecule includes a nucleotide sequence encoding a NUMA1-ERBB4 fusion polypeptide that includes a fragment of a NUMA1 gene and a fragment of an ERBB4 gene. In one embodiment, the nucleotide sequence encodes a NUMA1-ERBB4 fusion polypeptide that includes e.g., an ERBB4 tyrosine kinase domain or a functional fragment thereof. In yet other embodiments, the nucleic acid molecule includes a nucleotide sequence encoding the amino acid sequence (e.g., a fragment of the amino acid sequence) shown in FIGS. 66A-66C (e.g., SEQ ID NO:66) and a nucleotide sequence encoding the amino acid sequence (e.g., a fragment of the amino acid sequence) shown in FIG. 28 (e.g., SEQ ID NO:28), or a fragment of the fusion, or a sequence substantially identical thereto. In one embodiment, the encoded NUMA1-ERBB4 fusion polypeptide includes an ERBB4 tyrosine kinase domain or a functional fragment thereof.

In a related aspect, the invention features nucleic acid constructs that include the NUMA1-ERBB4 nucleic acid molecules described herein. In certain embodiments, the nucleic acid molecules are operatively linked to a native or a heterologous regulatory sequence. Also included are vectors and host cells that include the NUMA1-ERBB4 nucleic acid molecules described herein, e.g., vectors and host cells suitable for producing the nucleic acid molecules and polypeptides described herein.

In a related aspect, methods of producing the nucleic acid molecules and polypeptides described herein are also described.

In another aspect, the invention features nucleic acid molecules that reduce or inhibit the expression of a nucleic acid molecule that encodes a NUMA1-ERBB4 fusion described herein. Examples of such nucleic acid molecules include, for example, antisense molecules, ribozymes, RNAi, triple helix molecules that hybridize to a nucleic acid encoding NUMA1-ERBB4, or a transcription regulatory region of NUMA1-ERBB4, and blocks or reduces mRNA expression of NUMA1-ERBB4.

Nucleic Acid Detection and Capturing Reagents

The invention also features a nucleic acid molecule, e.g., nucleic acid fragment, suitable as probe, primer, bait or library member that includes, flanks, hybridizes to, which are useful for identifying, or are otherwise based on, the NUMA1-ERBB4 fusions described herein. In certain embodiments, the probe, primer or bait molecule is an oligonucleotide that allows capture, detection or isolation of a NUMA1-ERBB4 fusion nucleic acid molecule described herein. The oligonucleotide can comprise a nucleotide sequence substantially complementary to a fragment of the NUMA1-ERBB4 fusion nucleic acid molecules described herein. The sequence identity between the nucleic acid fragment, e.g., the oligonucleotide, and the target NUMA1-ERBB4 sequence need not be exact, so long as the sequences are sufficiently complementary to allow the capture, detection or isolation of the target sequence. In one embodiment, the nucleic acid fragment is a probe or primer that includes an oligonucleotide between about 5 and 25, e.g., between 10 and 20, or 10 and 15 nucleotides in length. In other embodiments, the nucleic acid fragment is a bait that includes an oligonucleotide between about 100 to 300 nucleotides, 130 and 230 nucleotides, or 150 and 200 nucleotides, in length.

In one embodiment, the nucleic acid fragment can be used to identify or capture, e.g., by hybridization, a NUMA1-ERBB4 fusion. For example, the nucleic acid fragment can be a probe, a primer, or a bait, for use in identifying or capturing, e.g., by hybridization, a NUMA1-ERBB4 fusion described herein. In one embodiment, the nucleic acid fragment can be useful for identifying or capturing a NUMA1-ERBB4 breakpoint, e.g., the nucleotide sequence of: chromosome 11 at nucleotide 71,727,864 plus or minus 10, 20, 30, 40 50, 60, 80, 100, 150 nucleotides and chromosome 2 at nucleotide 212,495,208 plus or minus 10, 20, 30, 40 50, 60, 80, 100, 150 nucleotides.

In one embodiment, the nucleic acid fragment hybridizes to a nucleotide sequence within a chromosomal rearrangement that creates an in-frame fusion of intron 13 of NUMA1 with intron 13 of ERBB4. In one embodiment, the nucleic acid fragment hybridizes to a nucleotide sequence in the region In other embodiments, the nucleic acid molecules includes a nucleotide sequence in the region of nucleotides 71,727,864 of chromosome 11 coupled to (e.g., juxtaposed to) nucleotides in the region of nucleotides 212,495,208 of chromosome 2. In one embodiment, the nucleic acid fragment hybridizes to a nucleotide sequence that includes a breakpoint, e.g., the nucleotide sequence of: chromosome 11 at nucleotide 71,727,864 plus or minus 10, 20, 30, 40 50, 60, 80, 100, 150 or more nucleotides and chromosome 2 at nucleotide 212,495,208 plus or minus 10, 20, 30, 40 50, 60, 80, 100, 150 or more nucleotides. For example, the nucleic acid fragment can hybridize to a nucleotide sequence that includes the fusion junction between the NUMA1 gene and the ERBB4 gene, e.g., a nucleotide sequence that includes a portion of a nucleotide sequence within intron 13 of a NUMA1 gene and 13 of an ERBB4 gene.

In another embodiment, the nucleic acid fragment hybridizes to a nucleotide sequence that comprises at least 6, 12, 15, 20, 25, 50, 75, 100, 150 or more nucleotides from exons 1-13 of NUMA1 (e.g., from the nucleotide sequence of NUMA1 preceding the fusion junction with ERBB4, e.g., of the NUMA1 sequence shown in FIGS. 65A-65C (SEQ ID NO:65)), and at least 6, 12, 15, 20, 25, 50, 75, 100, 150 or more nucleotides from exon 18 of ERBB4 (e.g., from the nucleotide sequence of ERBB4 following the fusion junction with NUMA1, e.g., of the ERBB4 sequence shown in FIGS. 27A-27E (SEQ ID NO:27)).

The probes or primers described herein can be used, for example, for FISH detection or PCR amplification. In one exemplary embodiment where detection is based on PCR, amplification of the NUMA1-ERBB4 fusion junction fusion junction can be performed using a primer or a primer pair, e.g., for amplifying a sequence flanking the fusion junctions described herein, e.g., the mutations or the junction of a chromosomal rearrangement described herein, e.g., NUMA1-ERBB4.

In one embodiment, a pair of isolated oligonucleotide primers can amplify a region containing or adjacent to a position in the NUMA1-ERBB4 fusion. For example, forward primers can be designed to hybridize to a nucleotide sequence within NUMA1 genomic or mRNA sequence (e.g., a nucleotide sequence within exons 1-13 of NUMA1 of SEQ ID NO:63), and the reverse primers can be designed to hybridize to a nucleotide sequence of ERBB4 (e.g., a nucleotide sequence within exon 18 of ERBB4, of SEQ ID NO:27).

In another embodiment, the nucleic acid fragments can be used to identify, e.g., by hybridization, a NUMA1-ERBB4 fusion. In one embodiment, the nucleic acid fragment hybridizes to a nucleotide sequence that includes a fusion junction between the NUMA1 transcript and the ERBB4 transcript.

In other embodiments, the nucleic acid fragment includes a bait that comprises a nucleotide sequence that hybridizes to a NUMA1-ERBB4 fusion nucleic acid molecule described herein, and thereby allows the capture or isolation said nucleic acid molecule. In one embodiment, a bait is suitable for solution phase hybridization. In other embodiments, a bait includes a binding entity, e.g., an affinity tag, that allows capture and separation, e.g., by binding to a binding entity, of a hybrid formed by a bait and a nucleic acid hybridized to the bait.

In other embodiments, the nucleic acid fragment includes a library member comprising a NUMA1-ERBB4 nucleic acid molecule described herein. In one embodiment, the library member includes a rearrangement that results in a NUMA1-ERBB4 fusion described herein.

The nucleic acid fragment can be detectably labeled with, e.g., a radiolabel, a fluorescent label, a bioluminescent label, a chemiluminescent label, an enzyme label, a binding pair label, or can include an affinity tag; a tag, or identifier (e.g., an adaptor, barcode or other sequence identifier).

NUMA1-ERBB4 Fusion Polypeptides

In another embodiment, the NUMA1-ERBB4 fusion comprises an amino acid sequence (e.g., a fragment of the amino acid sequence) shown in FIG. 66 (SEQ ID NO:66) and an amino acid sequence (e.g., a fragment of the amino acid sequence) shown in FIG. 28 (SEQ ID NO:28), or a fragment of the fusion. In one embodiment, the NUMA1-ERBB4 fusion comprises an amino acid sequence substantially identical to the amino acid sequence (e.g., a fragment of the amino acid sequence) shown in FIG. 66 (SEQ ID NO:66) and the amino acid sequence (e.g., a fragment of the amino acid sequence) shown in FIG. 28 (SEQ ID NO:28), or a fragment thereof. In one embodiment, the NUMA1-ERBB4 fusion comprises an amino acid sequence at least 70%, at least 75%, at least 80%, at least 85%, at least 90%, at least 95%, at least 99%, at least 99.5 or greater, identical to the amino acid sequence (e.g., a fragment of the amino acid sequence) shown in FIG. 66 (SEQ ID NO:66) and the amino acid sequence (e.g., a fragment of the amino acid sequence) shown in FIG. 28 (SEQ ID NO:28). In one embodiment, the NUMA1-ERBB4 fusion comprises a sequence containing at least 10, 20, 50, 100, 500, 600, 700, 800, 900, 1000, or more amino acids of the amino acid sequence shown in FIG. 66 (SEQ ID NO:66) and FIG. 28 (SEQ ID NO:28). In one embodiment, the NUMA1-ERBB4 fusion comprises an amino acid sequence containing at least 5, 10, 20, 50, 100, 500, 600, 700, 800, 900, 1000, or more contiguous amino acids of the amino acid sequence shown in FIG. 66 (SEQ ID NO:66) and at least 5, 10, 20, 50, 100, 500, 600, 700, 800, 900, 1000, or more contiguous amino acids of the amino acid sequence shown in FIG. 28 (SEQ ID NO:28). In one embodiment, the 5' NUMA1-3' ERBB4 fusion polypeptide includes an ERBB4 receptor tyrosine kinase domain or a functional fragment thereof. In an embodiment, the 5'NUMA1-3'ERBB4 fusion polypeptide comprises sufficient ERBB4 and sufficient NUMA1 sequence such that it has kinase activity, e.g., has elevated activity, e.g., ERBB4 kinase activity, as compared with wild type ERBB4, e.g., in a cell of a cancer referred to herein.

In another aspect, the invention features a NUMA1-ERBB4 fusion polypeptide (e.g., a purified NUMA1-

ERBB4 fusion polypeptide), a biologically active or antigenic fragment thereof, as well as reagents (e.g., antibody molecules that bind to a NUMA1-ERBB4 fusion polypeptide), methods for modulating a NUMA1-ERBB4 polypeptide activity and detection of a NUMA1-ERBB4 polypeptide.

In one embodiment, the NUMA1-ERBB4 fusion polypeptide has at least one biological activity, e.g., an ERBB4 kinase activity. In one embodiment, at least one biological activity of the NUMA1-ERBB4 fusion polypeptide is reduced or inhibited by an anti-cancer drug, e.g., a kinase inhibitor (e.g., a multikinase inhibitor or an ERBB4-specific inhibitor). In one embodiment, at least one biological activity of the NUMA1-ERBB4 fusion polypeptide is reduced or inhibited by an ERBB4 kinase inhibitor chosen from e.g., AST-1306; or dacamitinib (PF299804).

In yet other embodiments, the NUMA1-ERBB4 fusion polypeptide is encoded by a nucleic acid molecule described herein. In one embodiment, the NUMA1-ERBB4 fusion polypeptide is encoded by an in-frame fusion of intron 13 of NUMA1 with intron 13 of ERBB4 (e.g., a sequence on chromosome 11). In another embodiment, the NUMA1-ERBB4 fusion polypeptide includes an amino acid sequence encoded by a nucleotide sequence comprising a fusion junction between the NUMA1 transcript and the ERBB4 transcript.

In certain embodiments, the NUMA1-ERBB4 fusion polypeptide comprises one or more of encoded exons 1-13 from NUMA1 and one or more of encoded exon exons 18-28 of ERBB4. In certain embodiments, the NUMA1-ERBB4 fusion polypeptide comprises at least 1, 2, 3, 4, 5, 6, 7, 8, 9, 10, 11, 12, 13 or more encoded exons from NUMA1 and at least 1, 2, 3, 4, 5, 6, 7, 8, 9, 10 or more, encoded exons from ERBB4. In certain embodiments, the NUMA1-ERBB4 fusion polypeptide comprises a fusion of encoded exons 1-13 from NUMA1 and encoded exon 18 from ERBB4 (or a fragment thereof). In other embodiments, the fusion comprises least 1, 2, 3, 4, 5, 6, 7, 8, 9, 10, 11, 12, 13 encoded exons from NUMA1; and at least 1, 2, 3, 4, 5, 6, 7, 8, 9, 10 encoded exons from ERBB4. In certain embodiments, the NUMA1-ERBB4 fusion polypeptide comprises encoded exons 1-13 from NUMA1 and exon exons 18-28 of ERBB4. In certain embodiments, the 5' NUMA1-3' ERBB4 fusion polypeptide comprises a fusion junction of the sequence of exons 1-13 from NUMA1 and the sequence of exon 18 from ERBB4.

In certain embodiments, the NUMA1-ERBB4 fusion comprises the amino acid sequence corresponding to exons 1-13 or a fragment thereof from NUMA1, and the amino acid sequence corresponding to exon 18 or a fragment thereof from ERBB4 (e.g., as shown in FIG. 66 (SEQ ID NO:66) and FIG. 28 (SEQ ID NO:28)). In one embodiment, the NUMA1-ERBB4 fusion comprises at least 5, 10, 15, 20 or more amino acids from exons 1-13 of NUMA1 (e.g., from the amino acid sequence of NUMA1 preceding the fusion junction with ERBB4, e.g., of the NUMA1 sequence shown in FIG. 66 (SEQ ID NO:66)), and at least 5, 10, 15, 20 or more amino acids from exon 18 of ERBB4 (e.g., from the amino acid sequence of ERBB4 following the fusion junction with NUMA1, e.g., of the ERBB4 sequence shown in FIG. 28 (SEQ ID NO:28)).

In one embodiment, the NUMA1-ERBB4 fusion polypeptide includes an ERBB4 tyrosine kinase domain or a functional fragment thereof. In a related aspect, the invention features NUMA1-ERBB4 fusion polypeptide or fragments operatively linked to heterologous polypeptides to form fusion proteins.

In another embodiment, the NUMA1-ERBB4 fusion polypeptide or fragment is a peptide, e.g., an immunogenic peptide or protein, that contains a fusion junction described herein. Such immunogenic peptides or proteins can be used to raise antibodies specific to the fusion protein. In other embodiments, such immunogenic peptides or proteins can be used for vaccine preparation. The vaccine preparation can include other components, e.g., an adjuvant.

In another aspect, the invention features antibody molecules that bind to a NUMA1-ERBB4 fusion polypeptide or fragment described herein. In embodiments, the antibody can distinguish wild type ERBB4 (or NUMA1) from NUMA1-ERBB4.

Detection Reagents and Detection of Mutations

In another aspect, the invention features a detection reagent, e.g., a purified or an isolated preparation thereof. Detection reagents can distinguish a nucleic acid, or protein sequence, having a breakpoint, e.g., a NUMA1-ERBB4 breakpoint; from a reference sequence. In one embodiment, the detection reagent detects (e.g., specifically detects) a NUMA1-ERBB4 fusion nucleic acid or a polypeptide (e.g., distinguishes a wild type ERBB4 or another ERBB4 fusion (or NUMA1) from a NUMA1-ERBB4 nucleic acid (e.g., as described herein in FIGS. 65A-65C (SEQ ID NO:65) and FIGS. 27A-27E (SEQ ID NO:27); or a NUMA1-ERBB4 polypeptide (e.g., as described herein in FIG. 66 (SEQ ID NO:66) and FIG. 28 (SEQ ID NO:28).

Detection reagents, e.g., nucleic acid-based detection reagents, can be used to identify mutations in a target nucleic acid, e.g., DNA, e.g., genomic DNA or cDNA, or RNA, e.g., in a sample, e.g., a sample of nucleic acid derived from a neoplastic or tumor cell, e.g., a melanocytic neoplasm, melanoma or metastatic cell. Detection reagents, e.g., antibody-based detection reagents, can be used to identify mutations in a target protein, e.g., in a sample, e.g., a sample of protein derived from, or produced by, a neoplastic or tumor cell, e.g., a melanocytic neoplasm, melanoma or metastatic cell.

Method of Treatment

The ERBB4 gene encodes ErbB4, a member of the Egfr/Her2 receptor tyrosine kinase family that plays a role in cell proliferation and apoptosis and has been found to be mutated in various cancers. The variant reported here results in a rearrangement in which exons 1-13 of NUMA1 are fused to exons 18-28 of ERBB4. This eliminates the ERBB4 extracelluar and transmembrane domains, but includes most of the cytoplasmic domain and all of the ERBB4 protein kinase domain (uniprot.org). ERBB4 mutation has been reported very rarely in pancreatic carcinoma (COSMIC, October 2012). One study reported that pancreatic cancer cell lines had very low expression of Erbb4; in vitro studies suggested that ERBB4 may have dual roles in pancreatic cancer as both tumor suppressor and oncogene. These mutations may predict sensitivity to inhibitors of other ErbB family members, including the approved tyrosine kinase inhibitors erlotinib, lapatinib, and gefitinib. Erlotinib has received FDA approval for use in pancreatic ductal adenocarcinoma, and lapatinib and gefitinib are currently in clinical trials in multiple solid tumor types.

Erlotinib is a small molecule EGFR tyrosine kinase inhibitor. It has been approved for use in NSCLC and pancreatic cancer. In a study of glioblastoma cell lines, the Egfr small molecule inhibitors AG1478, gefitinib, erlotinib, and lapatinib all caused cell cycle arrest and a decrease in the Akt/Erk pathway; these inhibitors were shown to bind ErbB3 and ErbB4, preventing phosphorylation and therefore activation (Carrasco-Garcia E, Saceda M, Grasso S, et al.

(2011) Small tyrosine kinase inhibitors interrupt EGFR signaling by interacting with erbB3 and erbB4 in glioblastoma cell lines. Exp Cell Res 317(10):1476-89).

Gefitinib is a small molecule tyrosine kinase inhibitor targeting Egfr. Its initial FDA approval in unselected patients with advanced non-small cell lung cancer was revoked after the drug failed to show a survival benefit compared to placebo in patients who had progressed on first-line therapy. However, since that time, data from a number of randomized clinical trials has shown a significant improvement in progression-free survival compared with combination chemotherapy in chemo-naïve patients with known EGFR mutations in their tumor. In a study of glioblastoma cell lines, the Egfr small molecule inhibitors AG1478, gefitinib, erlotinib, and lapatinib caused cell cycle arrest and a decrease in the Akt/Erk pathway; these inhibitors were shown to bind ErbB3 and ErbB4, preventing phosphorylation and therefore activation (Carrasco-Garcia E, Saceda M, Grasso S, et al. (2011) Small tyrosine kinase inhibitors interrupt EGFR signaling by interacting with erbB3 and erbB4 in glioblastoma cell lines. Exp Cell Res 317(10):1476-89). Gefitinib is currently in clinical trials in multiple solid tumor types. A Phase 2 clinical trial of gefitinib with gemcitabine in pancreatic cancer reported 6/53 responses and 12/53 instances of stable disease (Fountzilas G, Bobos M, Kalogera-Fountzila A, et al. (2008) Gemcitabine combined with gefitinib in patients with inoperable or metastatic pancreatic cancer: a phase II Study of the Hellenic Cooperative Oncology Group with biomarker evaluation. Cancer Invest 26(8): 784-93). Another Phase 2 clinical trial of gefitinib in pancreatic cancer also reported some efficacy (Brell J M, Matin K, Evans T, et al. (2009) Phase II study of docetaxel and gefitinib as second-line therapy in gemcitabine pretreated patients with advanced pancreatic cancer. Oncology 76(4): 270-4).

Lapatinib is a dual tyrosine kinase inhibitor, targeting both Egfr and Her2 (Erbb2). It has been approved for use in metastatic breast cancer. Lapatinib is known to bind an inactive form of ErbB4, in a region that is conserved in all EGF family members (Qiu C, Tarrant M K, Choi S H, et al. (2008) Mechanism of activation and inhibition of the HER4/ErbB4 kinase. Structure 16(3):460-7). In a study of glioblastoma cell lines, the Egfr small molecule inhibitors AG1478, gefitinib, erlotinib, and lapatinib all caused cell cycle arrest and a decrease in the Akt/Erk pathway; these inhibitors were shown to bind ErbB3 and ErbB4, preventing phosphorylation and therefore activation (Carrasco-Garcia E, Saceda M, Grasso S, et al. (2011) Small tyrosine kinase inhibitors interrupt EGFR signaling by interacting with erbB3 and erbB4 in glioblastoma cell lines. Exp Cell Res 317(10):1476-89). Lapatinib is currently in clinical trials in multiple solid tumor types. A Phase 1 clinical trials of lapatinb, in combination with other drugs, in pancreatic cancer reported safety, and Phase 2 trials are ongoing (Safran H, Miner T, Resnick M, et al. (2008) Lapatinib/gemcitabine and lapatinib/gemcitabine/oxaliplatin: a phase I study for advanced pancreaticobiliary cancer. Am J Clin Oncol 31(2):140-4).

Accordingly, in another aspect, a method of inhibiting, reducing, or treating a hyperproliferative disorder, e.g., a neoplasm (including benign, pre-malignant or malignant (e.g., a cancer), in a subject is provided. The method includes administering to the subject a preselected therapeutic agent, e.g., an anti-cancer agent (e.g., a kinase inhibitor), as a single agent, or in combination, in an amount sufficient to reduce, inhibit or treat the activity or expression of NUMA1-ERBB4 (e.g., a NUMA1-ERBB4 fusion described herein), thereby inhibiting, reducing, or treating the hyperproliferative disorder in the subject.

In one embodiment, the subject treated has a NUMA1-ERBB4 fusion; e.g., the subject has a tumor or cancer harboring a NUMA1-ERBB4 fusion. In other embodiments, the subject has been previously identified as having a NUMA1-ERBB4 fusion. In yet other embodiments, the subject has been previously identified as being likely or unlikely to respond to treatment with a protein kinase inhibitor, e.g., a subject that has previously participated in a clinical trial. In other embodiments, the subject has been previously identified as being likely or unlikely to respond to treatment with a protein kinase inhibitor, based on the presence of the NUMA1-ERBB4 fusion. In one embodiment, the subject is a mammal, e.g., a human. In one embodiment, the subject has, or at risk of having a cancer at any stage of disease. In other embodiments, the subject is a patient, e.g., a cancer patient.

In certain embodiments, the neoplasm or neoplastic cell is a benign, pre-malignant, malignant (cancer) or metastasis. In certain embodiments, the cancer is a solid tumor, a soft tissue tumor, or a metastatic lesion.

In one embodiment, the neoplasm or neoplastic cell is a benign, pre-malignant, malignant (cancer) or metastasis. In certain embodiments, the cancer is a solid tumor, a soft tissue tumor, or a metastatic lesion. In an embodiment, the cancer is a pancreatic ductal carcinoma. In one embodiment, the cancer is chosen from a lung cancer, a pancreatic cancer, melanoma, a colorectal cancer, an esophageal-gastric cancer, a thyroid cancer, or an adenocarcinoma. In one embodiment, the cancer is a lung adenocarcinoma. In other embodiments, the lung cancer is chosen from one or more of the following: non-small cell lung cancer (NSCLC), small cell lung cancer (SCLC), squamous cell carcinoma (SCC), adenocarcinoma of the lung, bronchogenic carcinoma, or a combination thereof. In one embodiment, the lung cancer is NSCLC or SCC.

In one embodiment, the anti-cancer agent is a kinase inhibitor. For example, the kinase inhibitor is a multi-kinase inhibitor or an ERBB4-specific inhibitor. In one embodiment, the kinase inhibitor is an ERBB4 inhibitor including, but not limited to, AST-1306; or dacamitinib (PF299804). In certain embodiments, the ERBB4 inhibitor is an ERBB4 inhibitor described herein.

DOT1L-MYST3 Fusions

In one embodiment, a fusion includes an in-frame fusion of an exon of DOT1-like histone H3 methyltransferase (DOT1L), e.g., one more exons of DOT1L (e.g., one or more of exons 1-18 of DOT1L) or a fragment thereof, and an exon of monocytic leukemia zinc finger protein (MYST3) (also known as KAT6A), e.g., one or more exons of a MYST3 (e.g., one or more of exons 3-17 of MYST3) or a fragment thereof. For example, the DOT1L-MYST3 fusion can include an in-frame fusion within an intron of DOT1L (e.g., intron 18) or a fragment thereof, with an intron of MYST3 (e.g., intron 2) or a fragment thereof. In one embodiment, the fusion of the DOT1L-MYST3 fusion comprises the nucleotide sequence of: chromosome 19 at one or more of nucleotide 2,214,550 (plus or minus 10, 20, 30, 50, 60, 70, 80, 100 or more nucleotides) and chromosome 8 at one or more of nucleotide 41,904,252 (plus or minus 10, 20, 30, 50, 60, 70, 80, 100 or more nucleotides). In one embodiment, the DOT1L-MYST3 fusion is a translocation, e.g., a translocation of a portion of chromosome 19 or a portion of chromosome 8.

In certain embodiments, the DOT1L-MYST3 fusion is in a 5'-DOT1L to 3'-MYST3 configuration (also referred herein as "5'-DOT1L-MYST3-3')." The term "fusion" or "fusion molecule" can refer to a polypeptide or a nucleic acid fusion, depending on the context. It may include a full-length sequence of a fusion or a fragment thereof, e.g., a fusion junction (e.g., a fragment including a portion of DOT1L and a portion of MYST3, e.g., a portion of the DOT1L-MYST3 fusion described herein). In one embodiment, the DOT1L-MYST3 fusion polypeptide includes a fragment of the amino acid sequence shown in FIG. 40 (SEQ ID NO:40) and a fragment of the amino acid sequence shown in FIG. 42 (SEQ ID NO:42), or an amino acid sequence substantially identical thereto. In another embodiment, the DOT1L-MYST3 fusion nucleic acid includes a fragment of the nucleotide sequence shown in FIGS. 39A-39C (SEQ ID NO:39) and a fragment of the nucleotide sequence shown in FIGS. 41A-41D (SEQ ID NO:41), or a nucleotide sequence substantially identical thereto. In one embodiment, the DOT1L-MYST3 fusion polypeptide comprises sufficient DOT1L and sufficient MYST3 sequence such that the 5' DOT1L-3' MYST3 fusion has kinase activity, e.g., has elevated activity, e.g., tyrosine kinase activity, as compared with wild type, e.g., in a cell of a cancer referred to herein (e.g., adenocarcinoma, e.g., lung adenocarcinoma). In one embodiment, the DOT1L-MYST3 fusion polypeptide comprises sufficient DOT1L and sufficient MYST3 sequence such that the 5' DOT1L-3' MYST3 fusion has methyltransferase activity, e.g., has elevated activity, e.g., DOT1L methyltransferase activity, as compared with wild type DOT1L, e.g., in a cell of a cancer referred to herein (e.g., adenocarcinoma, e.g., lung adenocarcinoma).

In certain embodiments, the DOT1L-MYST3 fusion comprises one or more (or all of) exons 1-18 from DOT1L and one or more (or all of) exons 3-17 of MYST3 (e.g., one or more of the exons shown in FIGS. 39A-39C (SEQ ID NO:39) and FIGS. 41A-41D (SEQ ID NO:41). In another embodiment, the DOT1L-MYST3 fusion comprises one or more (or all of) exons 1-18 of DOT1L and one or more (or all of) exons 3-17 of MYST3. In certain embodiments, the DOT1L-MYST3 fusion comprises at least 1, 2, 3, 4, 5, 6, 7, 8, 9, 10, 11, 12, 13, 14, 15, 16, 17, 18 or more exons (or encoded exons) from DOT1L and at least 1, 2, 3, 4, 5, 6, 7, 8, 9, 10, 11, 12, 13, 14 or more exons (or encoded exons) from MYST3 (e.g., from the DOT1L and MYST3 sequences shown in FIGS. 39A-39C and FIG. 40 (SEQ ID NO:39 and 40) and FIGS. 41A-41D and FIG. 42 (SEQ ID NOs:41 and 42).

In certain embodiments, the DOT1L-MYST3 fusion comprises exon 18 or a fragment thereof from DOT1L, and exon 3 or a fragment thereof from MYST3 (e.g., as shown in FIGS. 39A-39C (SEQ ID NO:39) and FIGS. 41A-41D (SEQ ID NO:41)). In one embodiment, the DOT1L-MYST3 fusion comprises at least 5, 10, 15, 20, 30, 40, 50 or more amino acids from exon 18 of DOT1L (e.g., from the amino acid sequence of DOT1L as shown in FIG. 40 (SEQ ID NO:40) (e.g., from the amino acid sequence of DOT1L preceding the fusion junction with MYST3, and at least 5, 10, 15, 20, 30, 40, 50 or more amino acids from exon 3 of MYST3 (e.g., from the amino acid sequence of MYST3 as shown in FIG. 42 (SEQ ID NO:42)). In another embodiment, the DOT1L-MYST3 fusion comprises at least 6, 12, 15, 20, 25, 50, 75, 100 or more nucleotides from exon 18 of DOT1L (e.g., from the nucleotide sequence of DOT1L as shown in FIGS. 39A-39C (SEQ ID NO:39) (e.g., from the nucleotide sequence of DOT1L preceding the fusion junction with MYST3); and at least 6, 12, 15, 20, 25, 50, 75, 100 or more nucleotides from exon 3 of MYST3 (e.g., from the nucleotide sequence of MYST3 as shown in FIGS. 41A-41D (SEQ ID NO:41)).

DOT1L-MYST3 Nucleic Acid Molecules

In one aspect, the invention features a nucleic acid molecule (e.g., an isolated or purified) nucleic acid molecule that includes a fragment of a DOT1L gene and a fragment of a MYST3 gene. In one embodiment, the nucleotide sequence encodes a DOT1L-MYST3 fusion polypeptide that includes a tyrosine kinase domain or a functional fragment thereof. In another embodiment, the nucleotide sequence encodes a fragment of the MYST3 polypeptide including the amino acid sequence of SEQ ID NO:42 or a fragment thereof, or a sequence substantially identical thereto. In other embodiments, the nucleic acid molecule includes a fragment of the DOT1L gene encoding the amino acid sequence of SEQ ID NO:40 or a fragment thereof, or a sequence substantially identical thereto. In yet other embodiments, the nucleic acid molecule includes a nucleotide sequence encoding the amino acid sequence shown in FIG. 40 (SEQ ID NO:40), or a fragment thereof, and the amino acid sequence shown in FIG. 42 (SEQ ID NO:42) or a fragment thereof, or a sequence substantially identical thereto.

In one embodiment, the nucleic acid molecule includes a fusion, e.g., an in-frame fusion, between an intron of DOT1L (e.g., intron 18, or a fragment thereof), and an intron of MYST3 (e.g., intron 2, or a fragment thereof). The DOT1L-MYST3 fusion can comprise a fusion of the nucleotide sequence of: chromosome 19 at one or more of nucleotide 2,214,550 (plus or minus 10, 20, 30, 50, 60, 70, 80, 100 nucleotides) and chromosome 8 at one or more of nucleotide 41,904,252 (plus or minus 10, 20, 30, 50, 60, 70, 80, 100 nucleotides), or a fragment thereof. In one embodiment, the DOT1L-MYST3 fusion comprises a fusion of the nucleotide sequence of: chromosome 19 at one or more of nucleotide 2,214,550 (plus or minus 10, 20, 30, 50, 60, 70, 80, 100 nucleotides) and chromosome 8 at one or more of nucleotide 41,904,252 (plus or minus 10, 20, 30, 50, 60, 70, 80, 100 nucleotides), or a fragment thereof.

In another embodiment, the DOT1L-MYST3 fusion comprises a nucleotide sequence (e.g., a fragment of a nucleotide sequence) shown in FIGS. 39A-39C (SEQ ID NO:39) and a nucleotide sequence (e.g., a fragment of a nucleotide sequence) shown in FIGS. 41A-41D (SEQ ID NO:41), or a fragment of the fusion. In one embodiment, the DOT1L-MYST3 fusion comprises a nucleotide sequence substantially identical to the nucleotide sequence (e.g., a fragment of a nucleotide sequence) shown in FIGS. 39A-39C (SEQ ID NO:39) and the nucleotide sequence (e.g., a fragment of a nucleotide sequence) shown FIGS. 41A-41D (SEQ ID NO:41), or a fragment of the fusion. In one embodiment, the DOT1L-MYST3 fusion comprises a nucleotide sequence at least 70%, at least 75%, at least 80%, at least 85%, at least 90%, at least 95%, at least 99%, at least 99.5 or greater, identical to the nucleotide sequence (e.g., a fragment of a nucleotide sequence) shown in FIGS. 39A-39C (SEQ ID NO:39) and to the nucleotide sequence (e.g., a fragment of a nucleotide sequence) shown in FIGS. 41A-41D (SEQ ID NO:41). In one embodiment, the DOT1L-MYST3 fusion comprises a nucleotide sequence containing at least 25, 50, 100, 150, 200, 500, 1000, 1500, 2000, 2500, 3000, or more nucleotides of the nucleotide sequence shown in FIGS. 39A-39C (SEQ ID NO:39) and a nucleotide sequence containing at least 25, 50, 100, 150, 200, 500, 1000, 1500, 2000, 2500, 3000, or more nucleotides of the nucleotide sequence shown in FIGS. 41A-41D (SEQ ID NO:41). In one embodiment, the DOT1L-MYST3 fusion comprises a nucleotide sequence containing at least 25, 50, 100, 150, 200, 500, 1000, 1500, 2000, 2500, 3000, or more contiguous nucleotides of the nucleotide sequence shown in FIGS. 39A-39C (SEQ ID NO:39) and a nucleotide sequence containing at least 25, 50, 100, 150, 200, 500, 1000, 1500, 2000, 2500, 3000, or more nucleotides of the nucleotide sequence shown in FIGS. 41A-41D (SEQ ID NO:41).

In another embodiment, the nucleic acid molecule includes a fusion, e.g., an in-frame fusion, of at least exon 18 of DOT1L or a fragment thereof (e.g., one or more of exons 1-18 of DOT1L or a fragment thereof), and at least exon 3 or a fragment thereof (e.g., one or more of exons 3-17 of MYST3 or a fragment thereof). In yet other embodiments, the nucleic acid molecule includes a fragment the nucleotide sequence shown in FIGS. 39A-39C (SEQ ID NO:39) and a fragment of the nucleotide sequence shown in FIGS. 41A-41D (SEQ ID NO:41) or a fragment of the fusion, or a sequence substantially identical thereto.

In one embodiment, the nucleic acid molecule is complementary to at least a portion of a nucleotide sequence disclosed herein, e.g., is capable of hybridizing under a stringency condition described herein to SEQ ID NO:39 and/or SEQ ID NO:41, or a fragment thereof. In yet another embodiment, the nucleic acid molecule hybridizes to a nucleotide sequence that is complementary to at least a portion of a nucleotide sequence disclosed herein, e.g., is capable of hybridizing under a stringency condition to a nucleotide sequence complementary to SEQ ID NO:39 and/or SEQ ID NO:41, or a fragment thereof. The nucleotide sequence of a cDNA encoding an exemplary 5' DOT1L-3' MYST3 fusion is shown in at least exon 18 (e.g., exons 1-18) of SEQ ID NO:39 and at least exon 3 (e.g., exons 3-17) of SEQ ID NO:41, and the predicted amino acid sequence is shown in the corresponding encoded exons of SEQ ID NO:40 and the corresponding encoded exons of SEQ ID NO:42, respectively.

In an embodiment the DOT1L-MYST3 nucleic acid molecule comprises sufficient DOT1L and sufficient MYST3 sequence such that the encoded 5' DOT1L-3' MYST3 fusion has kinase activity, e.g., has elevated activity, e.g., MYST3 kinase activity, as compared with wild type MYST3, e.g., in a cell of a cancer referred to herein. In certain embodiments, the 5' DOT1L-3' MYST3 fusion comprises exons 1-18 from DOT1L and exons 3-17 from MYST3. In certain embodiments, the DOT1L-MYST3 fusion comprises at least 1, 2, 3, 4, 5, 6, 7, 8, 9, 10, 11, 12, 13, 14, 15, 16, 17, 18 or more exons from DOT1L and at least 1, 2, 3, 4, 5, 6, 7, 8, 9, 10, 11, 12, 13, 14 or more, exons from MYST3. In certain embodiments, the DOT1L-MYST3 fusion comprises a fusion of exon 18 from DOT1L and exon 3 from MYST3. In another embodiment, the DOT1L-MYST3 fusion comprises at least 1, 2, 3, 4, 5, 6, 7, 8, 9, 10, 11, 12, 13, 14, 15, 16, 17, 18 exons from DOT1L; and at least 1, 2, 3, 4, 5, 6, 7, 8, 9, 10, 11, 12, 13, 14 exons from MYST3.

In one embodiment, the nucleic acid molecule includes a nucleotide sequence that has an in-frame fusion of intron 18 of DOT1L (e.g., NM_032482) with intron 2 of MYST3 (e.g., NM_006766). In another embodiment, the nucleic acid molecule includes a nucleotide sequence that includes a breakpoint. For example, the nucleic acid molecule includes a nucleotide sequence that includes the fusion junction between the DOT1L gene and the MYST3 gene, e.g., the breakpoint between intron 18 of DOT1L and intron 2 of MYST3. In other embodiments, the nucleic acid molecules includes a nucleotide sequence of one or more of nucleotide 2,214,550 of chromosome 19 coupled to (e.g., directly or indirectly juxtaposed to) one or more of nucleotide 41,904,252 of chromosome 8. In one embodiment, the nucleic acid molecule includes the nucleotide sequence of: chromosome 19 at one or more of nucleotide 2,214,550 plus or minus 10, 20, 30, 40 50, 60, 80, 100, 150 nucleotides and chromosome 8 at one or more of nucleotide 41,904,252 plus or minus 10, 20, 30, 40 50, 60, 80, 100, 150 nucleotides (corresponding to the breakpoint of a DOT1L-MYST3 fusion), or a fragment thereof, or a sequence substantially identical thereto. In one embodiment, the nucleic acid molecule is complementary to at least a portion of a nucleotide sequence disclosed herein, e.g., is capable of hybridizing under a stringency condition described herein to SEQ ID NO:39 and/or SEQ ID NO:41 or a fragment thereof. In yet other embodiment, the nucleic acid molecule hybridizes to a nucleotide sequence that is complementary to at least a portion of a nucleotide sequence disclosed herein, e.g., is capable of hybridizing under a stringency condition described herein to a nucleotide sequence complementary to SEQ ID NO:39 or 41 or a fragment thereof.

In another embodiment, the DOT1L-MYST3 fusion nucleic acid comprises at least 6, 12, 15, 20, 25, 50, 75, 100 or more nucleotides from exon 18 of DOT1L (e.g., from the nucleotide sequence of DOT1L preceding the fusion junction with MYST3, e.g., of the DOT sequence shown in FIGS. 39A-39C (SEQ ID NO:39)), and at least 6, 12, 15, 20, 25, 50, 75, 100 or more nucleotides from exon 3 of MYST3 (e.g., from the nucleotide sequence of MYST3 following the fusion junction with DOT1L, e.g., of the MYST3 sequence shown in FIGS. 41A-41D (SEQ ID NO:41)).

In other embodiments, the nucleic acid molecule includes a nucleotide sequence encoding a DOT1L-MYST3 fusion polypeptide that includes a fragment of a DOT1L gene and a fragment of a MYST3 gene. In one embodiment, the nucleotide sequence encodes a DOT1L-MYST3 fusion polypeptide that includes e.g., a tyrosine kinase domain or a functional fragment thereof. In yet other embodiments, the nucleic acid molecule includes a nucleotide sequence encoding the amino acid sequence (e.g., a fragment of the amino acid sequence) shown in FIG. 40 (e.g., SEQ ID NO:40) and a nucleotide sequence encoding the amino acid sequence (e.g., a fragment of the amino acid sequence) shown in FIG. 42 (e.g., SEQ ID NO:42), or a fragment of the fusion, or a sequence substantially identical thereto. In one embodiment, the encoded DOT1L-MYST3 fusion polypeptide includes a tyrosine kinase domain or a functional fragment thereof.

In a related aspect, the invention features nucleic acid constructs that include the DOT1L-MYST3 nucleic acid molecules described herein. In certain embodiments, the nucleic acid molecules are operatively linked to a native or a heterologous regulatory sequence. Also included are vectors and host cells that include the DOT1L-MYST3 nucleic acid molecules described herein, e.g., vectors and host cells suitable for producing the nucleic acid molecules and polypeptides described herein.

In a related aspect, methods of producing the nucleic acid molecules and polypeptides described herein are also described.

In another aspect, the invention features nucleic acid molecules that reduce or inhibit the expression of a nucleic acid molecule that encodes a DOT1L-MYST3 fusion described herein. Examples of such nucleic acid molecules include, for example, antisense molecules, ribozymes, RNAi, triple helix molecules that hybridize to a nucleic acid encoding DOT1L-MYST3, or a transcription regulatory region of DOT1L-MYST3, and blocks or reduces mRNA expression of DOT1L-MYST3.

Nucleic Acid Detection and Capturing Reagents

The invention also features a nucleic acid molecule, e.g., nucleic acid fragment, suitable as probe, primer, bait or library member that includes, flanks, hybridizes to, which are useful for identifying, or are otherwise based on, the DOT1L-MYST3 fusions described herein. In certain embodiments, the probe, primer or bait molecule is an oligonucleotide that allows capture, detection or isolation of a DOT1L-MYST3 fusion nucleic acid molecule described herein. The oligonucleotide can comprise a nucleotide sequence substantially complementary to a fragment of the DOT1L-MYST3 fusion nucleic acid molecules described herein. The sequence identity between the nucleic acid fragment, e.g., the oligonucleotide, and the target DOT1L-MYST3 sequence need not be exact, so long as the sequences are sufficiently complementary to allow the capture, detection or isolation of the target sequence. In one embodiment, the nucleic acid fragment is a probe or primer that includes an oligonucleotide between about 5 and 25, e.g., between 10 and 20, or 10 and 15 nucleotides in length. In other embodiments, the nucleic acid fragment is a bait that includes an oligonucleotide between about 100 to 300 nucleotides, 130 and 230 nucleotides, or 150 and 200 nucleotides, in length.

In one embodiment, the nucleic acid fragment can be used to identify or capture, e.g., by hybridization, a DOT1L-MYST3 fusion. For example, the nucleic acid fragment can be a probe, a primer, or a bait, for use in identifying or capturing, e.g., by hybridization, a DOT1L-MYST3 fusion described herein. In one embodiment, the nucleic acid fragment can be useful for identifying or capturing a DOT1L-MYST3 breakpoint, e.g., the nucleotide sequence of: chromosome 19 at nucleotide 2,214,550 plus or minus 10, 20, 30, 40, 50, 60, 80, 100, 150 nucleotides and chromosome 8 at nucleotide 41,904,252 plus or minus 10, 20, 30, 40 50, 60, 80, 100, 150 nucleotides.

In one embodiment, the nucleic acid fragment hybridizes to a nucleotide sequence within a chromosomal rearrangement that creates an in-frame fusion of intron 18 of DOT1L with intron 2 of MYST3. In one embodiment, the nucleic acid fragment hybridizes to a nucleotide sequence in the region In other embodiments, the nucleic acid molecules includes a nucleotide sequence in the region of nucleotides 2,214,550 of chromosome 19 coupled to (e.g., juxtaposed to) nucleotides in the region of nucleotides 41,904,252 of chromosome 8. In one embodiment, the nucleic acid fragment hybridizes to a nucleotide sequence that includes a breakpoint, e.g., the nucleotide sequence of: chromosome 19 at nucleotide 2,214,550 plus or minus 10, 20, 30, 40 50, 60, 80, 100, 150 or more nucleotides and chromosome 8 at nucleotide 41,904,252 plus or minus 10, 20, 30, 40 50, 60, 80, 100, 150 or more nucleotides. For example, the nucleic acid fragment can hybridize to a nucleotide sequence that includes the fusion junction between the DOT1L gene and the MYST3 gene, e.g., a nucleotide sequence that includes a portion of a nucleotide sequence within intron 18 of a DOT1L gene and intron 2 of a MYST3 gene.

In another embodiment, the nucleic acid fragment hybridizes to a nucleotide sequence that comprises at least 6, 12, 15, 20, 25, 50, 75, 100, 150 or more nucleotides from exon 18 of DOT1L (e.g., from the nucleotide sequence of DOT1L preceding the fusion junction with MYST3, e.g., of the DOT1L sequence shown in FIGS. 39A-39C (SEQ ID NO:39)), and at least 6, 12, 15, 20, 25, 50, 75, 100, 150 or more nucleotides from exon 3 of MYST3 (e.g., from the nucleotide sequence of MYST3 following the fusion junction with DOT1L, e.g., of the MYST3 sequence shown in FIGS. 41A-41D (SEQ ID NO:41)).

The probes or primers described herein can be used, for example, for FISH detection or PCR amplification. In one exemplary embodiment where detection is based on PCR, amplification of the DOT1L-MYST3 fusion junction fusion junction can be performed using a primer or a primer pair, e.g., for amplifying a sequence flanking the fusion junctions described herein, e.g., the mutations or the junction of a chromosomal rearrangement described herein, e.g., DOT1L-MYST3.

In one embodiment, a pair of isolated oligonucleotide primers can amplify a region containing or adjacent to a position in the DOT1L-MYST3 fusion. For example, forward primers can be designed to hybridize to a nucleotide sequence within DOT1L genomic or mRNA sequence (e.g., a nucleotide sequence within exon 18 of DOT1L of SEQ ID NO:39), and the reverse primers can be designed to hybridize to a nucleotide sequence of MYST3 (e.g., a nucleotide sequence within exon 3 of MYST3, of SEQ ID NO:41).

In another embodiment, the nucleic acid fragments can be used to identify, e.g., by hybridization, a DOT1L-MYST3 fusion. In one embodiment, the nucleic acid fragment hybridizes to a nucleotide sequence that includes a fusion junction between the DOT1L transcript and the MYST3 transcript.

In other embodiments, the nucleic acid fragment includes a bait that comprises a nucleotide sequence that hybridizes to a DOT1L-MYST3 fusion nucleic acid molecule described herein, and thereby allows the capture or isolation said nucleic acid molecule. In one embodiment, a bait is suitable for solution phase hybridization. In other embodiments, a bait includes a binding entity, e.g., an affinity tag, that allows capture and separation, e.g., by binding to a binding entity, of a hybrid formed by a bait and a nucleic acid hybridized to the bait.

In other embodiments, the nucleic acid fragment includes a library member comprising a DOT1L-MYST3 nucleic acid molecule described herein. In one embodiment, the library member includes a rearrangement that results in a DOT1L-MYST3 fusion described herein.

The nucleic acid fragment can be detectably labeled with, e.g., a radiolabel, a fluorescent label, a bioluminescent label, a chemiluminescent label, an enzyme label, a binding pair label, or can include an affinity tag; a tag, or identifier (e.g., an adaptor, barcode or other sequence identifier).

DOT1L-MYST3 Fusion Polypeptides

In another embodiment, the DOT1L-MYST3 fusion comprises an amino acid sequence (e.g., a fragment of the amino acid sequence) shown in FIG. 40 (SEQ ID NO:40) and an amino acid sequence (e.g., a fragment of the amino acid sequence) shown in FIG. 42 (SEQ ID NO:42), or a fragment of the fusion. In one embodiment, the DOT1L-MYST3 fusion comprises an amino acid sequence substantially identical to the amino acid sequence (e.g., a fragment of the amino acid sequence) shown in FIG. 40 (SEQ ID NO:40) and the amino acid sequence (e.g., a fragment of the amino acid sequence) shown in FIG. 42 (SEQ ID NO:42), or a fragment thereof. In one embodiment, the DOT1L-MYST3 fusion comprises an amino acid sequence at least 70%, at least 75%, at least 80%, at least 85%, at least 90%, at least 95%, at least 99%, at least 99.5 or greater, identical to the amino acid sequence (e.g., a fragment of the amino acid sequence) shown in FIG. 40 (SEQ ID NO:40) and the amino acid sequence (e.g., a fragment of the amino acid sequence) shown in FIG. 42 (SEQ ID NO:42). In one embodiment, the DOT1L-MYST3 fusion comprises a sequence containing at least 10, 20, 50, 100, 500, 600, 700, 800, 900, 1000, or more amino acids of the amino acid sequence shown in FIG. 40 (SEQ ID NO:40) and FIG. 42 (SEQ ID NO:42). In one embodiment, the DOT1L-MYST3 fusion comprises an amino acid sequence containing at least 5, 10, 20, 50, 100, 500, 600, 700, 800, 900, 1000, or more contiguous amino acids of the amino acid sequence shown in FIG. 40 (SEQ ID NO:40) and at least 5, 10, 20, 50, 100, 500, 600, 700, 800, 900, 1000, or more contiguous amino acids of the amino acid sequence shown in FIG. 42 (SEQ ID NO:42). In one embodiment, the 5' DOT1L-3' MYST3 fusion polypeptide includes a receptor tyrosine kinase domain or a functional fragment thereof. In an embodiment, the 5'DOT1L-3'MYST3 fusion polypeptide comprises sufficient MYST3 and sufficient DOT1L sequence such that it has kinase activity, e.g., has elevated activity, e.g., MYST3 kinase activity, as compared with wild type MYST3, e.g., in a cell of a cancer referred to herein.

In another aspect, the invention features a DOT1L-MYST3 fusion polypeptide (e.g., a purified DOT1L-MYST3 fusion polypeptide), a biologically active or antigenic fragment thereof, as well as reagents (e.g., antibody molecules that bind to a DOT1L-MYST3 fusion polypeptide), methods for modulating a DOT1L-MYST3 polypeptide activity and detection of a DOT1L-MYST3 polypeptide.

In one embodiment, the DOT1L-MYST3 fusion polypeptide has at least one biological activity. In one embodiment, at least one biological activity of the DOT1L-MYST3 fusion polypeptide is reduced or inhibited by an anti-cancer drug, e.g., a DOT1L inhibitor, a MYST3 inhibitor. In one embodiment, at least one biological activity of the DOT1L-MYST3 fusion polypeptide is reduced or inhibited by a MYST3 inhibitor. In one embodiment, at least one biological activity of the DOT1L-MYST3 fusion polypeptide is reduced or inhibited by an DOT1L inhibitor.

In yet other embodiments, the DOT1L-MYST3 fusion polypeptide is encoded by a nucleic acid molecule described herein. In one embodiment, the DOT1L-MYST3 fusion polypeptide is encoded by an in-frame fusion of intron 18 of DOT1L with intron 2 of MYST3 (e.g., a sequence on chromosome 19 and a sequence on chromosome 8). In another embodiment, the DOT1L-MYST3 fusion polypeptide includes an amino acid sequence encoded by a nucleotide sequence comprising a fusion junction between the DOT1L transcript and the MYST3 transcript.

In certain embodiments, the DOT1L-MYST3 fusion polypeptide comprises one or more of encoded exons 1-18 from DOT1L and one or more of encoded exons 3-17 of MYST3. In certain embodiments, the DOT1L-MYST3 fusion polypeptide comprises at least 1, 2, 3, 4, 5, 6, 7, 8, 9, 10, 11, 12, 13, 14, 15, 16, 17, 18 or more encoded exons from DOT1L and at least 1, 2, 3, 4, 5, 6, 7, 8, 9, 10, 11, 12, 13, 14 or more, encoded exons from MYST3. In certain embodiments, the DOT1L-MYST3 fusion polypeptide comprises a fusion of encoded exon 18 from DOT1L and encoded exon 3 from MYST3 (or a fragment thereof). In other embodiments, the fusion comprises least 1, 2, 3, 4, 5, 6, 7, 8, 9, 10, 11, 12, 13, 14, 15, 16, 17, 18 encoded exons from DOT1L; and at least 1, 2, 3, 4, 5, 6, 7, 8, 9, 10, 11, 12, 13, 14 encoded exons from MYST3. In certain embodiments, the DOT1L-MYST3 fusion polypeptide comprises encoded exons 1-18 from DOT1L and exons 3-17 of MYST3. In certain embodiments, the 5' DOT1L-3' MYST3 fusion polypeptide comprises a fusion junction of the sequence of exon 18 from DOT1L and the sequence of exon 3 from MYST3.

In certain embodiments, the DOT1L-MYST3 fusion comprises the amino acid sequence corresponding to exon 18 or a fragment thereof from DOT1L, and the amino acid sequence corresponding to exon 3 or a fragment thereof from MYST3 (e.g., as shown in FIG. 40 (SEQ ID NO:40) and FIG. 42 (SEQ ID NO:42)). In one embodiment, the DOT1L-MYST3 fusion comprises at least 5, 10, 15, 20 or more amino acids from exon 18 of DOT1L (e.g., from the amino acid sequence of DOT1L preceding the fusion junction with MYST3, e.g., of the DOT1L sequence shown in FIG. 40 (SEQ ID NO:40)), and at least 5, 10, 15, 20 or more amino acids from exon 3 of MYST3 (e.g., from the amino acid sequence of MYST3 following the fusion junction with DOT1L, e.g., of the MYST3 sequence shown in FIG. 42 (SEQ ID NO:42)).

In one embodiment, the DOT1L-MYST3 fusion polypeptide includes a tyrosine kinase domain or a functional fragment thereof. In a related aspect, the invention features DOT1L-MYST3 fusion polypeptide or fragments operatively linked to heterologous polypeptides to form fusion proteins.

In another embodiment, the DOT1L-MYST3 fusion polypeptide or fragment is a peptide, e.g., an immunogenic peptide or protein, that contains a fusion junction described herein. Such immunogenic peptides or proteins can be used to raise antibodies specific to the fusion protein. In other embodiments, such immunogenic peptides or proteins can be used for vaccine preparation. The vaccine preparation can include other components, e.g., an adjuvant.

In another aspect, the invention features antibody molecules that bind to a DOT1L-MYST3 fusion polypeptide or fragment described herein. In embodiments, the antibody can distinguish wild type MYST3 (or DOT1L) from DOT1L-MYST3.

Detection Reagents and Detection of Mutations

In another aspect, the invention features a detection reagent, e.g., a purified or an isolated preparation thereof. Detection reagents can distinguish a nucleic acid, or protein sequence, having a breakpoint, e.g., a DOT1L-MYST3 breakpoint; from a reference sequence. In one embodiment, the detection reagent detects (e.g., specifically detects) a DOT1L-MYST3 fusion nucleic acid or a polypeptide (e.g., distinguishes a wild type MYST3 or another MYST3 fusion (or DOT1L) from a DOT1L-MYST3 nucleic acid (e.g., as described herein in FIGS. 39A-39C (SEQ ID NO:39) and FIGS. 41A-41D (SEQ ID NO:41); or a DOT1L-MYST3 polypeptide (e.g., as described herein in FIG. 40 (SEQ ID NO:40) and FIG. 42 (SEQ ID NO:42).

Detection reagents, e.g., nucleic acid-based detection reagents, can be used to identify mutations in a target nucleic acid, e.g., DNA, e.g., genomic DNA or cDNA, or RNA, e.g., in a sample, e.g., a sample of nucleic acid derived from a neoplastic or tumor cell, e.g., a melanocytic neoplasm, melanoma or metastatic cell. Detection reagents, e.g., antibody-based detection reagents, can be used to identify mutations in a target protein, e.g., in a sample, e.g., a sample of protein derived from, or produced by, a neoplastic or tumor cell, e.g., a melanocytic neoplasm, melanoma or metastatic cell.

Method of Treatment

DOT1L encodes a histone methyltransferase, responsible for the methylation of histone H3 at lysine 79 (Feng Q, Wang H, Ng H H, et al. (2002) Methylation of H3-lysine 79 is mediated by a new family of HMTases without a SET domain. Curr Biol 12(12):1052-8). DOT1L has been implicated as an effector in mixed lineage leukemia (MLL); it has been shown to interact with MLL fusion partners and can induce leukemic transformation when fused to MLL (Okada Y, Feng Q, Lin Y, et al. (2005) hDOT1L links histone methylation to leukemogenesis. Cell 121(2):167-78). MYST3, also known as KAT6A and MOZ, encodes a histone acetyltransferase, which has also been implicated in leukemia (Borrow J, Stanton V P, Andresen J M, et al. (1996) The translocation t(8; 16)(p11; p13) of acute myeloid leukaemia fuses a putative acetyltransferase to the CREB-binding protein. Nat Genet 14(1):33-41). A t(8; 16)(p11; p13) translocation fuses MYST3 at 8p11 to another histone acetyltransferase, CREBBP, at 16p13, resulting in acute myelocytic or monocytic leukemia (Murati A, Gervais C, Carbuccia N, et al. (2009) Genome profiling of acute myelomonocytic leukemia: alteration of the MYB locus in MYST3-linked cases. Leukemia 23(1):85-94). The rearrangement seen in this tumor results in the fusion of the 5' end of DOT1L (exons 1-18) to the majority of MYST3 (exon 3-C-terminus). This region of DOT1L contains the functional histone methyltransferase activity (amino acids 1-472) and is expected to retain activity (Feng Q, Wang H, Ng H H, et al. (2002) Methylation of H3-lysine 79 is mediated by a new family of HMTases without a SET domain. Curr Biol 12(12):1052-8). MYST3 also retains all functional domains, including two PHD domains and the catalytic domain (uniprot.org), and is likely to remain active. Both of these genes have been implicated in the development of leukemia. Neither DOT1L nor MYST3 rearrangements have been previously reported in lung adenocarcinoma, however, one study in lung cancer cells demonstrated that lung cancer cells have elevated levels of methylated histone H3 at lysine 79 (H3K79Me); depletion of Dot1L with siRNA resulted in a reduction in H3K79Me, and led to a reduction in cell proliferation, due to disruption of the cell division cycle (Kim W, Kim R, Park G, et al. (2012) Deficiency of H3K79 histone methyltransferase Dot1-like protein (DOT1L) inhibits cell proliferation. J Biol Chem 287(8):5588-99). These results suggest that elevated Dot1L activity could play a role in lung tumorigenesis, and that Dot1L could be a therapeutic target. Treatment of cells bearing MLL fusions with shRNA targeting Dot1L has led to growth arrest and apoptosis in preclinical studies (Krivtsov A V, Feng Z, Lemieux M E, et al. (2008) H3K79 methylation profiles define murine and human MLL-AF4 leukemias. Cancer Cell 14(5):355-68, Bernt K M, Zhu N, Sinha A U, et al. (2011) MLL-rearranged leukemia is dependent on aberrant H3K79 methylation by DOT1L. Cancer Cell 20(1):66-78), and preclinical studies to search for inhibitors of Dot1L are in progress (Daigle S R, Olhava E J, Therkelsen C A, et al. (2011) Selective killing of mixed lineage leukemia cells by a potent small-molecule DOT1L inhibitor. Cancer Cell 20(1):53-65). MYST3 may also be a therapeutic target. A recent preclinical study identified a number of candidate molecules in a high-throughput screen for inhibitors of MYST3 activity (Falk H, Connor T, Yang H, et al. (2011) An efficient high-throughput screening method for MYST family acetyltransferases, a new class of epigenetic drug targets. J Biomol Screen 16(10):1196-205).

Accordingly, in another aspect, a method of inhibiting, reducing, or treating a hyperproliferative disorder, e.g., a neoplasm (including benign, pre-malignant or malignant (e.g., a cancer), in a subject is provided. The method includes administering to the subject a preselected therapeutic agent, e.g., an anti-cancer agent (e.g., a kinase inhibitor), as a single agent, or in combination, in an amount sufficient to reduce, inhibit or treat the activity or expression of DOT1L-MYST3 (e.g., a DOT1L-MYST3 fusion described herein), thereby inhibiting, reducing, or treating the hyperproliferative disorder in the subject.

In one embodiment, the subject treated has a DOT1L-MYST3 fusion; e.g., the subject has a tumor or cancer harboring a DOT1L-MYST3 fusion. In other embodiments, the subject has been previously identified as having a DOT1L-MYST3 fusion. In yet other embodiments, the subject has been previously identified as being likely or unlikely to respond to treatment with a protein kinase inhibitor, e.g., a subject that has previously participated in a clinical trial. In other embodiments, the subject has been previously identified as being likely or unlikely to respond to treatment with a protein kinase inhibitor, based on the presence of the DOT1L-MYST3 fusion. In one embodiment, the subject is a mammal, e.g., a human. In one embodiment, the subject has, or at risk of having a cancer at any stage of disease. In other embodiments, the subject is a patient, e.g., a cancer patient.

In certain embodiments, the neoplasm or neoplastic cell is a benign, pre-malignant, malignant (cancer) or metastasis. In certain embodiments, the cancer is a solid tumor, a soft tissue tumor, or a metastatic lesion.

In one embodiment, the neoplasm or neoplastic cell is a benign, pre-malignant, malignant (cancer) or metastasis. In certain embodiments, the cancer is a solid tumor, a soft tissue tumor, or a metastatic lesion. In one embodiment, the cancer is an adenocarcinoma. In one embodiment, the cancer is a lung adenocarcinoma. In one embodiment, the cancer is chosen from a lung cancer, a pancreatic cancer, melanoma, a colorectal cancer, an esophageal-gastric cancer, a thyroid cancer, or an adenocarcinoma. In one embodiment, the cancer is a lung adenocarcinoma. In other embodiment, the lung cancer is chosen from one or more of the following: non-small cell lung cancer (NSCLC), small cell lung cancer (SCLC), squamous cell carcinoma (SCC), adenocarcinoma of the lung, bronchogenic carcinoma, or a combination thereof. In one embodiment, the lung cancer is NSCLC or SCC.

In one embodiment, the anti-cancer agent is a MYST3 inhibitor. In one embodiment, the anti-cancer agent is a DOT1L inhibitor. In one embodiment, the anti-cancer agent is a kinase inhibitor. In certain embodiments, the MYST3 inhibitor is a MYST3 inhibitor described herein. In certain embodiments, the DOT1L inhibitor is a DOT1L inhibitor described herein.

SMAD4-MYO5B Fusions

In one embodiment, a fusion includes an in-frame fusion of an exon of mothers against decapentaplegic homolog 4 (SMAD4), e.g., one more exons of SMAD4 (e.g., one or more of exons 1-2 of SMAD4) or a fragment thereof, and an exon of myosin 5B (MYO5B), e.g., one or more exons of a MYO5B (e.g., one or more of exons 2-40 of MYO5B) or a fragment thereof. For example, the SMAD4-MYO5B fusion can include an in-frame fusion within an intron of SMAD4 (e.g., intron 2) or a fragment thereof, with an intron of MYO5B (e.g., intron 1) or a fragment thereof. In one embodiment, the fusion of the SMAD4-MYO5B fusion comprises the nucleotide sequence of: chromosome 18 at one or more of nucleotide 48,573,683 (plus or minus 10, 20, 30, 50, 60, 70, 80, 100 or more nucleotides) and chromosome 18 at one or more of nucleotide 47,682,520 (plus or minus 10, 20, 30, 50, 60, 70, 80, 100 or more nucleotides). In one embodiment, the SMAD4-MYO5B fusion is an inversion, e.g., an inversion of a portion of chromosome 18.

In certain embodiments, the SMAD4-MYO5B fusion is in a 5'-SMAD4 to 3'-MYO5B configuration (also referred to herein as "5'-SMAD4-MYO5B-3')." The term "fusion" or "fusion molecule" can refer to a polypeptide or a nucleic acid fusion, depending on the context. It may include a full-length sequence of a fusion or a fragment thereof, e.g., a fusion junction (e.g., a fragment including a portion of SMAD4 and a portion of MYO5B, e.g., a portion of the SMAD4-MYO5B fusion described herein). In one embodiment, the SMAD4-MYO5B fusion polypeptide includes a fragment of the amino acid sequence shown in FIG. 44 (SEQ ID NO:44) and a fragment of the amino acid sequence shown in FIG. 46 (SEQ ID NO:46), or an amino acid sequence substantially identical thereto. In another embodiment, the SMAD4-MYO5B fusion nucleic acid includes a fragment of the nucleotide sequence shown in FIGS. 43A-43D (SEQ ID NO:43) and a fragment of the nucleotide sequence shown in FIGS. 45A-45D (SEQ ID NO:45), or a nucleotide sequence substantially identical thereto. In one embodiment, the SMAD4-MYO5B fusion polypeptide comprises sufficient SMAD4 and sufficient MYO5B sequence such that the 5' SMAD4-3' MYO5B fusion has kinase activity, e.g., has elevated activity, e.g., tyrosine kinase activity, as compared with wild type, e.g., in a cell of a cancer referred to herein (e.g., adenocarcinoma, e.g., colorectal adenocarcinoma).

In certain embodiments, the SMAD4-MYO5B fusion comprises one or more (or all of) exons 1-2 from SMAD4 and one or more (or all of) exons 2-40 of MYO5B (e.g., one or more of the exons shown in FIGS. 43A-43D (SEQ ID NO:43) and FIGS. 45A-45D (SEQ ID NO:45). In another embodiment, the SMAD4-MYO5B fusion comprises one or more (or all of) exons 1-2 of SMAD4 and one or more (or all of) exons 2-40 of MYO5B. In certain embodiments, the SMAD4-MYO5B fusion comprises at least 1, 2 or more exons (or encoded exons) from SMAD4 and at least 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38 or more exons (or encoded exons) from MYO5B (e.g., from the SMAD4 and MYO5B sequences shown in FIGS. 43A-43D and FIG. 44 (SEQ ID NO:43 and 44) and FIGS. 45A-45D and FIG. 46 (SEQ ID NOs:45 and 46).

In certain embodiments, the SMAD4-MYO5B fusion comprises exon 2 or a fragment thereof from SMAD4, and exon 2 or a fragment thereof from MYO5B (e.g., as shown in FIGS. 43A-43D (SEQ ID NO:43) and FIGS. 45A-45D (SEQ ID NO:45)). In one embodiment, the SMAD4-MYO5B fusion comprises at least 5, 10, 15, 20, 30, 40, 50 or more amino acids from exon 2 of SMAD4 (e.g., from the amino acid sequence of SMAD4 as shown in FIG. 44 (SEQ ID NO:44) (e.g., from the amino acid sequence of SMAD4 preceding the fusion junction with MYO5B, and at least 5, 10, 15, 20, 30, 40, 50 or more amino acids from exon 2 of MYO5B (e.g., from the amino acid sequence of MYO5B as shown in FIG. 46 (SEQ ID NO:46)). In another embodiment, the SMAD4-MYO5B fusion comprises at least 6, 12, 15, 20, 25, 50, 75, 100 or more nucleotides from exon 2 of SMAD4 (e.g., from the nucleotide sequence of SMAD4 as shown in FIGS. 43A-43D (SEQ ID NO:43) (e.g., from the nucleotide sequence of SMAD4 preceding the fusion junction with MYO5B); and at least 6, 12, 15, 20, 25, 50, 75, 100 or more nucleotides from exon 2 of MYO5B (e.g., from the nucleotide sequence of MYO5B as shown in FIGS. 45A-45D (SEQ ID NO:45)).

SMAD4-MYO5B Nucleic Acid Molecules

In one aspect, the invention features a nucleic acid molecule (e.g., an isolated or purified) nucleic acid molecule that includes a fragment of a SMAD4 gene and a fragment of a MYO5B gene. In one embodiment, the nucleotide sequence encodes a SMAD4-MYO5B fusion polypeptide that includes a tyrosine kinase domain or a functional fragment thereof. In another embodiment, the nucleotide sequence encodes a fragment of the MYO5B polypeptide including the amino acid sequence of SEQ ID NO:46 or a fragment thereof, or a sequence substantially identical thereto. In other embodiments, the nucleic acid molecule includes a fragment of the SMAD4 gene encoding the amino acid sequence of SEQ ID NO:44 or a fragment thereof, or a sequence substantially identical thereto. In yet other embodiments, the nucleic acid molecule includes a nucleotide sequence encoding the amino acid sequence shown in FIG. 44 (SEQ ID NO:44), or a fragment thereof, and the amino acid sequence shown in FIG. 46 (SEQ ID NO:46) or a fragment thereof, or a sequence substantially identical thereto.

In one embodiment, the nucleic acid molecule includes a fusion, e.g., an in-frame fusion, between an intron of SMAD4 (e.g., intron 2, or a fragment thereof), and an intron of MYO5B (e.g., intron 1, or a fragment thereof). The SMAD4-MYO5B fusion can comprise a fusion of the nucleotide sequence of: chromosome 18 at one or more of nucleotide 48,573,683 (plus or minus 10, 20, 30, 50, 60, 70, 80, 100 nucleotides) and chromosome 18 at one or more of nucleotide 47,682,520 (plus or minus 10, 20, 30, 50, 60, 70, 80, 100 nucleotides), or a fragment thereof. In one embodiment, the SMAD4-MYO5B fusion comprises a fusion of the nucleotide sequence of: chromosome 18 at one or more of nucleotide 48,573,683 (plus or minus 10, 20, 30, 50, 60, 70, 80, 100 nucleotides) and chromosome 18 at one or more of nucleotide 47,682,520 (plus or minus 10, 20, 30, 50, 60, 70, 80, 100 nucleotides), or a fragment thereof.

In another embodiment, the SMAD4-MYO5B fusion comprises a nucleotide sequence (e.g., a fragment of a nucleotide sequence) shown in FIGS. 43A-43D (SEQ ID NO:43) and a nucleotide sequence (e.g., a fragment of a nucleotide sequence) shown in FIGS. 45A-45D (SEQ ID NO:45), or a fragment of the fusion. In one embodiment, the SMAD4-MYO5B fusion comprises a nucleotide sequence substantially identical to the nucleotide sequence (e.g., a fragment of a nucleotide sequence) shown in FIGS. 43A-43D (SEQ ID NO:43) and the nucleotide sequence (e.g., a fragment of a nucleotide sequence) shown FIGS. 45A-45C (SEQ ID NO:45), or a fragment of the fusion. In one embodiment, the SMAD4-MYO5B fusion comprises a nucleotide sequence at least 70%, at least 75%, at least 80%, at least 85%, at least 90%, at least 95%, at least 99%, at least 99.5 or greater, identical to the nucleotide sequence (e.g., a fragment of a nucleotide sequence) shown in FIGS. 43A-43D (SEQ ID NO:43) and to the nucleotide sequence (e.g., a fragment of a nucleotide sequence) shown in FIGS. 45A-45D (SEQ ID NO:45). In one embodiment, the SMAD4-MYO5B fusion comprises a nucleotide sequence containing at least 25, 50, 100, 150, 200, 500, 1000, 1500, 2000, 2500, 3000, or more nucleotides of the nucleotide sequence shown in FIGS. 43A-43D (SEQ ID NO:43) and a nucleotide sequence containing at least 25, 50, 100, 150, 200, 500, 1000, 1500, 2000, 2500, 3000, or more nucleotides of the nucleotide sequence shown in FIGS. 45A-45D (SEQ ID NO:45). In one embodiment, the SMAD4-MYO5B fusion comprises a nucleotide sequence containing at least 25, 50, 100, 150, 200, 500, 1000, 1500, 2000, 2500, 3000, or more contiguous nucleotides of the nucleotide sequence shown in FIGS. 43A-43D (SEQ ID NO:43) and a nucleotide sequence containing at least 25, 50, 100, 150, 200, 500, 1000, 1500, 2000, 2500, 3000, or more nucleotides of the nucleotide sequence shown in FIGS. 45A-45D (SEQ ID NO:45).

In another embodiment, the nucleic acid molecule includes a fusion, e.g., an in-frame fusion, of at least exon 2 of SMAD4 or a fragment thereof (e.g., one or more of exons 1-2 of SMAD4 or a fragment thereof), and at least exon 2 or a fragment thereof (e.g., one or more of exons 2-40 of MYO5B or a fragment thereof). In yet other embodiments, the nucleic acid molecule includes a fragment the nucleotide sequence shown in FIGS. 43A-43D (SEQ ID NO:43) and a fragment of the nucleotide sequence shown in FIGS. 45A-45D (SEQ ID NO:45) or a fragment of the fusion, or a sequence substantially identical thereto.

In one embodiment, the nucleic acid molecule is complementary to at least a portion of a nucleotide sequence disclosed herein, e.g., is capable of hybridizing under a stringency condition described herein to SEQ ID NO:43 and/or SEQ ID NO:45, or a fragment thereof. In yet another embodiment, the nucleic acid molecule hybridizes to a nucleotide sequence that is complementary to at least a portion of a nucleotide sequence disclosed herein, e.g., is capable of hybridizing under a stringency condition to a nucleotide sequence complementary to SEQ ID NO:43 and/or SEQ ID NO:45, or a fragment thereof. The nucleotide sequence of a cDNA encoding an exemplary 5' SMAD4-3' MYO5B fusion is shown in at least exon 2 (e.g., exons 1-2) of SEQ ID NO:43 and at least exon 2 (e.g., exons 2-40) of SEQ ID NO:45, and the predicted amino acid sequence is shown in the corresponding encoded exons of SEQ ID NO:44 and the corresponding encoded exons of SEQ ID NO:46, respectively.

In an embodiment the SMAD4-MYO5B nucleic acid molecule comprises sufficient SMAD4 and sufficient MYO5B sequence such that the encoded 5' SMAD4-3' MYO5B fusion has kinase activity, e.g., has elevated activity, e.g., MYO5B kinase activity, as compared with wild type MYO5B, e.g., in a cell of a cancer referred to herein. In certain embodiments, the 5' SMAD4-3' MYO5B fusion comprises exons 1-2 from SMAD4 and exons 2-40 from MYO5B. In certain embodiments, the SMAD4-MYO5B fusion comprises at least 1, 2 or more exons from SMAD4 and at least 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38 or more, exons from MYO5B. In certain embodiments, the SMAD4-MYO5B fusion comprises a fusion of exon 2 from SMAD4 and exon 2 from MYO5B. In another embodiment, the SMAD4-MYO5B fusion comprises at least 1, 2 exons from SMAD4; and at least 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38 exons from MYO5B.

In one embodiment, the nucleic acid molecule includes a nucleotide sequence that has an in-frame fusion of intron 2 of SMAD4 (e.g., NM_005359) with intron 1 of MYO5B (e.g., NM_001080467). In another embodiment, the nucleic acid molecule includes a nucleotide sequence that includes a breakpoint. For example, the nucleic acid molecule includes a nucleotide sequence that includes the fusion junction between the SMAD4 gene and the MYO5B gene, e.g., the breakpoint between intron 2 of SMAD4 and intron 1 of MYO5B. In other embodiments, the nucleic acid molecules includes a nucleotide sequence of one or more of nucleotide 48,573,683 of chromosome 18 coupled to (e.g., directly or indirectly juxtaposed to) one or more of nucleotide 47,682,520 of chromosome 18. In one embodiment, the nucleic acid molecule includes the nucleotide sequence of: chromosome 18 at one or more of nucleotide 48,573,683 plus or minus 10, 20, 30, 40 50, 60, 80, 100, 150 nucleotides and chromosome 18 at one or more of nucleotide 47,682,520 plus or minus 10, 20, 30, 40 50, 60, 80, 100, 150 nucleotides (corresponding to the breakpoint of a SMAD4-MYO5B fusion), or a fragment thereof, or a sequence substantially identical thereto. In one embodiment, the nucleic acid molecule is complementary to at least a portion of a nucleotide sequence disclosed herein, e.g., is capable of hybridizing under a stringency condition described herein to SEQ ID NO:43 and/or SEQ ID NO:45 or a fragment thereof. In yet other embodiment, the nucleic acid molecule hybridizes to a nucleotide sequence that is complementary to at least a portion of a nucleotide sequence disclosed herein, e.g., is capable of hybridizing under a stringency condition described herein to a nucleotide sequence complementary to SEQ ID NO:43 or 45 or a fragment thereof.

In another embodiment, the SMAD4-MYO5B fusion nucleic acid comprises at least 6, 12, 15, 20, 25, 50, 75, 100 or more nucleotides from exon 2 of SMAD4 (e.g., from the nucleotide sequence of SMAD4 preceding the fusion junction with MYO5B, e.g., of the SMAD4 sequence shown in FIGS. 43A-43D (SEQ ID NO:43)), and at least 6, 12, 15, 20, 25, 50, 75, 100 or more nucleotides from exon 2 of MYO5B (e.g., from the nucleotide sequence of MYO5B following the fusion junction with SMAD4, e.g., of the MYO5B sequence shown in FIGS. 45A-45D (SEQ ID NO:45)).

In other embodiments, the nucleic acid molecule includes a nucleotide sequence encoding a SMAD4-MYO5B fusion polypeptide that includes a fragment of a SMAD4 gene and a fragment of a MYO5B gene. In one embodiment, the nucleotide sequence encodes a SMAD4-MYO5B fusion polypeptide that includes e.g., a tyrosine kinase domain or a functional fragment thereof. In yet other embodiments, the nucleic acid molecule includes a nucleotide sequence encoding the amino acid sequence (e.g., a fragment of the amino acid sequence) shown in FIG. 44 (e.g., SEQ ID NO:44) and a nucleotide sequence encoding the amino acid sequence (e.g., a fragment of the amino acid sequence) shown in FIG. 46 (e.g., SEQ ID NO:46), or a fragment of the fusion, or a sequence substantially identical thereto. In one embodiment, the encoded SMAD4-MYO5B fusion polypeptide includes a tyrosine kinase domain or a functional fragment thereof.

In a related aspect, the invention features nucleic acid constructs that include the SMAD4-MYO5B nucleic acid molecules described herein. In certain embodiments, the nucleic acid molecules are operatively linked to a native or a heterologous regulatory sequence. Also included are vectors and host cells that include the SMAD4-MYO5B nucleic acid molecules described herein, e.g., vectors and host cells suitable for producing the nucleic acid molecules and polypeptides described herein.

In a related aspect, methods of producing the nucleic acid molecules and polypeptides described herein are also described.

In another aspect, the invention features nucleic acid molecules that reduce or inhibit the expression of a nucleic acid molecule that encodes a SMAD4-MYO5B fusion described herein. Examples of such nucleic acid molecules include, for example, antisense molecules, ribozymes, RNAi, triple helix molecules that hybridize to a nucleic acid encoding SMAD4-MYO5B, or a transcription regulatory region of SMAD4-MYO5B, and blocks or reduces mRNA expression of SMAD4-MYO5B.

Nucleic Acid Detection and Capturing Reagents

The invention also features a nucleic acid molecule, e.g., nucleic acid fragment, suitable as probe, primer, bait or library member that includes, flanks, hybridizes to, which are useful for identifying, or are otherwise based on, the SMAD4-MYO5B fusions described herein. In certain embodiments, the probe, primer or bait molecule is an oligonucleotide that allows capture, detection or isolation of a SMAD4-MYO5B fusion nucleic acid molecule described herein. The oligonucleotide can comprise a nucleotide sequence substantially complementary to a fragment of the SMAD4-MYO5B fusion nucleic acid molecules described herein. The sequence identity between the nucleic acid fragment, e.g., the oligonucleotide, and the target SMAD4-MYO5B sequence need not be exact, so long as the sequences are sufficiently complementary to allow the capture, detection or isolation of the target sequence. In one embodiment, the nucleic acid fragment is a probe or primer that includes an oligonucleotide between about 5 and 25, e.g., between 10 and 20, or 10 and 15 nucleotides in length. In other embodiments, the nucleic acid fragment is a bait that includes an oligonucleotide between about 100 to 300 nucleotides, 130 and 230 nucleotides, or 150 and 200 nucleotides, in length.

In one embodiment, the nucleic acid fragment can be used to identify or capture, e.g., by hybridization, a SMAD4-MYO5B fusion. For example, the nucleic acid fragment can be a probe, a primer, or a bait, for use in identifying or capturing, e.g., by hybridization, a SMAD4-MYO5B fusion described herein. In one embodiment, the nucleic acid fragment can be useful for identifying or capturing a SMAD4-MYO5B breakpoint, e.g., the nucleotide sequence of: chromosome 18 at nucleotide 48,573,683 plus or minus 10, 20, 30, 40, 50, 60, 80, 100, 150 nucleotides and chromosome 18 at nucleotide 47,682,520 plus or minus 10, 20, 30, 40 50, 60, 80, 100, 150 nucleotides.

In one embodiment, the nucleic acid fragment hybridizes to a nucleotide sequence within a chromosomal rearrangement that creates an in-frame fusion of intron 2 of SMAD4 with intron 1 of MYO5B. In one embodiment, the nucleic acid fragment hybridizes to a nucleotide sequence in the region In other embodiments, the nucleic acid molecules includes a nucleotide sequence in the region of nucleotides 48,573,683 of chromosome 18 coupled to (e.g., juxtaposed to) nucleotides in the region of nucleotides 47,682,520 of chromosome 18. In one embodiment, the nucleic acid fragment hybridizes to a nucleotide sequence that includes a breakpoint, e.g., the nucleotide sequence of: chromosome 18 at nucleotide 48,573,683 plus or minus 10, 20, 30, 40 50, 60, 80, 100, 150 or more nucleotides and chromosome 18 at nucleotide 47,682,520 plus or minus 10, 20, 30, 40 50, 60, 80, 100, 150 or more nucleotides. For example, the nucleic acid fragment can hybridize to a nucleotide sequence that includes the fusion junction between the SMAD4 gene and the MYO5B gene, e.g., a nucleotide sequence that includes a portion of a nucleotide sequence within intron 2 of a SMAD4 gene and intron 1 of a MYO5B gene.

In another embodiment, the nucleic acid fragment hybridizes to a nucleotide sequence that comprises at least 6, 12, 15, 20, 25, 50, 75, 100, 150 or more nucleotides from exon 2 of SMAD4 (e.g., from the nucleotide sequence of SMAD4 preceding the fusion junction with MYO5B, e.g., of the SMAD4 sequence shown in FIGS. 43A-43D (SEQ ID NO:43)), and at least 6, 12, 15, 20, 25, 50, 75, 100, 150 or more nucleotides from exon 2 of MYO5B (e.g., from the nucleotide sequence of MYO5B following the fusion junction with SMAD4, e.g., of the MYO5B sequence shown in FIGS. 45A-45D (SEQ ID NO:45)).

The probes or primers described herein can be used, for example, for FISH detection or PCR amplification. In one exemplary embodiment where detection is based on PCR amplification of the SMAD4-MYO5B fusion junction fusion junction can be performed using a primer or a primer pair, e.g., for amplifying a sequence flanking the fusion junctions described herein, e.g., the mutations or the junction of a chromosomal rearrangement described herein, e.g., SMAD4-MYO5B.

In one embodiment, a pair of isolated oligonucleotide primers can amplify a region containing or adjacent to a position in the SMAD4-MYO5B fusion. For example, forward primers can be designed to hybridize to a nucleotide sequence within SMAD4 genomic or mRNA sequence (e.g., a nucleotide sequence within exon 2 of SMAD4 of SEQ ID NO:43), and the reverse primers can be designed to hybridize to a nucleotide sequence of MYO5B (e.g., a nucleotide sequence within exon 2 of MYO5B, of SEQ ID NO:45).

In another embodiment, the nucleic acid fragments can be used to identify, e.g., by hybridization, a SMAD4-MYO5B fusion. In one embodiment, the nucleic acid fragment hybridizes to a nucleotide sequence that includes a fusion junction between the SMAD4 transcript and the MYO5B transcript.

In other embodiments, the nucleic acid fragment includes a bait that comprises a nucleotide sequence that hybridizes to a SMAD4-MYO5B fusion nucleic acid molecule described herein, and thereby allows the capture or isolation said nucleic acid molecule. In one embodiment, a bait is suitable for solution phase hybridization. In other embodiments, a bait includes a binding entity, e.g., an affinity tag, that allows capture and separation, e.g., by binding to a binding entity, of a hybrid formed by a bait and a nucleic acid hybridized to the bait.

In other embodiments, the nucleic acid fragment includes a library member comprising a SMAD4-MYO5B nucleic acid molecule described herein. In one embodiment, the library member includes a rearrangement that results in a SMAD4-MYO5B fusion described herein.

The nucleic acid fragment can be detectably labeled with, e.g., a radiolabel, a fluorescent label, a bioluminescent label, a chemiluminescent label, an enzyme label, a binding pair label, or can include an affinity tag; a tag, or identifier (e.g., an adaptor, barcode or other sequence identifier).

SMAD4-MYO5B Fusion Polypeptides

In another embodiment, the SMAD4-MYO5B fusion comprises an amino acid sequence (e.g., a fragment of the amino acid sequence) shown in FIG. 44 (SEQ ID NO:44) and an amino acid sequence (e.g., a fragment of the amino acid sequence) shown in FIG. 46 (SEQ ID NO:46), or a fragment of the fusion. In one embodiment, the SMAD4-MYO5B fusion comprises an amino acid sequence substantially identical to the amino acid sequence (e.g., a fragment of the amino acid sequence) shown in FIG. 44 (SEQ ID NO:44) and the amino acid sequence (e.g., a fragment of the amino acid sequence) shown in FIG. 46 (SEQ ID NO:46), or a fragment thereof. In one embodiment, the SMAD4-MYO5B fusion comprises an amino acid sequence at least 70%, at least 75%, at least 80%, at least 85%, at least 90%, at least 95%, at least 99%, at least 99.5 or greater, identical to the amino acid sequence (e.g., a fragment of the amino acid sequence) shown in FIG. 44 (SEQ ID NO:44) and the amino acid sequence (e.g., a fragment of the amino acid sequence) shown in FIG. 46 (SEQ ID NO:46). In one embodiment, the SMAD4-MYO5B fusion comprises a sequence containing at least 10, 20, 50, 100, 500, 600, 700, 800, 900, 1000, or more amino acids of the amino acid sequence shown in FIG. 44 (SEQ ID NO:44) and FIG. 46 (SEQ ID NO:46). In one embodiment, the SMAD4-MYO5B fusion comprises an amino acid sequence containing at least 5, 10, 20, 50, 100, 500, 600, 700, 800, 900, 1000, or more contiguous amino acids of the amino acid sequence shown in FIG. 44 (SEQ ID NO:44) and at least 5, 10, 20, 50, 100, 500, 600, 700, 800, 900, 1000, or more contiguous amino acids of the amino acid sequence shown in FIG. 46 (SEQ ID NO:46). In one embodiment, the 5' SMAD4-3' MYO5B fusion polypeptide includes a receptor tyrosine kinase domain or a functional fragment thereof. In an embodiment, the 5'SMAD4-3'MYO5B fusion polypeptide comprises sufficient MYO5B and sufficient SMAD4 sequence such that it has kinase activity, e.g., has elevated activity, e.g., MYO5B kinase activity, as compared with wild type MYO5B, e.g., in a cell of a cancer referred to herein.

In another aspect, the invention features a SMAD4-MYO5B fusion polypeptide (e.g., a purified SMAD4-MYO5B fusion polypeptide), a biologically active or antigenic fragment thereof, as well as reagents (e.g., antibody molecules that bind to a SMAD4-MYO5B fusion polypeptide), methods for modulating a SMAD4-MYO5B polypeptide activity and detection of a SMAD4-MYO5B polypeptide.

In one embodiment, the SMAD4-MYO5B fusion polypeptide has at least one biological activity. In one embodiment, at least one biological activity of the SMAD4-MYO5B fusion polypeptide is reduced or inhibited by an anti-cancer drug, e.g., a SMAD4 inhibitor, a MYO5B inhibitor. In one embodiment, at least one biological activity of the SMAD4-MYO5B fusion polypeptide is reduced or inhibited by a MYO5B inhibitor. In one embodiment, at least one biological activity of the SMAD4-MYO5B fusion polypeptide is reduced or inhibited by an SMAD4 inhibitor.

In yet other embodiments, the SMAD4-MYO5B fusion polypeptide is encoded by a nucleic acid molecule described herein. In one embodiment, the SMAD4-MYO5B fusion polypeptide is encoded by an in-frame fusion of intron 2 of SMAD4 with intron 1 of MYO5B (e.g., a sequence on chromosome 18 and a sequence on chromosome 18). In another embodiment, the SMAD4-MYO5B fusion polypeptide includes an amino acid sequence encoded by a nucleotide sequence comprising a fusion junction between the SMAD4 transcript and the MYO5B transcript.

In certain embodiments, the SMAD4-MYO5B fusion polypeptide comprises one or more of encoded exons 1-2 from SMAD4 and one or more of encoded exons 2-40 of MYO5B. In certain embodiments, the SMAD4-MYO5B fusion polypeptide comprises at least 1, 2 or more encoded exons from SMAD4 and at least 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38 or more, encoded exons from MYO5B. In certain embodiments, the SMAD4-MYO5B fusion polypeptide comprises a fusion of encoded exon 2 from SMAD4 and encoded exon 2 from MYO5B (or a fragment thereof). In other embodiments, the fusion comprises least 1, 2 encoded exons from SMAD4; and at least 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38 encoded exons from MYO5B. In certain embodiments, the SMAD4-MYO5B fusion polypeptide comprises encoded exons 1-2 from SMAD4 and exons 2-40 of MYO5B. In certain embodiments, the 5' SMAD4-3' MYO5B fusion polypeptide comprises a fusion junction of the sequence of exon 2 from SMAD4 and the sequence of exon 2 from MYO5B.

In certain embodiments, the SMAD4-MYO5B fusion comprises the amino acid sequence corresponding to exon 2 or a fragment thereof from SMAD4, and the amino acid sequence corresponding to exon 2 or a fragment thereof from MYO5B (e.g., as shown in FIG. 44 (SEQ ID NO:44) and FIG. 46 (SEQ ID NO:46)). In one embodiment, the SMAD4-MYO5B fusion comprises at least 5, 10, 15, 20 or more amino acids from exon 2 of SMAD4 (e.g., from the amino acid sequence of SMAD4 preceding the fusion junction with MYO5B, e.g., of the SMAD4 sequence shown in FIG. 44 (SEQ ID NO:44)), and at least 5, 10, 15, 20 or more amino acids from exon 2 of MYO5B (e.g., from the amino acid sequence of MYO5B following the fusion junction with SMAD4, e.g., of the MYO5B sequence shown in FIG. 46 (SEQ ID NO:46)).

In one embodiment, the SMAD4-MYO5B fusion polypeptide includes a tyrosine kinase domain or a functional fragment thereof. In a related aspect, the invention features SMAD4-MYO5B fusion polypeptide or fragments operatively linked to heterologous polypeptides to form fusion proteins.

In another embodiment, the SMAD4-MYO5B fusion polypeptide or fragment is a peptide, e.g., an immunogenic peptide or protein, that contains a fusion junction described herein. Such immunogenic peptides or proteins can be used to raise antibodies specific to the fusion protein. In other embodiments, such immunogenic peptides or proteins can be used for vaccine preparation. The vaccine preparation can include other components, e.g., an adjuvant.

In another aspect, the invention features antibody molecules that bind to a SMAD4-MYO5B fusion polypeptide or fragment described herein. In embodiments, the antibody can distinguish wild type MYO5B (or SMAD4) from SMAD4-MYO5B.

Detection Reagents and Detection of Mutations

In another aspect, the invention features a detection reagent, e.g., a purified or an isolated preparation thereof. Detection reagents can distinguish a nucleic acid, or protein sequence, having a breakpoint, e.g., a SMAD4-MYO5B breakpoint; from a reference sequence. In one embodiment, the detection reagent detects (e.g., specifically detects) a SMAD4-MYO5B fusion nucleic acid or a polypeptide (e.g., distinguishes a wild type MYO5B or another MYO5B fusion (or SMAD4) from a SMAD4-MYO5B nucleic acid (e.g., as described herein in FIGS. 43A-43D (SEQ ID NO:43) and FIGS. 45A-45D (SEQ ID NO:45); or a SMAD4-MYO5B polypeptide (e.g., as described herein in FIG. 44 (SEQ ID NO:44) and FIG. 46 (SEQ ID NO:46).

Detection reagents, e.g., nucleic acid-based detection reagents, can be used to identify mutations in a target nucleic acid, e.g., DNA, e.g., genomic DNA or cDNA, or RNA, e.g., in a sample, e.g., a sample of nucleic acid derived from a neoplastic or tumor cell, e.g., a melanocytic neoplasm, melanoma or metastatic cell. Detection reagents, e.g., antibody-based detection reagents, can be used to identify mutations in a target protein, e.g., in a sample, e.g., a sample of protein derived from, or produced by, a neoplastic or tumor cell, e.g., a melanocytic neoplasm, melanoma or metastatic cell.

Method of Treatment

The SMAD4-MYO5B fusion and amplification have been identified in multiple studies have demonstrated that Smad4 inactivation in colorectal cancer is associated with metastasis and poor outcome. Several groups have proposed that Smad4 loss specifically impairs the tumor suppressive portion of the TGF-β signaling pathway and converts TGF-β signaling into a promoter of tumorigenicity and metastasis, providing putative targets for therapy (Zhang J, Neisa R, Mao Y Oncogenic Adenomatous polyposis coli mutants impair the mitotic checkpoint through direct interaction with Mad2. Molecular biology of the cell 2009 May; 20(9):2381-8). SMAD4 encodes a signal transduction protein that is phosphorylated and activated in response to TGF-β signaling (Massagué J TGFbeta in Cancer. Cell 2008 Jul. 25; 134(2):215-30). Upon activation, Smad4 homodimerizes or heterodimerizes with other Smad family members and translocates to the nucleus where it activates the transcription of target genes that possess a Smad-binding element (SBE). Smad4 has been proposed to function as a tumor suppressor protein, since germline alterations in SMAD4 result in the juvenile polyposis syndrome (van Hattem W A, Langeveld D, de Leng W W, Morsink F H, van Diest P J, Iacobuzio-Donahue C A, Giardiello F M, Offerhaus G J, Brosens L A Histologic variations in juvenile polyp phenotype correlate with genetic defect underlying juvenile polyposis. The American journal of surgical pathology 2011 April; 35(4): 530-6), and the chromosomal region that contains SMAD4 (18q21) is commonly lost in sporadic colorectal cancer. MYO5B is an adjacent gene on chromosome 18q21 that encodes a protein that appears to be involved in plasma membrane recycling. Fusion of SMAD4 with MYO5B has not yet been reported. The SMAD4-MYO5B fusion is a novel alteration. Without being bound by theory, the attachment to Myo5b may mislocalize Smad4 and prevent it from activating transcription in the nucleus. In addition, given the ability of Smad4 to heterodimerize with other Smad family members, this fusion protein could exert a dominant negative effect on Smad signaling more generally, thus explaining its amplification.

SMAD4 mutation and deletion is common in colorectal cancer. Multiple studies have demonstrated that inactivation of Smad4 occurs frequently in colorectal cancer and tends to be associated with metastasis (Miyaki M, Iijima T, Konishi M, Sakai K, Ishii A, Yasuno M, Hishima T, Koike M, Shitara N, Iwama T, Utsunomiya J, Kuroki T, Mori T Higher frequency of Smad4 gene mutation in human colorectal cancer with distant metastasis. Oncogene 1999 May 20; 18(20):3098-103). It has also been proposed that loss of Smad4 specifically impairs the tumor suppressive portion of the TGF-β signaling pathway and shifts TGF-β signaling towards enhancing tumor cell survival and metastasis (Zhang J, Neisa R, Mao Y Oncogenic Adenomatous polyposis coli mutants impair the mitotic checkpoint through direct interaction with Mad2. Molecular biology of the cell 2009 May; 20(9):2381-8). Smad4 inactivation is also believed to promote tumorigenicity and metastasis of gastric cancer (Leng A, Liu T, He Y, Li Q, Zhang G Smad4/Smad7 balance: a role of tumorigenesis in gastric cancer. Experimental and molecular pathology 2009 August; 87(1):48-53), as well as pancreatic and head and neck cancer (Malkoski S P, Wang X J Two sides of the story? Smad4 loss in pancreatic cancer versus head-and-neck cancer. FEBS letters 2012 Feb. 3). Myo5b typically functions in controlling membrane recycling and epithelial polarization in conjunction with several RAB GTPase family members (Roland J T, Bryant D M, Datta A, Itzen A, Mostov K E, Goldenring J R Rab GTPase-Myo5B complexes control membrane recycling and epithelial polarization. Proceedings of the National Academy of Sciences of the United States of America 2011 Feb. 15; 108(7):2789-94). Germline mutations in Myo5b are associated with microvillus inclusion disease, which results in impaired enterocyte function (Szperl A M, Golachowska M R, Bruinenberg M, Prekeris R, Thunnissen A M, Karrenbeld A, Dijkstra G, Hoekstra D, Mercer D, Ksiazyk J, Wijmenga C, Wapenaar M C, Rings E H, van IJzendoorn S C Functional characterization of mutations in the myosin Vb gene associate d with microvillus inclusion disease. Journal of pediatric gastroenterology and nutrition 2011 March; 52(3):307-13). Inactivation of Myo5b was recently observed in gastric cancer specimens and shown to promote proliferation, invasion, and migration of gastric cancer cells (Dong W, Chen X, Chen P, Yue D, Zhu L, Fan Q Inactivation of MYO5B Promotes Invasion and Motility in Gastric Cancer Cells. Digestive diseases and sciences 2011 Dec. 2).

Multiple studies have demonstrated prognostic and predictive relevance of Smad4 inactivation in colorectal cancer. For example, one study demonstrated that median survival of patients with Smad4 negative tumors was 1.7 years, compared with over 9 years in Smad4 positive tumors (Alazzouzi H, Alhopuro P, Salovaara R, Sammalkorpi H, Järvinen H, Mecklin J P, Hemminki A, Schwartz S Jr, Aaltonen L A, Arango D SMAD4 as a prognostic marker in colorectal cancer. Clinical cancer research: an official journal of the American Association for Cancer Research 2005 Apr. 1; 11(7):2606-11). Similarly, examination of nuclear Smad4 levels using immunohistochemistry confirmed increased survival associated with Smad4 high tumors, particularly in patients that had undergone potentially curative surgery (Isaksson-Mettävainio M, Palmqvist R, Dahlin A M, Van Guelpen B, Rutegård J, Oberg A, Henriksson M L High SMAD4 levels appear in microsatellite instability and hypermethylated colon cancers, and indicate a better prognosis. International journal of cancer. Journal international du cancer 2011 Sep. 30). Smad4 loss has also been studied in association with high tumor stroma (Mesker W E, Liefers G J, Junggeburt J M, van Pelt G W, Alberici P, Kuppen P J, Miranda N F, van Leeuwen K A, Morreau H, Szuhai K, Tollenaar R A, Tanke H J Presence of a high amount of stroma and downregulation of SMAD4 predict for worse survival for stage I-II colon cancer patients. Cellular oncology: the official journal of the International Society for Cellular Oncology 2009; 31(3):169-78) and high Vegf-C levels (Li X, Liu B, Xiao J, Yuan Y, Ma J, Zhang Y Roles of VEGF-C and Smad4 in the lymphangiogenesis, lymphatic metastasis, and prognosis in colon cancer. Journal of gastrointestinal surgery: official journal of the Society for Surgery of the Alimentary Tract 2011 November; 15(11): 2001-10) as predictors for poor outcome and increased likelihood of lymph node metastasis. Low Smad4 levels were also shown to predict worse progression free (7.0 months vs. 8.9 months) and overall (13.9 months vs 17.8 months) survival in patients receiving oxaliplatin and 5-FU chemotherapy (Baraniskin A, Munding J, Schulmann K, Meier D, Porschen R, Arkenau H T, Graeven U, Schmiegel W, Tannapfel A, Reinacher-Schick A Prognostic value of reduced SMAD4 expression in patients with metastatic colorectal cancer under oxaliplatin-containing chemotherapy: a translational study of the AIO colorectal study group. Clinical colorectal cancer 2011 Mar. 1; 10(1):24-9). Finally, mutations in SMAD4 have also been correlated with the presence of a KRAS mutation (Sameer A S, Chowdri N A, Syeed N, Banday M Z, Shah Z A, Siddiqi M A SMAD4-molecular gladiator of the TGF-beta signaling is trampled upon by mutational insufficiency in colorectal carcinoma of Kashmiri population: an analysis with relation to KRAS proto-oncogene. BMC cancer 2010 Jun. 17; 10:300), which has been associated with resistance to Egfr-based therapy. Smad4 loss may shift TGF-β signaling to pro-tumorigenic pathways. Several groups have proposed targeting these alternative TGF-β signaling pathways. For example, the TGF-β receptor kinase inhibitor LY2109761 was shown to block metastasis of Smad4-null cells in pre-clinical mouse models (Zhang J, Neisa R, Mao Y Oncogenic Adenomatous polyposis coli mutants impair the mitotic checkpoint through direct interaction with Mad2. Molecular biology of the cell 2009 May; 20(9):2381-8). Similarly, loss of Smad4 and retention of TOF-13 was shown to increase levels of Vegf and to involve MEK-ERK and p38-MAPK signaling pathways, providing a rationale to target these alternative pathways in Smad4-null tumors (Papageorgis P, Cheng K, Ozturk S, Gong Y, Lambert A W, Abdolmaleky H M, Zhou J R, Thiagalingam S Smad4 inactivation promotes malignancy and drug resistance of colon cancer. Cancer research 2011 Feb. 1; 71(3):998-1008). Accordingly, any of the aforesaid agents can be used in a method of treating a SMAD4-MYO5B alteration. Accordingly, in another aspect, a method of inhibiting, reducing, or treating a hyperproliferative disorder, e.g., a neoplasm (including benign, premalignant or malignant (e.g., a cancer), in a subject is provided. The method includes administering to the subject a preselected therapeutic agent, e.g., an anti-cancer agent (e.g., a kinase inhibitor), as a single agent, or in combination, in an amount sufficient to reduce, inhibit or treat the activity or expression of SMAD4-MYO5B (e.g., a SMAD4-MYO5B fusion described herein), thereby inhibiting, reducing, or treating the hyperproliferative disorder in the subject.

In one embodiment, the subject treated has a SMAD4-MYO5B fusion; e.g., the subject has a tumor or cancer harboring a SMAD4-MYO5B fusion. In other embodiments, the subject has been previously identified as having a SMAD4-MYO5B fusion. In yet other embodiments, the subject has been previously identified as being likely or unlikely to respond to treatment with a protein kinase inhibitor, e.g., a subject that has previously participated in a clinical trial. In other embodiments, the subject has been previously identified as being likely or unlikely to respond to treatment with a protein kinase inhibitor, based on the presence of the SMAD4-MYO5B fusion. In one embodiment, the subject is a mammal, e.g., a human. In one embodiment, the subject has, or at risk of having a cancer at any stage of disease. In other embodiments, the subject is a patient, e.g., a cancer patient.

In certain embodiments, the neoplasm or neoplastic cell is a benign, pre-malignant, malignant (cancer) or metastasis. In certain embodiments, the cancer is a solid tumor, a soft tissue tumor, or a metastatic lesion.

In one embodiment, the neoplasm or neoplastic cell is a benign, pre-malignant, malignant (cancer) or metastasis. In certain embodiments, the cancer is a solid tumor, a soft tissue tumor, or a metastatic lesion. In one embodiment, the cancer is an adenocarcinoma. In one embodiment, the cancer is a colorectal adenocarcinoma. In one embodiment, the cancer is chosen from a lung cancer, a pancreatic cancer, melanoma, a colorectal cancer, an esophageal-gastric cancer, a thyroid cancer, or an adenocarcinoma. In one embodiment, the cancer is a lung adenocarcinoma. In other embodiment, the lung cancer is chosen from one or more of the following: non-small cell lung cancer (NSCLC), small cell lung cancer (SCLC), squamous cell carcinoma (SCC), adenocarcinoma of the lung, bronchogenic carcinoma, or a combination thereof. In one embodiment, the lung cancer is NSCLC or SCC. In certain embodiments, the cancer is a metastatic cancer, e.g., metastatic colon cancer. In certain embodiments, the cancer is a gastric cancer, pancreatic cancer, or head and neck cancer. In certain embodiments, the cancer is a metstatic gastic cancer, metastatic pancreatic cancer, or metastatic head and neck cancer.

In one embodiment, the anti-cancer agent is a MYO5B inhibitor. In one embodiment, the anti-cancer agent is a SMAD4 inhibitor. In one embodiment, the anti-cancer agent is a kinase inhibitor. In certain embodiments, the MYO5B inhibitor is a MYO5B inhibitor described herein. In certain embodiments, the SMAD4 inhibitor is a SMAD4 inhibitor described herein. In certain embodiments, the inhibitor is a TGFbeta receptor kinase inhibitor. In certain embodiments, the inhibitor is LY2109761. In certain embodiments, the inhibitor is a MEK-ERK inhibitor. In certain embodiments, the inhibitor is a p38-MAPK inhibitor.

HMGXB3-FLT4 Fusions

FLT4 is the gene encoding the protein fms-related tyrosine kinase 4 (Koch et al 2011; 21711246), also known as VEGFR3 (vascular endothelial growth factor receptor 3). FLT4 is one of the receptors for vascular endothelial growth factors VEGF-C and VEGF-D. FLT4 is thought to be primarily involved in lymphangiogenesis, or growth of new lymphatic vessels (Werynska, et al 2009; 20164015). Targeting of VEGF receptors has been a major therapeutic strategy in cancer, as growth of new blood and lymph vessels is a critical determinant of tumor growth and metastasis.

FLT4, which encodes the protein for the vascular endothelial growth factor receptor-3, is activated by ligands including VEGF-C and VEGF-D. Although FLT4 has been reported to be amplified to a high-level in 1.6% of non-small cell lung cancers, the precise biological effect of this amplification is unknown. It is difficult to predict whether amplification of FLT4 is associated with overexpression of the gene or protein, and the role of FLT4 overexpression is controversial. In one study, overexpression of either FLT4 or its ligand VEGF-C were not significantly associated with prognosis in NSCLC (Zhan et al 2009, 19687765). However, in another study, high levels of FLT4 negatively affected prognosis only in patients with T2a staged-tumors (Donnem et al 2011, 21550557). Finally, patients with high levels of nuclear FLT4/VEGFR3 staining were found to have a better prognosis in one study (Carrillo de Santa Pau et al 2009, 19197998). Preclinical data suggests that down-regulation of the VEGF-C ligand does decrease proliferation and invasion (Khromova et al 2012, 21804602; Feng at al 2011, 21680174). Multiple small molecule inhibitors of the VEGF system are either approved or in clinical trials. Drugs known to inhibit FLT4/VEGFR3 include sorafenib, sunitinib, cediranib and pazopanib, among others. None of these drugs are currently FDA-approved for the treatment of NSCLC but are in various stages of study.

In a related aspect, a fusion includes an in-frame fusion of an exon of HMG box domain containing 3 (HMGXB3), e.g., one more exons of HMGXB3 (e.g., one or more of exons 1-5 of HMGXB3) or a fragment thereof, and an exon of fms-related tyrosine kinase 4 (FLT4), e.g., one or more exons of a FLT4 (e.g., one or more of exons 23-30 of FLT4) or a fragment thereof. For example, the HMGXB3-FLT4 fusion can include an in-frame fusion within an intron of HMGXB3 (e.g., intron 5) or a fragment thereof, with an intron of FLT4 (e.g., intron 22) or a fragment thereof. In one embodiment, the fusion of the HMGXB3-FLT4 fusion comprises the nucleotide sequence of: chromosome 5 at one or more of nucleotide 149,396,435 (plus or minus 10, 20, 30, 50, 60, 70, 80, 100 or more nucleotides) and chromosome 5 at one or more of nucleotide 180,043,875 (plus or minus 10, 20, 30, 50, 60, 70, 80, 100 or more nucleotides). In one embodiment, the HMGXB3-FLT4 fusion is a deletion, e.g., a deletion of a portion of chromosome 5.

In certain embodiments, the HMGXB3-FLT4 fusion is in a 5'-HMGXB3 to 3'-FLT4 configuration (also referred to herein as "5'-HMGXB3-FLT4-3')." The term "fusion" or "fusion molecule" can refer to a polypeptide or a nucleic acid fusion, depending on the context. It may include a full-length sequence of a fusion or a fragment thereof, e.g., a fusion junction (e.g., a fragment including a portion of HMGXB3 and a portion of FLT4, e.g., a portion of the HMGXB3-FLT4 fusion described herein). In one embodiment, the HMGXB3-FLT4 fusion polypeptide includes a fragment of the amino acid sequence shown in FIG. 48 (SEQ ID NO:48) and a fragment of the amino acid sequence shown in FIG. 50 (SEQ ID NO:50), or an amino acid sequence substantially identical thereto. In another embodiment, the HMGXB3-FLT4 fusion nucleic acid includes a fragment of the nucleotide sequence shown in FIGS. 47A-47C (SEQ ID NO:47) and a fragment of the nucleotide sequence shown in FIGS. 49A-49B (SEQ ID NO:49), or a nucleotide sequence substantially identical thereto. In one embodiment, the HMGXB3-FLT4 fusion polypeptide comprises sufficient HMGXB3 and sufficient FLT4 sequence such that the 5' HMGXB3-3' FLT4 fusion has kinase activity, e.g., has elevated activity, e.g., FLT4 tyrosine kinase activity, as compared with wild type FLT4, e.g., in a cell of a cancer referred to herein (e.g., breast carcinoma, e.g., breat inflammatory carcinoma).

In certain embodiments, the HMGXB3-FLT4 fusion comprises one or more (or all of) exons 1-5 from HMGXB3 and one or more (or all of) exons 23-30 of FLT4 (e.g., one or more of the exons shown in FIGS. 47A-47C (SEQ ID NO:47) and FIGS. 49A-49C (SEQ ID NO:49). In another embodiment, the HMGXB3-FLT4 fusion comprises one or more (or all of) exons 1-5 of HMGXB3 and one or more (or all of) exons 23-30 of FLT4. In certain embodiments, the HMGXB3-FLT4 fusion comprises at least 1, 2, 3, 4, 5 or more exons (or encoded exons) from HMGXB3 and at least 1, 2, 3, 4, 5, 6, 7, 8 or more exons (or encoded exons) from FLT4 (e.g., from the HMGXB3 and FLT4 sequences shown in FIGS. 47A-47C and FIG. 48 (SEQ ID NO:47 and 48) and FIGS. 49A-49B and FIG. 50 (SEQ ID NOs:49 and 50)).

In certain embodiments, the HMGXB3-FLT4 fusion comprises exon 5 or a fragment thereof from HMGXB3, and exon 23 or a fragment thereof from FLT4 (e.g., as shown in FIGS. 47A-47C (SEQ ID NO:47) and FIGS. 49A-49B (SEQ ID NO:49)). In one embodiment, the HMGXB3-FLT4 fusion comprises at least 5, 10, 15, 20, 30, 40, 50 or more amino acids from exon 5 of HMGXB3 (e.g., from the amino acid sequence of HMGXB3 as shown in FIG. 48 (SEQ ID NO:48) (e.g., from the amino acid sequence of HMGXB3 preceding the fusion junction with FLT4, and at least 5, 10, 15, 20, 30, 40, 50 or more amino acids from exon 23 of FLT4 (e.g., from the amino acid sequence of FLT4 as shown in FIG. 50 (SEQ ID NO:50)). In another embodiment, the HMGXB3-FLT4 fusion comprises at least 6, 12, 15, 20, 25, 50, 75, 100 or more nucleotides from exon 5 of HMGXB3 (e.g., from the nucleotide sequence of HMGXB3 as shown in FIGS. 47A-47C (SEQ ID NO:47) (e.g., from the nucleotide sequence of HMGXB3 preceding the fusion junction with FLT4); and at least 6, 12, 15, 20, 25, 50, 75, 100 or more nucleotides from exon 23 of FLT4 (e.g., from the nucleotide sequence of FLT4 as shown in FIGS. 49A-49B (SEQ ID NO:49).

HMGXB3-FLT4 Nucleic Acid Molecules

In one aspect, the invention features a nucleic acid molecule (e.g., an isolated or purified) nucleic acid molecule that includes a fragment of a HMGXB3 gene and a fragment of a FLT4 gene. In one embodiment, the nucleotide sequence encodes a HMGXB3-FLT4 fusion polypeptide that includes a FLT4 tyrosine kinase domain or a functional fragment thereof. In another embodiment, the nucleotide sequence encodes a fragment of the FLT4 polypeptide including the amino acid sequence of SEQ ID NO:50 or a fragment thereof, or a sequence substantially identical thereto. In other embodiments, the nucleic acid molecule includes a fragment of the HMGXB3 gene encoding the amino acid sequence of SEQ ID NO:48 or a fragment thereof, or a sequence substantially identical thereto. In yet other embodiments, the nucleic acid molecule includes a nucleotide sequence encoding the amino acid sequence shown in FIG. 48 (SEQ ID NO:48), or a fragment thereof, and the amino acid sequence shown in FIG. 50 (SEQ ID NO:50) or a fragment thereof, or a sequence substantially identical thereto.

In one embodiment, the nucleic acid molecule includes a fusion, e.g., an in-frame fusion, between an intron of HMGXB3 (e.g., intron 5, or a fragment thereof), and an intron of FLT4 (e.g., intron 22, or a fragment thereof). The HMGXB3-FLT4 fusion can comprise a fusion of the nucleotide sequence of: chromosome 5 at one or more of nucleotide 149,396,435 (plus or minus 10, 20, 30, 50, 60, 70, 80, 100 nucleotides) and chromosome 5 at one or more of nucleotide 180,043,875 (plus or minus 10, 20, 30, 50, 60, 70, 80, 100 nucleotides), or a fragment thereof. In one embodiment, the HMGXB3-FLT4 fusion comprises a fusion of the nucleotide sequence of: chromosome 5 at one or more of nucleotide 149,396,435 (plus or minus 10, 20, 30, 50, 60, 70, 80, 100 nucleotides) and chromosome 5 at one or more of nucleotide 180,043,875 (plus or minus 10, 20, 30, 50, 60, 70, 80, 100 nucleotides), or a fragment thereof.

In another embodiment, the HMGXB3-FLT4 fusion comprises a nucleotide sequence (e.g., a fragment of a nucleotide sequence) shown in FIGS. 47A-47C (SEQ ID NO:47) and a nucleotide sequence (e.g., a fragment of a nucleotide sequence) shown in FIGS. 49A-49B (SEQ ID NO:49), or a fragment of the fusion. In one embodiment, the HMGXB3-FLT4 fusion comprises a nucleotide sequence substantially identical to the nucleotide sequence (e.g., a fragment of a nucleotide sequence) shown in FIGS. 47A-47C (SEQ ID NO:47) and the nucleotide sequence (e.g., a fragment of a nucleotide sequence) shown FIGS. 49A-49B (SEQ ID NO:49), or a fragment of the fusion. In one embodiment, the HMGXB3-FLT4 fusion comprises a nucleotide sequence at least 70%, at least 75%, at least 80%, at least 85%, at least 90%, at least 95%, at least 99%, at least 99.5 or greater, identical to the nucleotide sequence (e.g., a fragment of a nucleotide sequence) shown in FIGS. 47A-47C (SEQ ID NO:47) and to the nucleotide sequence (e.g., a fragment of a nucleotide sequence) shown in FIGS. 49A-49B (SEQ ID NO:49). In one embodiment, the HMGXB3-FLT4 fusion comprises a nucleotide sequence containing at least 25, 50, 100, 150, 200, 500, 1000, 1500, 2000, 2500, 3000, or more nucleotides of the nucleotide sequence shown in FIGS. 47A-47C (SEQ ID NO:47) and a nucleotide sequence containing at least 25, 50, 100, 150, 200, 500, 1000, 1500, 2000, 2500, 3000, or more nucleotides of the nucleotide sequence shown in FIGS. 49A-49B (SEQ ID NO:49). In one embodiment, the HMGXB3-FLT4 fusion comprises a nucleotide sequence containing at least 25, 50, 100, 150, 200, 500, 1000, 1500, 2000, 2500, 3000, or more contiguous nucleotides of the nucleotide sequence shown in FIGS. 47A-47C (SEQ ID NO:47) and a nucleotide sequence containing at least 25, 50, 100, 150, 200, 500, 1000, 1500, 2000, 2500, 3000, or more nucleotides of the nucleotide sequence shown in FIGS. 49A-49B (SEQ ID NO:49).

In another embodiment, the nucleic acid molecule includes a fusion, e.g., an in-frame fusion, of at least exon 5 of HMGXB3 or a fragment thereof (e.g., one or more of exons 1-5 of HMGXB3 or a fragment thereof), and at least exon 23 or a fragment thereof (e.g., one or more of exons 23-30 of FLT4 or a fragment thereof). In yet other embodiments, the nucleic acid molecule includes a fragment the nucleotide sequence shown in FIGS. 47A-47C (SEQ ID NO:47) and a fragment of the nucleotide sequence shown in FIGS. 49A-49BC (SEQ ID NO:49) or a fragment of the fusion, or a sequence substantially identical thereto.

In one embodiment, the nucleic acid molecule is complementary to at least a portion of a nucleotide sequence disclosed herein, e.g., is capable of hybridizing under a stringency condition described herein to SEQ ID NO:47 and/or SEQ ID NO:49, or a fragment thereof. In yet another embodiment, the nucleic acid molecule hybridizes to a nucleotide sequence that is complementary to at least a portion of a nucleotide sequence disclosed herein, e.g., is capable of hybridizing under a stringency condition to a nucleotide sequence complementary to SEQ ID NO:47 and/or SEQ ID NO:49, or a fragment thereof. The nucleotide sequence of a cDNA encoding an exemplary 5' HMGXB3-3' FLT4 fusion is shown in at least exon 5 (e.g., exons 1-5) of SEQ ID NO:47 and at least exon 23 (e.g., exons 23-30) of SEQ ID NO:49, and the predicted amino acid sequence is shown in the corresponding encoded exons of SEQ ID NO:48 and the corresponding encoded exons of SEQ ID NO:50, respectively.

In an embodiment the HMGXB3-FLT4 nucleic acid molecule comprises sufficient HMGXB3 and sufficient FLT4 sequence such that the encoded 5' HMGXB3-3' FLT4 fusion has kinase activity, e.g., has elevated activity, e.g., FLT4 kinase activity, as compared with wild type FLT4, e.g., in a cell of a cancer referred to herein. In certain embodiments, the 5' HMGXB3-3' FLT4 fusion comprises exons 1-5 from HMGXB3 and exon 23-30 from FLT4. In certain embodiments, the HMGXB3-FLT4 fusion comprises at least 1, 2, 3, 4, 5 or more exons from HMGXB3 and at least 1, 2, 3, 4, 5, 6, 7, 8 or more, exons from FLT4. In certain embodiments, the HMGXB3-FLT4 fusion comprises a fusion of exon 5 from HMGXB3 and exon 23 from FLT4. In another embodiment, the HMGXB3-FLT4 fusion comprises at least 1, 2, 3, 4, 5 exons from HMGXB3; and at least 1, 2, 3, 4, 5, 6, 7, 8 exons from FLT4.

In one embodiment, the nucleic acid molecule includes a nucleotide sequence that has an in-frame fusion of intron 5 of HMGXB3 (e.g., NM_014983) with intron 22 of FLT4 (e.g., NM_002020). In another embodiment, the nucleic acid molecule includes a nucleotide sequence that includes a breakpoint. For example, the nucleic acid molecule includes a nucleotide sequence that includes the fusion junction between the HMGXB3 gene and the FLT4 gene, e.g., the breakpoint between intron 5 of HMGXB3 and intron 22 of FLT4. In other embodiments, the nucleic acid molecules includes a nucleotide sequence of one or more of nucleotide 149,396,435 of chromosome 5 coupled to (e.g., directly or indirectly juxtaposed to) one or more of nucleotide 180,043, 875 of chromosome 5. In one embodiment, the nucleic acid molecule includes the nucleotide sequence of: chromosome 5 at one or more of nucleotide 149,396,435 plus or minus 10, 20, 30, 40 50, 60, 80, 100, 150 nucleotides and chromosome 5 at one or more of nucleotide 180,043,875 plus or minus 10, 20, 30, 40 50, 60, 80, 100, 150 nucleotides (corresponding to the breakpoint of a HMGXB3-FLT4 fusion), or a fragment thereof, or a sequence substantially identical thereto. In one embodiment, the nucleic acid molecule is complementary to at least a portion of a nucleotide sequence disclosed herein, e.g., is capable of hybridizing under a stringency condition described herein to SEQ ID NO:47 and/or SEQ ID NO:49 or a fragment thereof. In yet other embodiment, the nucleic acid molecule hybridizes to a nucleotide sequence that is complementary to at least a portion of a nucleotide sequence disclosed herein, e.g., is capable of hybridizing under a stringency condition described herein to a nucleotide sequence complementary to SEQ ID NO:47 or 49 or a fragment thereof.

In another embodiment, the HMGXB3-FLT4 fusion nucleic acid comprises at least 6, 12, 15, 20, 25, 50, 75, 100 or more nucleotides from exon 5 of HMGXB3 (e.g., from the nucleotide sequence of HMGXB3 preceding the fusion junction with FLT4, e.g., of the HMGXB3 sequence shown in FIGS. 47A-47C (SEQ ID NO:47)), and at least 6, 12, 15, 20, 25, 50, 75, 100 or more nucleotides from exon 23 of FLT4 (e.g., from the nucleotide sequence of FLT4 following the fusion junction with HMGXB3, e.g., of the FLT4 sequence shown in FIGS. 49A-49B (SEQ ID NO:49)).

In other embodiments, the nucleic acid molecule includes a nucleotide sequence encoding a HMGXB3-FLT4 fusion polypeptide that includes a fragment of a HMGXB3 gene and a fragment of an FLT4 gene. In one embodiment, the nucleotide sequence encodes a HMGXB3-FLT4 fusion polypeptide that includes e.g., an FLT4 tyrosine kinase domain or a functional fragment thereof. In yet other embodiments, the nucleic acid molecule includes a nucleotide sequence encoding the amino acid sequence (e.g., a fragment of the amino acid sequence) shown in FIG. 48 (e.g., SEQ ID NO:48) and a nucleotide sequence encoding the amino acid sequence (e.g., a fragment of the amino acid sequence) shown in FIG. 50 (e.g., SEQ ID NO:50), or a fragment of the fusion, or a sequence substantially identical thereto. In one embodiment, the encoded HMGXB3-FLT4 fusion polypeptide includes an FLT4 tyrosine kinase domain or a functional fragment thereof.

In a related aspect, the invention features nucleic acid constructs that include the HMGXB3-FLT4 nucleic acid molecules described herein. In certain embodiments, the nucleic acid molecules are operatively linked to a native or a heterologous regulatory sequence. Also included are vectors and host cells that include the HMGXB3-FLT4 nucleic acid molecules described herein, e.g., vectors and host cells suitable for producing the nucleic acid molecules and polypeptides described herein.

In a related aspect, methods of producing the nucleic acid molecules and polypeptides described herein are also described.

In another aspect, the invention features nucleic acid molecules that reduce or inhibit the expression of a nucleic acid molecule that encodes a HMGXB3-FLT4 fusion described herein. Examples of such nucleic acid molecules include, for example, antisense molecules, ribozymes, RNAi, triple helix molecules that hybridize to a nucleic acid encoding HMGXB3-FLT4, or a transcription regulatory region of HMGXB3-FLT4, and blocks or reduces mRNA expression of HMGXB3-FLT4.

Nucleic Acid Detection and Capturing Reagents

The invention also features a nucleic acid molecule, e.g., nucleic acid fragment, suitable as probe, primer, bait or library member that includes, flanks, hybridizes to, which are useful for identifying, or are otherwise based on, the HMGXB3-FLT4 fusions described herein. In certain embodiments, the probe, primer or bait molecule is an oligonucleotide that allows capture, detection or isolation of a HMGXB3-FLT4 fusion nucleic acid molecule described herein. The oligonucleotide can comprise a nucleotide sequence substantially complementary to a fragment of the HMGXB3-FLT4 fusion nucleic acid molecules described herein. The sequence identity between the nucleic acid fragment, e.g., the oligonucleotide, and the target HMGXB3-FLT4 sequence need not be exact, so long as the sequences are sufficiently complementary to allow the capture, detection or isolation of the target sequence. In one embodiment, the nucleic acid fragment is a probe or primer that includes an oligonucleotide between about 5 and 25, e.g., between 10 and 20, or 10 and 15 nucleotides in length. In other embodiments, the nucleic acid fragment is a bait that includes an oligonucleotide between about 100 to 300 nucleotides, 130 and 230 nucleotides, or 150 and 200 nucleotides, in length.

In one embodiment, the nucleic acid fragment can be used to identify or capture, e.g., by hybridization, a HMGXB3-FLT4 fusion. For example, the nucleic acid fragment can be a probe, a primer, or a bait, for use in identifying or capturing, e.g., by hybridization, a HMGXB3-FLT4 fusion described herein. In one embodiment, the nucleic acid fragment can be useful for identifying or capturing a HMGXB3-FLT4 breakpoint, e.g., the nucleotide sequence of: chromosome 5 at nucleotide 149,396,435 plus or minus 10, 20, 30, 40, 50, 60, 80, 100, 150 nucleotides and chromosome 5 at nucleotide 180,043,875 plus or minus 10, 20, 30, 40 50, 60, 80, 100, 150 nucleotides.

In one embodiment, the nucleic acid fragment hybridizes to a nucleotide sequence within a chromosomal rearrangement that creates an in-frame fusion of intron 5 of HMGXB3 with intron 22 of FLT4. In one embodiment, the nucleic acid fragment hybridizes to a nucleotide sequence in the region In other embodiments, the nucleic acid molecules includes a nucleotide sequence in the region of nucleotides 149,396, 435 of chromosome 5 coupled to (e.g., juxtaposed to) nucleotides in the region of nucleotides 180,043,875 of chromosome 5. In one embodiment, the nucleic acid fragment hybridizes to a nucleotide sequence that includes a breakpoint, e.g., the nucleotide sequence of: chromosome 5 at nucleotide 149,396,435 plus or minus 10, 20, 30, 40, 50, 60, 80, 100, 150 or more nucleotides and chromosome 5 at nucleotide 180,043,875 plus or minus 10, 20, 30, 40 50, 60, 80, 100, 150 or more nucleotides. For example, the nucleic acid fragment can hybridize to a nucleotide sequence that includes the fusion junction between the HMGXB3 gene and the FLT4 gene, e.g., a nucleotide sequence that includes a portion of a nucleotide sequence within introns 5 of a HMGXB3 gene and 22 of a FLT4 gene.

In another embodiment, the nucleic acid fragment hybridizes to a nucleotide sequence that comprises at least 6, 12, 15, 20, 25, 50, 75, 100, 150 or more nucleotides from exon 5 of HMGXB3 (e.g., from the nucleotide sequence of HMGXB3 preceding the fusion junction with FLT4, e.g., of the HMGXB3 sequence shown in FIGS. 47A-47C (SEQ ID NO:47)), and at least 6, 12, 15, 20, 25, 50, 75, 100, 150 or more nucleotides from exon 23 of FLT4 (e.g., from the nucleotide sequence of FLT4 following the fusion junction with HMGXB3, e.g., of the FLT4 sequence shown in FIGS. 49A-49B (SEQ ID NO:49)).

The probes or primers described herein can be used, for example, for FISH detection or PCR amplification. In one exemplary embodiment where detection is based on PCR, amplification of the HMGXB3-FLT4 fusion junction fusion junction can be performed using a primer or a primer pair, e.g., for amplifying a sequence flanking the fusion junctions described herein, e.g., the mutations or the junction of a chromosomal rearrangement described herein, e.g., HMGXB3-FLT4.

In one embodiment, a pair of isolated oligonucleotide primers can amplify a region containing or adjacent to a position in the HMGXB3-FLT4 fusion. For example, forward primers can be designed to hybridize to a nucleotide sequence within HMGXB3 genomic or mRNA sequence (e.g., a nucleotide sequence within exon 5 of HMGXB3 of SEQ ID NO:47), and the reverse primers can be designed to hybridize to a nucleotide sequence of FLT4 (e.g., a nucleotide sequence within exon 23 of FLT4, of SEQ ID NO:49).

In another embodiment, the nucleic acid fragments can be used to identify, e.g., by hybridization, a HMGXB3-FLT4 fusion. In one embodiment, the nucleic acid fragment hybridizes to a nucleotide sequence that includes a fusion junction between the HMGXB3 transcript and the FLT4 transcript.

In other embodiments, the nucleic acid fragment includes a bait that comprises a nucleotide sequence that hybridizes to a HMGXB3-FLT4 fusion nucleic acid molecule described herein, and thereby allows the capture or isolation said nucleic acid molecule. In one embodiment, a bait is suitable for solution phase hybridization. In other embodiments, a bait includes a binding entity, e.g., an affinity tag, that allows capture and separation, e.g., by binding to a binding entity, of a hybrid formed by a bait and a nucleic acid hybridized to the bait.

In other embodiments, the nucleic acid fragment includes a library member comprising a HMGXB3-FLT4 nucleic acid molecule described herein. In one embodiment, the library member includes a rearrangement that results in a HMGXB3-FLT4 fusion described herein. The nucleic acid fragment can be detectably labeled with, e.g., a radiolabel, a fluorescent label, a bioluminescent label, a chemiluminescent label, an enzyme label, a binding pair label, or can include an affinity tag; a tag, or identifier (e.g., an adaptor, barcode or other sequence identifier).

HMGXB3-FLT4 Fusion Polypeptides

In another embodiment, the HMGXB3-FLT4 fusion comprises an amino acid sequence (e.g., a fragment of the amino acid sequence) shown in FIG. 48 (SEQ ID NO:48) and an amino acid sequence (e.g., a fragment of the amino acid sequence) shown in FIG. 50 (SEQ ID NO:50), or a fragment of the fusion. In one embodiment, the HMGXB3-FLT4 fusion comprises an amino acid sequence substantially identical to the amino acid sequence (e.g., a fragment of the amino acid sequence) shown in FIG. 48 (SEQ ID NO:48) and the amino acid sequence (e.g., a fragment of the amino acid sequence) shown in FIG. 50 (SEQ ID NO:50), or a fragment thereof. In one embodiment, the HMGXB3-FLT4 fusion comprises an amino acid sequence at least 70%, at least 75%, at least 80%, at least 85%, at least 90%, at least 95%, at least 99%, at least 99.5 or greater, identical to the amino acid sequence (e.g., a fragment of the amino acid sequence) shown in FIG. 48 (SEQ ID NO:48) and the amino acid sequence (e.g., a fragment of the amino acid sequence) shown in FIG. 50 (SEQ ID NO:50). In one embodiment, the HMGXB3-FLT4 fusion comprises a sequence containing at least 10, 20, 50, 100, 500, 600, 700, 800, 900, 1000, or more amino acids of the amino acid sequence shown in FIG. 48 (SEQ ID NO:48) and FIG. 50 (SEQ ID NO:50). In one embodiment, the HMGXB3-FLT4 fusion comprises an amino acid sequence containing at least 5, 10, 20, 50, 100, 500, 600, 700, 800, 900, 1000, or more contiguous amino acids of the amino acid sequence shown in FIG. 48 (SEQ ID NO:48) and at least 5, 10, 20, 50, 100, 500, 600, 700, 800, 900, 1000, or more contiguous amino acids of the amino acid sequence shown in FIG. 50 (SEQ ID NO:50). In one embodiment, the 5' HMGXB3-3' FLT4 fusion polypeptide includes a FLT4 receptor tyrosine kinase domain or a functional fragment thereof. In an embodiment, the 5'HMGXB3-3'FLT4 fusion polypeptide comprises sufficient FLT4 and sufficient HMGXB3 sequence such that it has kinase activity, e.g., has elevated activity, e.g., FLT4 kinase activity, as compared with wild type FLT4, e.g., in a cell of a cancer referred to herein.

In another aspect, the invention features a HMGXB3-FLT4 fusion polypeptide (e.g., a purified HMGXB3-FLT4 fusion polypeptide), a biologically active or antigenic fragment thereof, as well as reagents (e.g., antibody molecules that bind to a HMGXB3-FLT4 fusion polypeptide), methods for modulating a HMGXB3-FLT4 polypeptide activity and detection of a HMGXB3-FLT4 polypeptide.

In one embodiment, the HMGXB3-FLT4 fusion polypeptide has at least one biological activity, e.g., an FLT4 kinase activity. In one embodiment, at least one biological activity of the HMGXB3-FLT4 fusion polypeptide is reduced or inhibited by an anti-cancer drug, e.g., a kinase inhibitor (e.g., a multikinase inhibitor or an FLT4-specific inhibitor). In one embodiment, at least one biological activity of the HMGXB3-FLT4 fusion polypeptide is reduced or inhibited by an FLT4 kinase inhibitor.

In yet other embodiments, the HMGXB3-FLT4 fusion polypeptide is encoded by a nucleic acid molecule described herein. In one embodiment, the HMGXB3-FLT4 fusion polypeptide is encoded by an in-frame fusion of intron 5 of HMGXB3 with intron 22 of FLT4 (e.g., a sequence on chromosome 5). In another embodiment, the HMGXB3-FLT4 fusion polypeptide includes an amino acid sequence encoded by a nucleotide sequence comprising a fusion junction between the HMGXB3 transcript and the FLT4 transcript.

In certain embodiments, the HMGXB3-FLT4 fusion polypeptide comprises one or more of encoded exons 1-5 from HMGXB3 and one or more of encoded exon 23-30 of FLT4. In certain embodiments, the HMGXB3-FLT4 fusion polypeptide comprises at least 1, 2, 3, 4, 5 or more encoded exons from HMGXB3 and at least 1, 2, 3, 4, 5, 6, 7, 8 or more, encoded exons from FLT4. In certain embodiments, the HMGXB3-FLT4 fusion polypeptide comprises a fusion of encoded exon 5 from HMGXB3 and encoded exon 23 from FLT4 (or a fragment thereof). In other embodiments, the fusion comprises least 1, 2, 3, 4, 5 encoded exons from HMGXB3; and at least 1, 2, 3, 4, 5, 6, 7, 8 encoded exons from FLT4. In certain embodiments, the HMGXB3-FLT4 fusion polypeptide comprises encoded exons 1-5 from HMGXB3 and exon 23-30 of FLT4. In certain embodiments, the 5' HMGXB3-3' FLT4 fusion polypeptide comprises a fusion junction of the sequence of exon 5 from HMGXB3 and the sequence of exon 23 from FLT4.

In certain embodiments, the HMGXB3-FLT4 fusion comprises the amino acid sequence corresponding to exon 5 or a fragment thereof from HMGXB3, and the amino acid sequence corresponding to exon 23 or a fragment thereof from FLT4 (e.g., as shown in FIG. 48 (SEQ ID NO:48) and FIG. 50 (SEQ ID NO:50)). In one embodiment, the HMGXB3-FLT4 fusion comprises at least 5, 10, 15, 20 or more amino acids from exon 5 of HMGXB3 (e.g., from the amino acid sequence of HMGXB3 preceding the fusion junction with FLT4, e.g., of the HMGXB3 sequence shown in FIG. 48 (SEQ ID NO:48)), and at least 5, 10, 15, 20 or more amino acids from exon 23 of FLT4 (e.g., from the amino acid sequence of FLT4 following the fusion junction with HMGXB3, e.g., of the FLT4 sequence shown in FIG. 50 (SEQ ID NO:50)).

In one embodiment, the HMGXB3-FLT4 fusion polypeptide includes a FLT4 tyrosine kinase domain or a functional fragment thereof. In a related aspect, the invention features HMGXB3-FLT4 fusion polypeptide or fragments operatively linked to heterologous polypeptides to form fusion proteins.

In another embodiment, the HMGXB3-FLT4 fusion polypeptide or fragment is a peptide, e.g., an immunogenic peptide or protein, that contains a fusion junction described herein. Such immunogenic peptides or proteins can be used to raise antibodies specific to the fusion protein. In other embodiments, such immunogenic peptides or proteins can be used for vaccine preparation. The vaccine preparation can include other components, e.g., an adjuvant.

In another aspect, the invention features antibody molecules that bind to a HMGXB3-FLT4 fusion polypeptide or fragment described herein. In embodiments, the antibody can distinguish wild type FLT4 (or HMGXB3) from HMGXB3-FLT4.

Detection Reagents and Detection of Mutations

In another aspect, the invention features a detection reagent, e.g., a purified or an isolated preparation thereof. Detection reagents can distinguish a nucleic acid, or protein sequence, having a breakpoint, e.g., a HMGXB3-FLT4 breakpoint; from a reference sequence. In one embodiment, the detection reagent detects (e.g., specifically detects) a HMGXB3-FLT4 fusion nucleic acid or a polypeptide (e.g., distinguishes a wild type FLT4 or another FLT4 fusion (or HMGXB3) from a HMGXB3-FLT4 nucleic acid (e.g., as described herein in FIGS. 47A-47C (SEQ ID NO:47) and FIGS. 49A-49B (SEQ ID NO:49); or a HMGXB3-FLT4 polypeptide (e.g., as described herein in FIG. 48 (SEQ ID NO:48) and FIG. 50 (SEQ ID NO:50).

Detection reagents, e.g., nucleic acid-based detection reagents, can be used to identify mutations in a target nucleic acid, e.g., DNA, e.g., genomic DNA or cDNA, or RNA, e.g., in a sample, e.g., a sample of nucleic acid derived from a neoplastic or tumor cell, e.g., a melanocytic neoplasm, melanoma or metastatic cell. Detection reagents, e.g., antibody-based detection reagents, can be used to identify mutations in a target protein, e.g., in a sample, e.g., a sample of protein derived from, or produced by, a neoplastic or tumor cell, e.g., a melanocytic neoplasm, melanoma or metastatic cell.

Method of Treatment

In a related aspect, a method of inhibiting, reducing, or treating a hyperproliferative disorder, e.g., a neoplasm (including benign, pre-malignant or malignant (e.g., a cancer), in a subject is provided. The method includes administering to the subject a preselected therapeutic agent, e.g., an anti-cancer agent (e.g., a kinase inhibitor), as a single agent, or in combination, in an amount sufficient to reduce, inhibit or treat the activity or expression of HMGXB3-FLT4 (e.g., a HMGXB3-FLT4 fusion described herein), thereby inhibiting, reducing, or treating the hyperproliferative disorder in the subject.

In one embodiment, the subject treated has a HMGXB3-FLT4 fusion; e.g., the subject has a tumor or cancer harboring a HMGXB3-FLT4 fusion. In other embodiments, the subject has been previously identified as having a HMGXB3-FLT4 fusion. In yet other embodiments, the subject has been previously identified as being likely or unlikely to respond to treatment with a protein kinase inhibitor, e.g., a subject that has previously participated in a clinical trial. In other embodiments, the subject has been previously identified as being likely or unlikely to respond to treatment with a protein kinase inhibitor, based on the presence of the HMGXB3-FLT4 fusion. In one embodiment, the subject is a mammal, e.g., a human. In one embodiment, the subject has, or at risk of having a cancer at any stage of disease. In other embodiments, the subject is a patient, e.g., a cancer patient.

In certain embodiments, the neoplasm or neoplastic cell is a benign, pre-malignant, malignant (cancer) or metastasis. In certain embodiments, the cancer is a solid tumor, a soft tissue tumor, or a metastatic lesion.

In one embodiment, the neoplasm or neoplastic cell is a benign, pre-malignant, malignant (cancer) or metastasis. In certain embodiments, the cancer is a solid tumor, a soft tissue tumor, or a metastatic lesion. In an embodiment, the cancer is a breast carcinoma. In one embodiment, the cancer is a breat inflammatory carcinoma. In one embodiment, the cancer is chosen from a lung cancer, a pancreatic cancer, melanoma, a colorectal cancer, an esophageal-gastric cancer, a thyroid cancer, or an adenocarcinoma. In one embodiment, the cancer is a lung adenocarcinoma. In other embodiment, the lung cancer is chosen from one or more of the following: non-small cell lung cancer (NSCLC), small cell lung cancer (SCLC), squamous cell carcinoma (SCC), adenocarcinoma of the lung, bronchogenic carcinoma, or a combination thereof. In one embodiment, the lung cancer is NSCLC or SCC. In certain embodiments, the cancer is a renal cancer.

In one embodiment, the anti-cancer agent is a kinase inhibitor. For example, the kinase inhibitor is a multi-kinase inhibitor or a FLT4-specific inhibitor. In one embodiment, the kinase inhibitor is a FLT4 inhibitor. In some embodiments, the FLT4 inhibitor is chosen from: BIBF1120 (Vargatef); KRN 633; Brivanib alaninate (BMS-582664); Telatinib (BAY 57-9352); E7080 (Lenvatinib); Trivozanib (AV-951), XL999; AL2846; Motesanib; AAL-993; Axitinib; Foretinib; MGCD-265; SAR131675; cediranib, Sorafenib; Pazopanib; Regorafenib (BAY 73-4506); Sunitinib; Vandetanib; and/or IMC-3C5. In some embodiments the FLT4 inhibitor is a FLT4 inhibitor desctibed herein.

MLL-YAP1 Fusions

MLL fusions are common in leukemia (reviewed in Marschalek R Mechanisms of leukemogenesis by MLL fusion proteins. British journal of haematology 2011 January; 152(2):141-54), but have not been reported in carcinosarcoma and have rarely been reported in other types of sarcoma (Braekeleer E D, Douet-Guilbert N, Meyer C, Morel F, Marschalek R, Braekeleer M D MLL-ELL fusion gene in two infants with acute monoblastic leukemia and myeloid sarcoma. Leukemia & lymphoma 2012 Jan. 31, Ouansafi I, Arabadjief M, Mathew S, Srivastara S, Orazi A Myeloid sarcoma with t(11; 19)(q23; p13.3) (MLL-ELL) in the uterine cervix. British journal of haematology 2011 June; 153(6):679). MLL fusions in leukemia have been shown to alter methylation patterns and result in disruption of transcription (Marschalek R Mechanisms of leukemogenesis by MLL fusion proteins. British journal of haematology 2011 January; 152(2):141-54). The fusion partner identified in this tumor, YAP1, has been implicated as both a putative oncogene and a tumor suppressor in different cellular contexts (reviewed in Diep C H, Zucker K M, Hostetter G, Watanabe A, Hu C, Munoz R M, Von Hoff D D, Han H Down-regulation of Yes Associated Protein 1 expression reduces cell proliferation and clonogenicity of pancreatic cancer cells. PloS one 2012; 7(3):e32783). YAP1 alteration has also not been reported in carcinosarcoma, although one report describes YAP1 amplification in 5% (22/404) of soft-tissue sarcomas (Hélias-Rodzewicz Z, Pérot G, Chibon F, Ferreira C, Lagarde P, Terrier P, Coindre J M, Aurias A YAP1 and VGLL3, encoding two cofactors of TEAD transcription factors, are amplified and overexpressed in a subset of soft tissue sarcomas. Genes, chromosomes & cancer 2010 December; 49(12):1161-71).

MLL encodes a histone methyltransferase—an enzyme involved in the modification of histones. It is a homolog of the *Drosophila* gene trithorax, and is involved in the positive regulation of transcription, particularly during development, although it is also expressed in most adult tissues. MLL rearrangements with various fusion partners have been widely implicated in several forms of leukemia (Harper D P, Aplan P D Chromosomal rearrangements leading to MLL gene fusions: clinical and biological aspects. Cancer research 2008 Dec. 15; 68(24):10024-7, Hess J L MLL: a histone methyltransferase disrupted in leukemia. Trends in molecular medicine 2004 October; 10(10):500-7).

MLL fusions with various fusion partners are present in approximately 10% of acute leukemias, involving 71 different fusion partners identified to date (Marschalek R Mechanisms of leukemogenesis by MLL fusion proteins. British journal of haematology 2011 January; 152(2):141-54). The particular alteration seen in this tumor is a complex rearrangement, resulting in the deletion of MLL exons 3-6 and possible fusion with the gene YAP1. YAP1 encodes the protein Yorkie (Yki), a nuclear transcriptional co-activator that is a component of the Salvador-Warts-Hippo (SWH) pathway, required for the control of cellular proliferation and regulation of organ size (reviewed in Edgar B A From cell structure to transcription: Hippo forges a new path. Cell 2006 Jan. 27; 124(2):267-73, Harvey K, Tapon N The Salvador-Warts-Hippo pathway—an emerging tumour-suppressor network. Nature reviews. Cancer 2007 March; 7(3): 182-91, Diep C H, Zucker K M, Hostetter G, Watanabe A, Hu C, Munoz R M, Von Hoff D D, Han H Down-regulation of Yes Associated Protein 1 expression reduces cell proliferation and clonogenicity of pancreatic cancer cells. PloS one 2012; 7(3):e32783). The role of YAP1 in cancer is complex, as it has been described both as a putative oncogene and as a tumor suppressor. YAP1 has been reported to be amplified and overexpressed in a number of tumor types (reviewed in Diep C H, Zucker K M, Hostetter G, Watanabe A, Hu C, Munoz R M, Von Hoff D D, Han H Down-regulation of Yes Associated Protein 1 expression reduces cell proliferation and clonogenicity of pancreatic cancer cells. PloS one 2012; 7(3):e32783), and overexpression of YAP1 in mammary epithelial cells leads to oncogenic transformation (Overholtzer M, Zhang J, Smolen G A, Muir B, Li W, Sgroi D C, Deng C X, Brugge J S, Haber D A Transforming properties of YAP, a candidate oncogene on the chromosome 11q22 amplicon. Proceedings of the National Academy of Sciences of the United States of America 2006 Aug. 15; 103(33):12405-10). In contrast, YAP has been implicated as a tumor suppressor in breast cancer, where knockdown of YAP1 using shRNA in breast cancer cell lines increased the growth and invasive properties of the cells (Yuan M, Tomlinson V, Lara R, Holliday D, Chelala C, Harada T, Gangeswaran R, Manson-Bishop C, Smith P, Danovi S A, Pardo O, Crook T, Mein C A, Lemoine N R, Jones L J, Basu S Yes-associated protein (YAP) functions as a tumor suppressor in breast. Cell death and differentiation 2008 November; 15(11):1752-9). The role of YAP1 in carcinogenesis appears to be context-dependent.

As a histone methyltransferase, MLL is involved in alteration of the methylation pattern at the promoters of its target genes, thus regulating their transcription. In leukemia, MLL fusions have been found to disrupt this process, thereby altering the chromatin signature and changing the pattern of transcription (reviewed in Marschalek R Mechanisms of leukemogenesis by MLL fusion proteins. British journal of haematology 2011 January; 152(2):141-54). Both the disruption of YAP1 and the disruption of MLL have oncogenic potential.

MLL fusions are common in leukemia, but have not been reported in carcinosarcoma. Case reports have described MLL fusions in myeloid sarcoma (Braekeleer E D, Douet-Guilbert N, Meyer C, Morel F, Marschalek R, Braekeleer M D MLL-ELL fusion gene in two infants with acute monoblastic leukemia and myeloid sarcoma. Leukemia & lymphoma 2012 Jan. 31, Ouansafi I, Arabadjief M, Mathew S, Srivastara S, Orazi A Myeloid sarcoma with t(11; 19)(q23; p13.3) (MLL-ELL) in the uterine cervix. British journal of haematology 2011 June; 153(6):679), but these cases are rare. Alteration of YAP1 has also not been reported in carcinosarcoma, although a study of 404 adult soft tissue sarcomas identified YAP1 amplification in 5% (22/404) of cases, all correlated with high YAP1 mRNA and protein expression (Hélias-Rodzewicz Z, Pérot G, Chibon F, Ferreira C, Lagarde P, Terrier P, Coindre J M, Aurias A YAP1 and VGLL3, encoding two cofactors of TEAD transcription factors, are amplified and overexpressed in a subset of soft tissue sarcomas. Genes, chromosomes & cancer 2010 December; 49(12):1161-71). In certain embodiments, the method includes targeting th MLL fusion and/or the YAP amplification events. In leukemia, the histone methyltransferase Dot1L has been implicated as an interaction partner with MLL-fusion proteins, required for the epigenetic disruption that leads to leukemogenesis (Bernt K M, Armstrong S A A role for DOT1L in MLL-rearranged leukemias. Epigenomics 2011 December; 3(6):667-70). Dot1L is a therapeutic target for leukemias bearing MLL fusions (Daigle S R, Olhava E J, Therkelsen C A, Majer C R, Sneeringer C J, Song J, Johnston L D, Scott M P, Smith J J, Xiao Y, Jin L, Kuntz K W, Chesworth R, Moyer M P, Bernt K M, Tseng J C, Kung A L, Armstrong S A, Copeland R A, Richon V M, Pollock R M Selective killing of mix ed lineage leukemia cells by a potent small-molecule DOT1L inhibitor. Cancer cell 2011 Jul. 12; 20(1):53-65). Other therapies include the inhibition of Bcl-2 family pro-survival proteins downstream of the MLL-AF9 fusion (Mizukawa B, Wei J, Shrestha M, Wunderlich M, Chou F S, Griesinger A, Harris C E, Kumar A R, Zheng Y, Williams D A, Mulloy J C Inhibition of Rac GTPase signaling and downstream prosurvival Bcl-2 proteins as combination targeted therapy in MLL-AF9 leukemia. Blood 2011 Nov. 10; 118(19):5235-45) and targeting activated Raf downstream of MLL fusion proteins (Ono R, Kumagai H, Nakajima H, Hishiya A, Taki T, Horikawa K, Takatsu K, Satoh T, Hayashi Y, Kitamura T, Nosaka T Mixed-lineage-leukemia (MLL) fusion protein collaborates with Ras to induce acute leukemia through aberrant Hox expression and Raf activation. Leukemia: official journal of the Leukemia Society of America, Leukemia Research Fund, U. K 2009 December; 23(12):2197-209).

Accordingly, in another aspect, a fusion includes an in-frame fusion of an exon of myeloid/lymphoid protein (MLL), e.g., one more exons of MLL (e.g., one or more of exons 1-6 of MLL) or a fragment thereof, and an exon of yes associated protein 1 (YAP1), e.g., one or more exons of a YAP1 (e.g., one or more of exon 7 of YAP1) or a fragment thereof. For example, the MLL-YAP1 fusion can include an in-frame fusion within an intron of MLL (e.g., intron 6) or a fragment thereof, with an intron of YAP1 (e.g., intron 6) or a fragment thereof. In one embodiment, the fusion of the MLL-YAP1 fusion comprises the nucleotide sequence of: chromosome 11 at one or more of nucleotide 102,099,656 (plus or minus 10, 20, 30, 50, 60, 70, 80, 100 or more nucleotides) and chromosome 11 at one or more of nucleotide 118,352,435 (plus or minus 10, 20, 30, 50, 60, 70, 80, 100 or more nucleotides).

In certain embodiments, the MLL-YAP1 fusion is in a 5'-MLL to 3'-YAP1 configuration (also referred to herein as "5'-MLL-YAP1-3')." The term "fusion" or "fusion molecule" can refer to a polypeptide or a nucleic acid fusion, depending on the context. It may include a full-length sequence of a fusion or a fragment thereof, e.g., a fusion junction (e.g., a fragment including a portion of MLL and a portion of YAP1, e.g., a portion of the MLL-YAP1 fusion described herein). In one embodiment, the MLL-YAP1 fusion polypeptide includes a fragment of the amino acid sequence shown in FIGS. 52A-52B (SEQ ID NO:52) and a fragment of the amino acid sequence shown in FIG. 54 (SEQ ID NO:54), or an amino acid sequence substantially identical thereto. In another embodiment, the MLL-YAP1 fusion nucleic acid includes a fragment of the nucleotide sequence shown in FIGS. 51A-51G (SEQ ID NO:51) and a fragment of the nucleotide sequence shown in FIGS. 53A-53C (SEQ ID NO:53), or a nucleotide sequence substantially identical thereto. In one embodiment, the MLL-YAP1 fusion polypeptide comprises sufficient MLL and sufficient YAP1 sequence such that the 5' MLL-3' YAP1 fusion has kinase activity, e.g., has elevated activity, e.g., tyrosine kinase activity, as compared with wild type, e.g., in a cell of a cancer referred to herein.

In certain embodiments, the MLL-YAP1 fusion comprises one or more (or all of) exons 1-6 from MLL and one or more (or all of) exon 7 of YAP1 (e.g., one or more of the exons shown in FIGS. 51A-51G (SEQ ID NO:51) and FIGS. 53A-53C (SEQ ID NO:53). In another embodiment, the MLL-YAP1 fusion comprises one or more (or all of) exons 1-6 of MLL and one or more (or all of) exon 7 of YAP1. In certain embodiments, the MLL-YAP1 fusion comprises at least 1, 2, 3, 4, 5, 6 or more exons (or encoded exons) from MLL and at least 1, 2, 3, 4, 5, 6, 7 or more exons (or encoded exons) from YAP1 (e.g., from the MLL and YAP1 sequences shown in FIGS. 51A-51G and FIGS. 52A-52B (SEQ ID NO:51 and 52) and FIGS. 53A-53C and FIG. 54 (SEQ ID NOs:53 and 54).

In certain embodiments, the MLL-YAP1 fusion comprises exon 6 or a fragment thereof from MLL, and exon 7 or a fragment thereof from YAP1 (e.g., as shown in FIGS. 51A-51G (SEQ ID NO:51) and FIGS. 53A-53C (SEQ ID NO:53)). In one embodiment, the MLL-YAP1 fusion comprises at least 5, 10, 15, 20, 30, 40, 50 or more amino acids from exon 6 of MLL (e.g., from the amino acid sequence of MLL as shown in FIGS. 52A-52B (SEQ ID NO:52) (e.g., from the amino acid sequence of MLL preceding the fusion junction with YAP1, and at least 5, 10, 15, 20, 30, 40, 50 or more amino acids from exon 7 of YAP1 (e.g., from the amino acid sequence of YAP1 as shown in FIG. 54 (SEQ ID NO:54)). In another embodiment, the MLL-YAP1 fusion comprises at least 6, 12, 15, 20, 25, 50, 75, 100 or more nucleotides from exon 6 of MLL (e.g., from the nucleotide sequence of MLL as shown in FIGS. 51A-51G (SEQ ID NO:51) (e.g., from the nucleotide sequence of MLL preceding the fusion junction with YAP1); and at least 6, 12, 15, 20, 25, 50, 75, 100 or more nucleotides from exon 7 of YAP1 (e.g., from the nucleotide sequence of YAP1 as shown in FIGS. 53A-53C (SEQ ID NO:53)).

MLL-YAP1 Nucleic Acid Molecules

In one aspect, the invention features a nucleic acid molecule (e.g., an isolated or purified) nucleic acid molecule that includes a fragment of a MLL gene and a fragment of a YAP1 gene. In one embodiment, the nucleotide sequence encodes a MLL-YAP1 fusion polypeptide that includes a tyrosine kinase domain or a functional fragment thereof. In another embodiment, the nucleotide sequence encodes a fragment of the YAP1 polypeptide including the amino acid sequence of SEQ ID NO:54 or a fragment thereof, or a sequence substantially identical thereto. In other embodiments, the nucleic acid molecule includes a fragment of the MLL gene encoding the amino acid sequence of SEQ ID NO:52 or a fragment thereof, or a sequence substantially identical thereto. In yet other embodiments, the nucleic acid molecule includes a nucleotide sequence encoding the amino acid sequence shown in FIGS. 52A-52B (SEQ ID NO:52), or a fragment thereof, and the amino acid sequence shown in FIG. 54 (SEQ ID NO:54) or a fragment thereof, or a sequence substantially identical thereto.

In one embodiment, the nucleic acid molecule includes a fusion, e.g., an in-frame fusion, between an intron of MLL (e.g., intron 6, or a fragment thereof), and an intron of YAP1 (e.g., intron 6, or a fragment thereof). The MLL-YAP1 fusion can comprise a fusion of the nucleotide sequence of: chromosome 11 at one or more of nucleotide 102,099,656 (plus or minus 10, 20, 30, 50, 60, 70, 80, 100 nucleotides) and chromosome 11 at one or more of nucleotide 118,352,435 (plus or minus 10, 20, 30, 50, 60, 70, 80, 100 nucleotides), or a fragment thereof. In one embodiment, the MLL-YAP1 fusion comprises a fusion of the nucleotide sequence of: chromosome 11 at one or more of nucleotide 102,099,656 (plus or minus 10, 20, 30, 50, 60, 70, 80, 100 nucleotides) and chromosome 11 at one or more of nucleotide 118,352,435 (plus or minus 10, 20, 30, 50, 60, 70, 80, 100 nucleotides), or a fragment thereof.

In another embodiment, the MLL-YAP1 fusion comprises a nucleotide sequence (e.g., a fragment of a nucleotide sequence) shown in FIGS. 51A-51G (SEQ ID NO:51) and a nucleotide sequence (e.g., a fragment of a nucleotide sequence) shown in FIGS. 53A-53C (SEQ ID NO:53), or a fragment of the fusion. In one embodiment, the MLL-YAP1 fusion comprises a nucleotide sequence substantially identical to the nucleotide sequence (e.g., a fragment of a nucleotide sequence) shown in FIGS. 51A-51G (SEQ ID NO:51) and the nucleotide sequence (e.g., a fragment of a nucleotide sequence) shown FIGS. 53A-53C (SEQ ID NO:53), or a fragment of the fusion. In one embodiment, the MLL-YAP1 fusion comprises a nucleotide sequence at least 70%, at least 75%, at least 80%, at least 85%, at least 90%, at least 95%, at least 99%, at least 99.5 or greater, identical to the nucleotide sequence (e.g., a fragment of a nucleotide sequence) shown in FIGS. 51A-51G (SEQ ID NO:51) and to the nucleotide sequence (e.g., a fragment of a nucleotide sequence) shown in FIGS. 53A-53C (SEQ ID NO:53). In one embodiment, the MLL-YAP1 fusion comprises a nucleotide sequence containing at least 25, 50, 100, 150, 200, 500, 1000, 1500, 2000, 2500, 3000, or more nucleotides of the nucleotide sequence shown in FIGS. 51A-51G (SEQ ID NO:51) and a nucleotide sequence containing at least 25, 50, 100, 150, 200, 500, 1000, 1500, 2000, 2500, 3000, or more nucleotides of the nucleotide sequence shown in FIGS. 53A-53C (SEQ ID NO:53). In one embodiment, the MLL-YAP1 fusion comprises a nucleotide sequence containing at least 25, 50, 100, 150, 200, 500, 1000, 1500, 2000, 2500, 3000, or more contiguous nucleotides of the nucleotide sequence shown in FIGS. 51A-51G (SEQ ID NO:51) and a nucleotide sequence containing at least 25, 50, 100, 150, 200, 500, 1000, 1500, 2000, 2500, 3000, or more nucleotides of the nucleotide sequence shown in FIGS. 53A-53C (SEQ ID NO:53).

In another embodiment, the nucleic acid molecule includes a fusion, e.g., an in-frame fusion, of at least exon 6 of MLL or a fragment thereof (e.g., one or more of exons 1-6 of MLL or a fragment thereof), and at least exon 7 or a fragment thereof (e.g., one or more of exon 7 of YAP1 or a fragment thereof). In yet other embodiments, the nucleic acid molecule includes a fragment the nucleotide sequence shown in FIGS. 51A-51G (SEQ ID NO:51) and a fragment of the nucleotide sequence shown in FIGS. 53A-53C (SEQ ID NO:53) or a fragment of the fusion, or a sequence substantially identical thereto.

In one embodiment, the nucleic acid molecule is complementary to at least a portion of a nucleotide sequence disclosed herein, e.g., is capable of hybridizing under a stringency condition described herein to SEQ ID NO:51 and/or SEQ ID NO:53, or a fragment thereof. In yet another embodiment, the nucleic acid molecule hybridizes to a nucleotide sequence that is complementary to at least a portion of a nucleotide sequence disclosed herein, e.g., is capable of hybridizing under a stringency condition to a nucleotide sequence complementary to SEQ ID NO:51 and/or SEQ ID NO:53, or a fragment thereof. The nucleotide sequence of a cDNA encoding an exemplary 5' MLL-3' YAP1 fusion is shown in at least exon 6 (e.g., exons 1-6) of SEQ ID NO:51 and at least exon 6 (e.g., exon 7) of SEQ ID NO:53, and the predicted amino acid sequence is shown in the corresponding encoded exons of SEQ ID NO:52 and the corresponding encoded exons of SEQ ID NO:54, respectively.

In an embodiment the MLL-YAP1 nucleic acid molecule comprises sufficient MLL and sufficient YAP1 sequence such that the encoded 5' MLL-3' YAP1 fusion has kinase activity, e.g., has elevated activity, e.g., YAP1 kinase activity, as compared with wild type YAP1, e.g., in a cell of a cancer referred to herein. In certain embodiments, the 5' MLL-3' YAP1 fusion comprises exons 1-6 from MLL and exon 7 from YAP1. In certain embodiments, the MLL-YAP1 fusion comprises at least 1, 2, 3, 4, 5, 6 or more exons from MLL and at least 1, 2, 3, 4, 5, 6, 7 or more, exons from YAP1. In certain embodiments, the MLL-YAP1 fusion comprises a fusion of exon 6 from MLL and exon 6 from YAP1. In another embodiment, the MLL-YAP1 fusion comprises at least 1, 2, 3, 4, 5, 6 exons from MLL; and at least 1, 2, 3, 4, 5, 6, 7 exons from YAP1.

In one embodiment, the nucleic acid molecule includes a nucleotide sequence that has an in-frame fusion of intron 6 of MLL (e.g., NM_005933) with intron 6 of YAP1 (e.g., NM_006106). In another embodiment, the nucleic acid molecule includes a nucleotide sequence that includes a breakpoint. For example, the nucleic acid molecule includes a nucleotide sequence that includes the fusion junction between the MLL gene and the YAP1 gene, e.g., the breakpoint between intron 6 of MLL and intron 6 of YAP1. In other embodiments, the nucleic acid molecules includes a nucleotide sequence of one or more of nucleotide 102,099,656 of chromosome 11 coupled to (e.g., directly or indirectly juxtaposed to) one or more of nucleotide 118,352,435 of chromosome 11. In one embodiment, the nucleic acid molecule includes the nucleotide sequence of: chromosome 11 at one or more of nucleotide 102,099,656 plus or minus 10, 20, 30, 40 50, 60, 80, 100, 150 nucleotides and chromosome 11 at one or more of nucleotide 118,352,435 plus or minus 10, 20, 30, 40 50, 60, 80, 100, 150 nucleotides (corresponding to the breakpoint of a MLL-YAP1 fusion), or a fragment thereof, or a sequence substantially identical thereto. In one embodiment, the nucleic acid molecule is complementary to at least a portion of a nucleotide sequence disclosed herein, e.g., is capable of hybridizing under a stringency condition described herein to SEQ ID NO:51 and/or SEQ ID NO:53 or a fragment thereof. In yet other embodiment, the nucleic acid molecule hybridizes to a nucleotide sequence that is complementary to at least a portion of a nucleotide sequence disclosed herein, e.g., is capable of hybridizing under a stringency condition described herein to a nucleotide sequence complementary to SEQ ID NO:51 or 53 or a fragment thereof.

In another embodiment, the MLL-YAP1 fusion nucleic acid comprises at least 6, 12, 15, 20, 25, 50, 75, 100 or more nucleotides from exon 6 of MLL (e.g., from the nucleotide sequence of MLL preceding the fusion junction with YAP1, e.g., of the MLL sequence shown in FIGS. 51A-51G (SEQ ID NO:51)), and at least 6, 12, 15, 20, 25, 50, 75, 100 or more nucleotides from exon 6 of YAP1 (e.g., from the nucleotide sequence of YAP1 following the fusion junction with MLL, e.g., of the YAP1 sequence shown in FIGS. 53A-53C (SEQ ID NO:53)).

In other embodiments, the nucleic acid molecule includes a nucleotide sequence encoding a MLL-YAP1 fusion polypeptide that includes a fragment of a MLL gene and a fragment of a YAP1 gene. In one embodiment, the nucleotide sequence encodes a MLL-YAP1 fusion polypeptide that includes e.g., a tyrosine kinase domain or a functional fragment thereof. In yet other embodiments, the nucleic acid molecule includes a nucleotide sequence encoding the amino acid sequence (e.g., a fragment of the amino acid sequence) shown in FIGS. 52A-52B (e.g., SEQ ID NO:52) and a nucleotide sequence encoding the amino acid sequence (e.g., a fragment of the amino acid sequence) shown in FIG. 54 (e.g., SEQ ID NO:54), or a fragment of the fusion, or a sequence substantially identical thereto. In one embodiment, the encoded MLL-YAP1 fusion polypeptide includes a tyrosine kinase domain or a functional fragment thereof.

In a related aspect, the invention features nucleic acid constructs that include the MLL-YAP1 nucleic acid molecules described herein. In certain embodiments, the nucleic acid molecules are operatively linked to a native or a heterologous regulatory sequence. Also included are vectors and host cells that include the MLL-YAP1 nucleic acid molecules described herein, e.g., vectors and host cells suitable for producing the nucleic acid molecules and polypeptides described herein.

In a related aspect, methods of producing the nucleic acid molecules and polypeptides described herein are also described.

In another aspect, the invention features nucleic acid molecules that reduce or inhibit the expression of a nucleic acid molecule that encodes a MLL-YAP1 fusion described herein. Examples of such nucleic acid molecules include, for example, antisense molecules, ribozymes, RNAi, triple helix molecules that hybridize to a nucleic acid encoding MLL-YAP1, or a transcription regulatory region of MLL-YAP1, and blocks or reduces mRNA expression of MLL-YAP1.

Nucleic Acid Detection and Capturing Reagents

The invention also features a nucleic acid molecule, e.g., nucleic acid fragment, suitable as probe, primer, bait or library member that includes, flanks, hybridizes to, which are useful for identifying, or are otherwise based on, the MLL-YAP1 fusions described herein. In certain embodiments, the probe, primer or bait molecule is an oligonucleotide that allows capture, detection or isolation of a MLL-YAP1 fusion nucleic acid molecule described herein. The oligonucleotide can comprise a nucleotide sequence substantially complementary to a fragment of the MLL-YAP1 fusion nucleic acid molecules described herein. The sequence identity between the nucleic acid fragment, e.g., the oligonucleotide, and the target MLL-YAP1 sequence need not be exact, so long as the sequences are sufficiently complementary to allow the capture, detection or isolation of the target sequence. In one embodiment, the nucleic acid fragment is a probe or primer that includes an oligonucleotide between about 5 and 25, e.g., between 10 and 20, or 10 and 15 nucleotides in length. In other embodiments, the nucleic acid fragment is a bait that includes an oligonucleotide between about 100 to 300 nucleotides, 130 and 230 nucleotides, or 150 and 200 nucleotides, in length.

In one embodiment, the nucleic acid fragment can be used to identify or capture, e.g., by hybridization, a MLL-YAP1 fusion. For example, the nucleic acid fragment can be a probe, a primer, or a bait, for use in identifying or capturing, e.g., by hybridization, a MLL-YAP1 fusion described herein. In one embodiment, the nucleic acid fragment can be useful for identifying or capturing a MLL-YAP1 breakpoint, e.g., the nucleotide sequence of: chromosome 11 at nucleotide 102,099,656 plus or minus 10, 20, 30, 40, 50, 60, 80, 100, 150 nucleotides and chromosome 11 at nucleotide 118,352,435 plus or minus 10, 20, 30, 40, 50, 60, 80, 100, 150 nucleotides.

In one embodiment, the nucleic acid fragment hybridizes to a nucleotide sequence within a chromosomal rearrangement that creates an in-frame fusion of intron 6 of MLL with intron 6 of YAP1. In one embodiment, the nucleic acid fragment hybridizes to a nucleotide sequence in the region In other embodiments, the nucleic acid molecules includes a nucleotide sequence in the region of nucleotides 102,099,656 of chromosome 11 coupled to (e.g., juxtaposed to) nucleotides in the region of nucleotides 118,352,435 of chromosome 11. In one embodiment, the nucleic acid fragment hybridizes to a nucleotide sequence that includes a breakpoint, e.g., the nucleotide sequence of: chromosome 11 at nucleotide 102,099,656 plus or minus 10, 20, 30, 40, 50, 60, 80, 100, 150 or more nucleotides and chromosome 11 at nucleotide 118,352,435 plus or minus 10, 20, 30, 40 50, 60, 80, 100, 150 or more nucleotides. For example, the nucleic acid fragment can hybridize to a nucleotide sequence that includes the fusion junction between the MLL gene and the YAP1 gene, e.g., a nucleotide sequence that includes a portion of a nucleotide sequence within intron 6 of a MLL gene and intron 6 of a YAP1 gene.

In another embodiment, the nucleic acid fragment hybridizes to a nucleotide sequence that comprises at least 6, 12, 15, 20, 25, 50, 75, 100, 150 or more nucleotides from exon 6 of MLL (e.g., from the nucleotide sequence of MLL preceding the fusion junction with YAP1, e.g., of the MLL sequence shown in FIGS. 51A-51G (SEQ ID NO:51)), and at least 6, 12, 15, 20, 25, 50, 75, 100, 150 or more nucleotides from exon 7 of YAP1 (e.g., from the nucleotide sequence of YAP1 following the fusion junction with MLL, e.g., of the YAP1 sequence shown in FIGS. 53A-53C (SEQ ID NO:53)).

The probes or primers described herein can be used, for example, for FISH detection or PCR amplification. In one exemplary embodiment where detection is based on PCR, amplification of the MLL-YAP1 fusion junction fusion junction can be performed using a primer or a primer pair, e.g., for amplifying a sequence flanking the fusion junctions described herein, e.g., the mutations or the junction of a chromosomal rearrangement described herein, e.g., MLL-YAP1.

In one embodiment, a pair of isolated oligonucleotide primers can amplify a region containing or adjacent to a position in the MLL-YAP1 fusion. For example, forward primers can be designed to hybridize to a nucleotide sequence within MLL genomic or mRNA sequence (e.g., a nucleotide sequence within exon 6 of MLL of SEQ ID NO:51), and the reverse primers can be designed to hybridize to a nucleotide sequence of YAP1 (e.g., a nucleotide sequence within exon 7 of YAP1, of SEQ ID NO:53).

In another embodiment, the nucleic acid fragments can be used to identify, e.g., by hybridization, a MLL-YAP1 fusion. In one embodiment, the nucleic acid fragment hybridizes to a nucleotide sequence that includes a fusion junction between the MLL transcript and the YAP1 transcript.

In other embodiments, the nucleic acid fragment includes a bait that comprises a nucleotide sequence that hybridizes to a MLL-YAP1 fusion nucleic acid molecule described herein, and thereby allows the capture or isolation said nucleic acid molecule. In one embodiment, a bait is suitable for solution phase hybridization. In other embodiments, a bait includes a binding entity, e.g., an affinity tag, that allows capture and separation, e.g., by binding to a binding entity, of a hybrid formed by a bait and a nucleic acid hybridized to the bait.

In other embodiments, the nucleic acid fragment includes a library member comprising a MLL-YAP1 nucleic acid molecule described herein. In one embodiment, the library member includes a rearrangement that results in a MLL-YAP1 fusion described herein.

The nucleic acid fragment can be detectably labeled with, e.g., a radiolabel, a fluorescent label, a bioluminescent label, a chemiluminescent label, an enzyme label, a binding pair label, or can include an affinity tag; a tag, or identifier (e.g., an adaptor, barcode or other sequence identifier).

MLL-YAP1 Fusion Polypeptides

In another embodiment, the MLL-YAP1 fusion comprises an amino acid sequence (e.g., a fragment of the amino acid sequence) shown in FIGS. 52A-52B (SEQ ID NO:52) and an amino acid sequence (e.g., a fragment of the amino acid sequence) shown in FIG. 54 (SEQ ID NO:54), or a fragment of the fusion. In one embodiment, the MLL-YAP1 fusion comprises an amino acid sequence substantially identical to the amino acid sequence (e.g., a fragment of the amino acid sequence) shown in FIGS. 52A-52B (SEQ ID NO:52) and the amino acid sequence (e.g., a fragment of the amino acid sequence) shown in FIG. 54 (SEQ ID NO:54), or a fragment thereof. In one embodiment, the MLL-YAP1 fusion comprises an amino acid sequence at least 70%, at least 75%, at least 80%, at least 85%, at least 90%, at least 95%, at least 99%, at least 99.5 or greater, identical to the amino acid sequence (e.g., a fragment of the amino acid sequence) shown in FIGS. 52A-52B (SEQ ID NO:52) and the amino acid sequence (e.g., a fragment of the amino acid sequence) shown in FIG. 54 (SEQ ID NO:54). In one embodiment, the MLL-YAP1 fusion comprises a sequence containing at least 10, 20, 50, 100, 500, 600, 700, 800, 900, 1000, or more amino acids of the amino acid sequence shown in FIGS. 52A-52B (SEQ ID NO:52) and FIG. 54 (SEQ ID NO:54). In one embodiment, the MLL-YAP1 fusion comprises an amino acid sequence containing at least 5, 10, 20, 50, 100, 500, 600, 700, 800, 900, 1000, or more contiguous amino acids of the amino acid sequence shown in FIGS. 52A-52B (SEQ ID NO:52) and at least 5, 10, 20, 50, 100, 500, 600, 700, 800, 900, 1000, or more contiguous amino acids of the amino acid sequence shown in FIG. 54 (SEQ ID NO:54). In one embodiment, the 5' MLL-3' YAP1 fusion polypeptide includes a receptor tyrosine kinase domain or a functional fragment thereof. In an embodiment, the 5'MLL-3'YAP1 fusion polypeptide comprises sufficient YAP1 and sufficient MLL sequence such that it has kinase activity, e.g., has elevated activity, e.g., kinase activity, as compared with wild type, e.g., in a cell of a cancer referred to herein.

In another aspect, the invention features a MLL-YAP1 fusion polypeptide (e.g., a purified MLL-YAP1 fusion polypeptide), a biologically active or antigenic fragment thereof, as well as reagents (e.g., antibody molecules that bind to a MLL-YAP1 fusion polypeptide), methods for modulating a MLL-YAP1 polypeptide activity and detection of a MLL-YAP1 polypeptide.

In one embodiment, the MLL-YAP1 fusion polypeptide has at least one biological activity. In one embodiment, at least one biological activity of the MLL-YAP1 fusion polypeptide is reduced or inhibited by an anti-cancer drug, e.g., a MLL inhibitor, a YAP1 inhibitor. In one embodiment, at least one biological activity of the MLL-YAP1 fusion polypeptide is reduced or inhibited by a YAP1 inhibitor. In one embodiment, at least one biological activity of the MLL-YAP1 fusion polypeptide is reduced or inhibited by an MLL inhibitor.

In yet other embodiments, the MLL-YAP1 fusion polypeptide is encoded by a nucleic acid molecule described herein. In one embodiment, the MLL-YAP1 fusion polypeptide is encoded by an in-frame fusion of intron 6 of MLL with intron 6 of YAP1 (e.g., a sequence on chromosome 11 and a sequence on chromosome 11). In another embodiment, the MLL-YAP1 fusion polypeptide includes an amino acid sequence encoded by a nucleotide sequence comprising a fusion junction between the MLL transcript and the YAP1 transcript.

In certain embodiments, the MLL-YAP1 fusion polypeptide comprises one or more of encoded exons 1-6 from MLL and one or more of encoded exon 7 of YAP1. In certain embodiments, the MLL-YAP1 fusion polypeptide comprises at least 1, 2, 3, 4, 5, 6 or more encoded exons from MLL and at least 1, 2, 3, 4, 5, 6, 7 or more, encoded exons from YAP1. In certain embodiments, the MLL-YAP1 fusion polypeptide comprises a fusion of encoded exon 6 from MLL and encoded exon 6 from YAP1 (or a fragment thereof). In other embodiments, the fusion comprises least 1, 2, 3, 4, 5, 6 encoded exons from MLL; and at least 1, 2, 3, 4, 5, 6, 7 encoded exons from YAP1. In certain embodiments, the MLL-YAP1 fusion polypeptide comprises encoded exons 1-6 from MLL and exon 7 of YAP1. In certain embodiments, the 5' MLL-3' YAP1 fusion polypeptide comprises a fusion junction of the sequence of exon 6 from MLL and the sequence of exon 7 from YAP1.

In certain embodiments, the MLL-YAP1 fusion comprises the amino acid sequence corresponding to exon 6 or a fragment thereof from MLL, and the amino acid sequence corresponding to exon 7 or a fragment thereof from YAP1 (e.g., as shown in FIGS. 52A-52B (SEQ ID NO:52) and FIG. 54 (SEQ ID NO:54)). In one embodiment, the MLL-YAP1 fusion comprises at least 5, 10, 15, 20 or more amino acids from exon 6 of MLL (e.g., from the amino acid sequence of MLL preceding the fusion junction with YAP1, e.g., of the MLL sequence shown in FIGS. 52A-52B (SEQ ID NO:52)), and at least 5, 10, 15, 20 or more amino acids from exon 7 of YAP1 (e.g., from the amino acid sequence of YAP1 following the fusion junction with MLL, e.g., of the YAP1 sequence shown in FIG. 54 (SEQ ID NO:54)).

In one embodiment, the MLL-YAP1 fusion polypeptide includes a tyrosine kinase domain or a functional fragment thereof. In a related aspect, the invention features MLL-YAP1 fusion polypeptide or fragments operatively linked to heterologous polypeptides to form fusion proteins.

In another embodiment, the MLL-YAP1 fusion polypeptide or fragment is a peptide, e.g., an immunogenic peptide or protein, that contains a fusion junction described herein. Such immunogenic peptides or proteins can be used to raise antibodies specific to the fusion protein. In other embodiments, such immunogenic peptides or proteins can be used for vaccine preparation. The vaccine preparation can include other components, e.g., an adjuvant.

In another aspect, the invention features antibody molecules that bind to a MLL-YAP1 fusion polypeptide or fragment described herein. In embodiments, the antibody can distinguish wild type YAP1 (or MLL) from MLL-YAP1.

Detection Reagents and Detection of Mutations

In another aspect, the invention features a detection reagent, e.g., a purified or an isolated preparation thereof. Detection reagents can distinguish a nucleic acid, or protein sequence, having a breakpoint, e.g., a MLL-YAP1 breakpoint; from a reference sequence. In one embodiment, the detection reagent detects (e.g., specifically detects) a MLL-YAP1 fusion nucleic acid or a polypeptide (e.g., distinguishes a wild type YAP1 or another YAP1 fusion (or MLL) from a MLL-YAP1 nucleic acid (e.g., as described herein in FIGS. 51A-51G (SEQ ID NO:51) and FIGS. 53A-53C (SEQ ID NO:53); or a MLL-YAP1 polypeptide (e.g., as described herein in FIGS. 52A-52B (SEQ ID NO:52) and FIG. 54 (SEQ ID NO:54).

Detection reagents, e.g., nucleic acid-based detection reagents, can be used to identify mutations in a target nucleic acid, e.g., DNA, e.g., genomic DNA or cDNA, or RNA, e.g., in a sample, e.g., a sample of nucleic acid derived from a neoplastic or tumor cell, e.g., a melanocytic neoplasm, melanoma or metastatic cell. Detection reagents, e.g., antibody-based detection reagents, can be used to identify mutations in a target protein, e.g., in a sample, e.g., a sample of protein derived from, or produced by, a neoplastic or tumor cell, e.g., a melanocytic neoplasm, melanoma or metastatic cell.

Method of Treatment

In a related aspect, a method of inhibiting, reducing, or treating a hyperproliferative disorder, e.g., a neoplasm (including benign, pre-malignant or malignant (e.g., a cancer), in a subject is provided. The method includes administering to the subject a preselected therapeutic agent, e.g., an anti-cancer agent (e.g., a kinase inhibitor), as a single agent, or in combination, in an amount sufficient to reduce, inhibit or treat the activity or expression of MLL-YAP1 (e.g., a MLL-YAP1 fusion described herein), thereby inhibiting, reducing, or treating the hyperproliferative disorder in the subject.

In one embodiment, the subject treated has a MLL-YAP1 fusion; e.g., the subject has a tumor or cancer harboring a MLL-YAP1 fusion. In other embodiments, the subject has been previously identified as having a MLL-YAP1 fusion. In yet other embodiments, the subject has been previously identified as being likely or unlikely to respond to treatment with a protein kinase inhibitor, e.g., a subject that has previously participated in a clinical trial. In other embodiments, the subject has been previously identified as being likely or unlikely to respond to treatment with a protein kinase inhibitor, based on the presence of the MLL-YAP1 fusion. In one embodiment, the subject is a mammal, e.g., a human. In one embodiment, the subject has, or at risk of having a cancer at any stage of disease. In other embodiments, the subject is a patient, e.g., a cancer patient.

In certain embodiments, the neoplasm or neoplastic cell is a benign, pre-malignant, malignant (cancer) or metastasis. In certain embodiments, the cancer is a solid tumor, a soft tissue tumor, or a metastatic lesion.

In one embodiment, the neoplasm or neoplastic cell is a benign, pre-malignant, malignant (cancer) or metastasis. In certain embodiments, the cancer is a solid tumor, a soft tissue tumor, or a metastatic lesion. In one embodiment, the cancer is chosen from a lung cancer, a pancreatic cancer, melanoma, a colorectal cancer, an esophageal-gastric cancer, a thyroid cancer, or an adenocarcinoma. In one embodiment, the cancer is a lung adenocarcinoma. In other embodiment, the lung cancer is chosen from one or more of the following: non-small cell lung cancer (NSCLC), small cell lung cancer (SCLC), squamous cell carcinoma (SCC), adenocarcinoma of the lung, bronchogenic carcinoma, or a combination thereof. In one embodiment, the lung cancer is NSCLC or SCC. In certain embodiments, the cancer is leukemia. In certain embodiments, the cancer is a sarcoma, e.g., a soft tissue sarcoma. In certain embodiments, the cancer is a carcinosarcoma, e.g., an addominal carcinosarcoma.

In one embodiment, the anti-cancer agent is a YAP1 inhibitor. In one embodiment, the anti-cancer agent is a MLL inhibitor. In one embodiment, the anti-cancer agent is a kinase inhibitor. In some embodiments the YAP1 inhibitor is a YAP1 inhibitor described herein. In some embodiments the MLL inhibitor is a MLL inhibitor described herein.

TMPRSS2-MX1 Fusions

In one embodiment, a fusion includes an in-frame fusion of an exon of transmembrane protease serine 2 (TMPRSS2), e.g., one more exons of TMPRSS2 (e.g., one or more of exon 1 of TMPRSS2) or a fragment thereof, and an exon of myxoma resistance protein 1 (MX1), e.g., one or more exons of a MX1 (e.g., one or more of exons 16-19 of MX1) or a fragment thereof. For example, the TMPRSS2-MX1 fusion can include an in-frame fusion within an intron of TMPRSS2 (e.g., intron 1) or a fragment thereof, with an intron of MX1 (e.g., intron 15) or a fragment thereof. In one embodiment, the fusion of the TMPRSS2-MX1 fusion comprises the nucleotide sequence of: chromosome 21 at one or more of nucleotide 42,874,744 (plus or minus 10, 20, 30, 50, 60, 70, 80, 100 or more nucleotides) and chromosome 21 at one or more of nucleotide 42,820,221 (plus or minus 10, 20, 30, 50, 60, 70, 80, 100 or more nucleotides).

In certain embodiments, the TMPRSS2-MX1 fusion is in a 5'-TMPRSS2 to 3'-MX1 configuration (also referred to herein as "5'-TMPRSS2-MX1-3')." The term "fusion" or "fusion molecule" can refer to a polypeptide or a nucleic acid fusion, depending on the context. It may include a full-length sequence of a fusion or a fragment thereof, e.g., a fusion junction (e.g., a fragment including a portion of TMPRSS2 and a portion of MX1, e.g., a portion of the TMPRSS2-MX1 fusion described herein). In one embodiment, the TMPRSS2-MX1 fusion polypeptide includes a fragment of the amino acid sequence shown in FIG. 56 (SEQ ID NO:56) and a fragment of the amino acid sequence shown in FIG. 58 (SEQ ID NO:58), or an amino acid sequence substantially identical thereto. In another embodiment, the TMPRSS2-MX1 fusion nucleic acid includes a fragment of the nucleotide sequence shown in FIGS. 55A-55B (SEQ ID NO:55) and a fragment of the nucleotide sequence shown in FIGS. 57A-57B (SEQ ID NO:57), or a nucleotide sequence substantially identical thereto. In one embodiment, the TMPRSS2-MX1 fusion polypeptide comprises sufficient TMPRSS2 and sufficient MX1 sequence such that the 5' TMPRSS2-3' MX1 fusion has kinase activity, e.g., has elevated activity, e.g., tyrosine kinase activity, as compared with wild type, e.g., in a cell of a cancer referred to herein.

In certain embodiments, the TMPRSS2-MX1 fusion comprises one or more (or all of) exon 1 from TMPRSS2 and one or more (or all of) exons 16-19 of MX1 (e.g., one or more of the exons shown in FIGS. 55A-55B (SEQ ID NO:55) and FIGS. 57A-57B (SEQ ID NO:57). In another embodiment, the TMPRSS2-MX1 fusion comprises one or more (or all of) exon 1 of TMPRSS2 and one or more (or all of) exons 16-19 of MX1. In certain embodiments, the TMPRSS2-MX1 fusion comprises at least 1 or more exons (or encoded exons) from TMPRSS2 and at least 1, 2, 3, 4 or more exons (or encoded exons) from MX1 (e.g., from the TMPRSS2 and MX1 sequences shown in FIGS. 55A-55B and FIG. 56 (SEQ ID NO:55 and 56) and FIGS. 57A-57B and FIG. 58 (SEQ ID NOs:57 and 58).

In certain embodiments, the TMPRSS2-MX1 fusion comprises exon 6 or a fragment thereof from TMPRSS2, and exons 16 or a fragment thereof from MX1 (e.g., as shown in FIGS. 55A-55B (SEQ ID NO:55) and FIGS. 57A-57B (SEQ ID NO:57)). In one embodiment, the TMPRSS2-MX1 fusion comprises at least 5, 10, 15, 20, 30, 40, 50 or more amino acids from exon 6 of TMPRSS2 (e.g., from the amino acid sequence of TMPRSS2 as shown in FIG. 56 (SEQ ID NO:56) (e.g., from the amino acid sequence of TMPRSS2 preceding the fusion junction with MX1, and at least 5, 10, 15, 20, 30, 40, 50 or more amino acids from exon 16 of MX1 (e.g., from the amino acid sequence of MX1 as shown in FIG. 58 (SEQ ID NO:58)). In another embodiment, the TMPRSS2-MX1 fusion comprises at least 6, 12, 15, 20, 25, 50, 75, 100 or more nucleotides from exon 6 of TMPRSS2 (e.g., from the nucleotide sequence of TMPRSS2 as shown in FIGS. 55A-55B (SEQ ID NO:55) (e.g., from the nucleotide sequence of TMPRSS2 preceding the fusion junction with MX1); and at least 6, 12, 15, 20, 25, 50, 75, 100 or more nucleotides from exons 16-19 of MX1 (e.g., from the nucleotide sequence of MX1 as shown in FIGS. 57A-57B (SEQ ID NO:57)).

TMPRSS2-MX1 Nucleic Acid Molecules

In one aspect, the invention features a nucleic acid molecule (e.g., an isolated or purified) nucleic acid molecule that includes a fragment of a TMPRSS2 gene and a fragment of a MX1 gene. In one embodiment, the nucleotide sequence encodes a TMPRSS2-MX1 fusion polypeptide that includes a tyrosine kinase domain or a functional fragment thereof. In another embodiment, the nucleotide sequence encodes a fragment of the MX1 polypeptide including the amino acid sequence of SEQ ID NO:58 or a fragment thereof, or a sequence substantially identical thereto. In other embodiments, the nucleic acid molecule includes a fragment of the TMPRSS2 gene encoding the amino acid sequence of SEQ ID NO:56 or a fragment thereof, or a sequence substantially identical thereto. In yet other embodiments, the nucleic acid molecule includes a nucleotide sequence encoding the amino acid sequence shown in FIG. 56 (SEQ ID NO:56), or a fragment thereof, and the amino acid sequence shown in FIG. 58 (SEQ ID NO:58) or a fragment thereof, or a sequence substantially identical thereto.

In one embodiment, the nucleic acid molecule includes a fusion, e.g., an in-frame fusion, between an intron of TMPRSS2 (e.g., intron 1, or a fragment thereof), and an intron of MX1 (e.g., intron 15, or a fragment thereof). The TMPRSS2-MX1 fusion can comprise a fusion of the nucleotide sequence of: chromosome 21 at one or more of nucleotide 42,874,744 (plus or minus 10, 20, 30, 50, 60, 70, 80, 100 nucleotides) and chromosome 21 at one or more of nucleotide 42,820,221 (plus or minus 10, 20, 30, 50, 60, 70, 80, 100 nucleotides), or a fragment thereof. In one embodiment, the TMPRSS2-MX1 fusion comprises a fusion of the nucleotide sequence of: chromosome 21 at one or more of nucleotide 42,874,744 (plus or minus 10, 20, 30, 50, 60, 70, 80, 100 nucleotides) and chromosome 21 at one or more of nucleotide 42,820,221 (plus or minus 10, 20, 30, 50, 60, 70, 80, 100 nucleotides), or a fragment thereof.

In another embodiment, the TMPRSS2-MX1 fusion comprises a nucleotide sequence (e.g., a fragment of a nucleotide sequence) shown in FIGS. 55A-55B (SEQ ID NO:55) and a nucleotide sequence (e.g., a fragment of a nucleotide sequence) shown in FIGS. 57A-57B (SEQ ID NO:57), or a fragment of the fusion. In one embodiment, the TMPRSS2-MX1 fusion comprises a nucleotide sequence substantially identical to the nucleotide sequence (e.g., a fragment of a nucleotide sequence) shown in FIGS. 55A-55B (SEQ ID NO:55) and the nucleotide sequence (e.g., a fragment of a nucleotide sequence) shown FIGS. 57A-57B (SEQ ID NO:57), or a fragment of the fusion. In one embodiment, the TMPRSS2-MX1 fusion comprises a nucleotide sequence at least 70%, at least 75%, at least 80%, at least 85%, at least 90%, at least 95%, at least 99%, at least 99.5 or greater, identical to the nucleotide sequence (e.g., a fragment of a nucleotide sequence) shown in FIGS. 55A-55B (SEQ ID NO:55) and to the nucleotide sequence (e.g., a fragment of a nucleotide sequence) shown in FIGS. 57A-57B (SEQ ID NO:57). In one embodiment, the TMPRSS2-MX1 fusion comprises a nucleotide sequence containing at least 25, 50, 100, 150, 200, 500, 1000, 1500, 2000, 2500, 3000, or more nucleotides of the nucleotide sequence shown in FIGS. 55A-55B (SEQ ID NO:55) and a nucleotide sequence containing at least 25, 50, 100, 150, 200, 500, 1000, 1500, 2000, 2500, 3000, or more nucleotides of the nucleotide sequence shown in FIGS. 57A-57B (SEQ ID NO:57). In one embodiment, the TMPRSS2-MX1 fusion comprises a nucleotide sequence containing at least 25, 50, 100, 150, 200, 500, 1000, 1500, 2000, 2500, 3000, or more contiguous nucleotides of the nucleotide sequence shown in FIGS. 55A-55B (SEQ ID NO:55) and a nucleotide sequence containing at least 25, 50, 100, 150, 200, 500, 1000, 1500, 2000, 2500, 3000, or more nucleotides of the nucleotide sequence shown in FIGS. 57A-57B (SEQ ID NO:57).

In another embodiment, the nucleic acid molecule includes a fusion, e.g., an in-frame fusion, of at least exon 1 of TMPRSS2 or a fragment thereof (e.g., one or more of exon 1 of TMPRSS2 or a fragment thereof), and at least exon 16 or a fragment thereof (e.g., one or more of exons 16-19 of MX1 or a fragment thereof). In yet other embodiments, the nucleic acid molecule includes a fragment the nucleotide sequence shown in FIGS. 55A-55B (SEQ ID NO:55) and a fragment of the nucleotide sequence shown in FIGS. 57A-57B (SEQ ID NO:57) or a fragment of the fusion, or a sequence substantially identical thereto.

In one embodiment, the nucleic acid molecule is complementary to at least a portion of a nucleotide sequence disclosed herein, e.g., is capable of hybridizing under a stringency condition described herein to SEQ ID NO:55 and/or SEQ ID NO:57, or a fragment thereof. In yet another embodiment, the nucleic acid molecule hybridizes to a nucleotide sequence that is complementary to at least a portion of a nucleotide sequence disclosed herein, e.g., is capable of hybridizing under a stringency condition to a nucleotide sequence complementary to SEQ ID NO:55 and/or SEQ ID NO:57, or a fragment thereof. The nucleotide sequence of a cDNA encoding an exemplary 5' TMPRSS2-3' MX1 fusion is shown in at least exon 1 (e.g., exon 1) of SEQ ID NO:55 and at least exon 16 (e.g., exons 16-19) of SEQ ID NO:57, and the predicted amino acid sequence is shown in the corresponding encoded exons of SEQ ID NO:56 and the corresponding encoded exons of SEQ ID NO:58, respectively.

In an embodiment the TMPRSS2-MX1 nucleic acid molecule comprises sufficient TMPRSS2 and sufficient MX1 sequence such that the encoded 5' TMPRSS2-3' MX1 fusion has kinase activity, e.g., has elevated activity, e.g., MX1 kinase activity, as compared with wild type MX1, e.g., in a cell of a cancer referred to herein. In certain embodiments, the 5' TMPRSS2-3' MX1 fusion comprises exon 1 from TMPRSS2 and exons 16-19 from MX1. In certain embodiments, the TMPRSS2-MX1 fusion comprises at least 1 or more exons from TMPRSS2 and at least 1, 2, 3, 4 or more, exons from MX1. In certain embodiments, the TMPRSS2-MX1 fusion comprises a fusion of exon 1 from TMPRSS2 and exon 16 from MX1. In another embodiment, the TMPRSS2-MX1 fusion comprises at least 1 exons from TMPRSS2; and at least 1, 2, 3, 4 exons from MX1.

In one embodiment, the nucleic acid molecule includes a nucleotide sequence that has an in-frame fusion of intron 1 of TMPRSS2 (e.g., NM_001135099) with intron 1 of MX1 (e.g., NM_001144925). In another embodiment, the nucleic acid molecule includes a nucleotide sequence that includes a breakpoint. For example, the nucleic acid molecule includes a nucleotide sequence that includes the fusion junction between the TMPRSS2 gene and the MX1 gene, e.g., the breakpoint between intron 1 of TMPRSS2 and intron 15 of MX1. In other embodiments, the nucleic acid molecules includes a nucleotide sequence of one or more of nucleotide 42,874,744 of chromosome 21 coupled to (e.g., directly or indirectly juxtaposed to) one or more of nucleotide 42,820,221 of chromosome 21. In one embodiment, the nucleic acid molecule includes the nucleotide sequence of: chromosome 21 at one or more of nucleotide 42,874,744 plus or minus 10, 20, 30, 40 50, 60, 80, 100, 150 nucleotides and chromosome 21 at one or more of nucleotide 42,820,221 plus or minus 10, 20, 30, 40 50, 60, 80, 100, 150 nucleotides (corresponding to the breakpoint of a TMPRSS2-MX1 fusion), or a fragment thereof, or a sequence substantially identical thereto. In one embodiment, the nucleic acid molecule is complementary to at least a portion of a nucleotide sequence disclosed herein, e.g., is capable of hybridizing under a stringency condition described herein to SEQ ID NO:55 and/or SEQ ID NO:57 or a fragment thereof. In yet other embodiment, the nucleic acid molecule hybridizes to a nucleotide sequence that is complementary to at least a portion of a nucleotide sequence disclosed herein, e.g., is capable of hybridizing under a stringency condition described herein to a nucleotide sequence complementary to SEQ ID NO:55 or 57 or a fragment thereof.

In another embodiment, the TMPRSS2-MX1 fusion nucleic acid comprises at least 6, 12, 15, 20, 25, 50, 75, 100 or more nucleotides from exon 6 of TMPRSS2 (e.g., from the nucleotide sequence of TMPRSS2 preceding the fusion junction with MX1, e.g., of the TMPRSS2 sequence shown in FIGS. 55A-55B (SEQ ID NO:55)), and at least 6, 12, 15, 20, 25, 50, 75, 100 or more nucleotides from exon 6 of MX1 (e.g., from the nucleotide sequence of MX1 following the fusion junction with TMPRSS2, e.g., of the MX1 sequence shown in FIGS. 57A-57B (SEQ ID NO:57)).

In other embodiments, the nucleic acid molecule includes a nucleotide sequence encoding a TMPRSS2-MX1 fusion polypeptide that includes a fragment of a TMPRSS2 gene and a fragment of a MX1 gene. In one embodiment, the nucleotide sequence encodes a TMPRSS2-MX1 fusion polypeptide that includes e.g., a tyrosine kinase domain or a functional fragment thereof. In yet other embodiments, the nucleic acid molecule includes a nucleotide sequence encoding the amino acid sequence (e.g., a fragment of the amino acid sequence) shown in FIG. 56 (e.g., SEQ ID NO:56) and a nucleotide sequence encoding the amino acid sequence (e.g., a fragment of the amino acid sequence) shown in FIG. 58 (e.g., SEQ ID NO:58), or a fragment of the fusion, or a sequence substantially identical thereto. In one embodiment, the encoded TMPRSS2-MX1 fusion polypeptide includes a tyrosine kinase domain or a functional fragment thereof.

In a related aspect, the invention features nucleic acid constructs that include the TMPRSS2-MX1 nucleic acid molecules described herein. In certain embodiments, the nucleic acid molecules are operatively linked to a native or a heterologous regulatory sequence. Also included are vectors and host cells that include the TMPRSS2-MX1 nucleic acid molecules described herein, e.g., vectors and host cells suitable for producing the nucleic acid molecules and polypeptides described herein.

In a related aspect, methods of producing the nucleic acid molecules and polypeptides described herein are also described.

In another aspect, the invention features nucleic acid molecules that reduce or inhibit the expression of a nucleic acid molecule that encodes a TMPRSS2-MX1 fusion described herein. Examples of such nucleic acid molecules include, for example, antisense molecules, ribozymes, RNAi, triple helix molecules that hybridize to a nucleic acid encoding TMPRSS2-MX1, or a transcription regulatory region of TMPRSS2-MX1, and blocks or reduces mRNA expression of TMPRSS2-MX1.

Nucleic Acid Detection and Capturing Reagents

The invention also features a nucleic acid molecule, e.g., nucleic acid fragment, suitable as probe, primer, bait or library member that includes, flanks, hybridizes to, which are useful for identifying, or are otherwise based on, the TMPRSS2-MX1 fusions described herein. In certain embodiments, the probe, primer or bait molecule is an oligonucleotide that allows capture, detection or isolation of a TMPRSS2-MX1 fusion nucleic acid molecule described herein. The oligonucleotide can comprise a nucleotide sequence substantially complementary to a fragment of the TMPRSS2-MX1 fusion nucleic acid molecules described herein. The sequence identity between the nucleic acid fragment, e.g., the oligonucleotide, and the target TMPRSS2-MX1sequence need not be exact, so long as the sequences are sufficiently complementary to allow the capture, detection or isolation of the target sequence. In one embodiment, the nucleic acid fragment is a probe or primer that includes an oligonucleotide between about 5 and 25, e.g., between 10 and 20, or 10 and 15 nucleotides in length. In other embodiments, the nucleic acid fragment is a bait that includes an oligonucleotide between about 100 to 300 nucleotides, 130 and 230 nucleotides, or 150 and 200 nucleotides, in length.

In one embodiment, the nucleic acid fragment can be used to identify or capture, e.g., by hybridization, a TMPRSS2-MX1 fusion. For example, the nucleic acid fragment can be a probe, a primer, or a bait, for use in identifying or capturing, e.g., by hybridization, a TMPRSS2-MX1 fusion described herein. In one embodiment, the nucleic acid fragment can be useful for identifying or capturing a TMPRSS2-MX1 breakpoint, e.g., the nucleotide sequence of: chromosome 21 at nucleotide 42,874,744 plus or minus 10, 20, 30, 40, 50, 60, 80, 100, 150 nucleotides and chromosome 21 at nucleotide 42,820,221 plus or minus 10, 20, 30, 40 50, 60, 80, 100, 150 nucleotides.

In one embodiment, the nucleic acid fragment hybridizes to a nucleotide sequence within a chromosomal rearrangement that creates an in-frame fusion of intron 1 of TMPRSS2 with intron 15 of MX1. In one embodiment, the nucleic acid fragment hybridizes to a nucleotide sequence in the region In other embodiments, the nucleic acid molecules includes a nucleotide sequence in the region of nucleotides 42,874,744 of chromosome 21 coupled to (e.g., juxtaposed to) nucleotides in the region of nucleotides 42,820,221 of chromosome 21. In one embodiment, the nucleic acid fragment hybridizes to a nucleotide sequence that includes a breakpoint, e.g., the nucleotide sequence of: chromosome 21 at nucleotide 42,874,744 plus or minus 10, 20, 30, 40 50, 60, 80, 100, 150 or more nucleotides and chromosome 21 at nucleotide 42,820,221 plus or minus 10, 20, 30, 40 50, 60, 80, 100, 150 or more nucleotides. For example, the nucleic acid fragment can hybridize to a nucleotide sequence that includes the fusion junction between the TMPRSS2 gene and the MX1 gene, e.g., a nucleotide sequence that includes a portion of a nucleotide sequence within intron 1 of a TMPRSS2 gene and intron 15 of a MX1 gene.

In another embodiment, the nucleic acid fragment hybridizes to a nucleotide sequence that comprises at least 6, 12, 15, 20, 25, 50, 75, 100, 150 or more nucleotides from exon 6 of TMPRSS2 (e.g., from the nucleotide sequence of TMPRSS2 preceding the fusion junction with MX1, e.g., of the TMPRSS2 sequence shown in FIGS. 55A-55B (SEQ ID NO:55)), and at least 6, 12, 15, 20, 25, 50, 75, 100, 150 or more nucleotides from exons 16-19 of MX1 (e.g., from the nucleotide sequence of MX1 following the fusion junction with TMPRSS2, e.g., of the MX1 sequence shown in FIGS. 57A-57B (SEQ ID NO:57)).

The probes or primers described herein can be used, for example, for FISH detection or PCR amplification. In one exemplary embodiment where detection is based on PCR, amplification of the TMPRSS2-MX1 fusion junction fusion junction can be performed using a primer or a primer pair, e.g., for amplifying a sequence flanking the fusion junctions described herein, e.g., the mutations or the junction of a chromosomal rearrangement described herein, e.g., TMPRSS2-MX1.

In one embodiment, a pair of isolated oligonucleotide primers can amplify a region containing or adjacent to a position in the TMPRSS2-MX1 fusion. For example, forward primers can be designed to hybridize to a nucleotide sequence within TMPRSS2 genomic or mRNA sequence (e.g., a nucleotide sequence within exon 6 of TMPRSS2 of SEQ ID NO:55), and the reverse primers can be designed to hybridize to a nucleotide sequence of MX1 (e.g., a nucleotide sequence within exons 16-19 of MX1, of SEQ ID NO:57).

In another embodiment, the nucleic acid fragments can be used to identify, e.g., by hybridization, a TMPRSS2-MX1 fusion. In one embodiment, the nucleic acid fragment hybridizes to a nucleotide sequence that includes a fusion junction between the TMPRSS2 transcript and the MX1 transcript.

In other embodiments, the nucleic acid fragment includes a bait that comprises a nucleotide sequence that hybridizes to a TMPRSS2-MX1 fusion nucleic acid molecule described herein, and thereby allows the capture or isolation said nucleic acid molecule. In one embodiment, a bait is suitable for solution phase hybridization. In other embodiments, a bait includes a binding entity, e.g., an affinity tag, that allows capture and separation, e.g., by binding to a binding entity, of a hybrid formed by a bait and a nucleic acid hybridized to the bait.

In other embodiments, the nucleic acid fragment includes a library member comprising a TMPRSS2-MX1 nucleic acid molecule described herein. In one embodiment, the library member includes a rearrangement that results in a TMPRSS2-MX1 fusion described herein.

The nucleic acid fragment can be detectably labeled with, e.g., a radiolabel, a fluorescent label, a bioluminescent label, a chemiluminescent label, an enzyme label, a binding pair label, or can include an affinity tag; a tag, or identifier (e.g., an adaptor, barcode or other sequence identifier).

TMPRSS2-MX1 Fusion Polypeptides

In another embodiment, the TMPRSS2-MX1 fusion comprises an amino acid sequence (e.g., a fragment of the amino acid sequence) shown in FIG. 56 (SEQ ID NO:56) and an amino acid sequence (e.g., a fragment of the amino acid sequence) shown in FIG. 58 (SEQ ID NO:58), or a fragment of the fusion. In one embodiment, the TMPRSS2-MX1 fusion comprises an amino acid sequence substantially identical to the amino acid sequence (e.g., a fragment of the amino acid sequence) shown in FIG. 56 (SEQ ID NO:56) and the amino acid sequence (e.g., a fragment of the amino acid sequence) shown in FIG. 58 (SEQ ID NO:58), or a fragment thereof. In one embodiment, the TMPRSS2-MX1 fusion comprises an amino acid sequence at least 70%, at least 75%, at least 80%, at least 85%, at least 90%, at least 95%, at least 99%, at least 99.5 or greater, identical to the amino acid sequence (e.g., a fragment of the amino acid sequence) shown in FIG. 56 (SEQ ID NO:56) and the amino acid sequence (e.g., a fragment of the amino acid sequence) shown in FIG. 58 (SEQ ID NO:58). In one embodiment, the TMPRSS2-MX1 fusion comprises a sequence containing at least 10, 20, 50, 100, 500, 600, 700, 800, 900, 1000, or more amino acids of the amino acid sequence shown in FIG. 56 (SEQ ID NO:56) and FIG. 58 (SEQ ID NO:58). In one embodiment, the TMPRSS2-MX1 fusion comprises an amino acid sequence containing at least 5, 10, 20, 50, 100, 500, 600, 700, 800, 900, 1000, or more contiguous amino acids of the amino acid sequence shown in FIG. 56 (SEQ ID NO:56) and at least 5, 10, 20, 50, 100, 500, 600, 700, 800, 900, 1000, or more contiguous amino acids of the amino acid sequence shown in FIG. 58 (SEQ ID NO:58). In one embodiment, the 5' TMPRSS2-3' MX1 fusion polypeptide includes a receptor tyrosine kinase domain or a functional fragment thereof. In an embodiment, the 5'TMPRSS2-3'MX1 fusion polypeptide comprises sufficient MX1 and sufficient TMPRSS2 sequence such that it has kinase activity, e.g., has elevated activity, e.g., kinase activity, as compared with wild type, e.g., in a cell of a cancer referred to herein.

In another aspect, the invention features a TMPRSS2-MX1 fusion polypeptide (e.g., a purified TMPRSS2-MX1 fusion polypeptide), a biologically active or antigenic fragment thereof, as well as reagents (e.g., antibody molecules that bind to a TMPRSS2-MX1 fusion polypeptide), methods for modulating a TMPRSS2-MX1 polypeptide activity and detection of a TMPRSS2-MX1 polypeptide.

In one embodiment, the TMPRSS2-MX1 fusion polypeptide has at least one biological activity. In one embodiment, at least one biological activity of the TMPRSS2-MX1 fusion polypeptide is reduced or inhibited by an anti-cancer drug, e.g., a TMPRSS2 inhibitor, an MX1 inhibitor. In one embodiment, at least one biological activity of the TMPRSS2-MX1 fusion polypeptide is reduced or inhibited by a MX1 inhibitor. In one embodiment, at least one biological activity of the TMPRSS2-MX1 fusion polypeptide is reduced or inhibited by an TMPRSS2 inhibitor.

In yet other embodiments, the TMPRSS2-MX1 fusion polypeptide is encoded by a nucleic acid molecule described herein. In one embodiment, the TMPRSS2-MX1 fusion polypeptide is encoded by an in-frame fusion of intron 1 of TMPRSS2 with intron 1 of MX1 (e.g., a sequence on chromosome 21 and a sequence on chromosome 21). In another embodiment, the TMPRSS2-MX1 fusion polypeptide includes an amino acid sequence encoded by a nucleotide sequence comprising a fusion junction between the TMPRSS2 transcript and the MX1 transcript.

In certain embodiments, the TMPRSS2-MX1 fusion polypeptide comprises one or more of encoded exon 1 from TMPRSS2 and one or more of encoded exons 16-19 of MX1. In certain embodiments, the TMPRSS2-MX1 fusion polypeptide comprises at least 1, 2, 3, 4 or more encoded exons from TMPRSS2 and at least 1, 2, 3, 4 or more, encoded exons from MX1. In certain embodiments, the TMPRSS2-MX1 fusion polypeptide comprises a fusion of encoded exon 1 from TMPRSS2 and encoded exon 16 from MX1 (or a fragment thereof). In other embodiments, the fusion comprises least 1, 2, 3, 4 encoded exons from TMPRSS2; and at least 1, 2, 3, 4 encoded exons from MX1. In certain embodiments, the TMPRSS2-MX1 fusion polypeptide comprises encoded exon 1 from TMPRSS2 and exons 16-19 of MX1. In certain embodiments, the 5' TMPRSS2-3' MX1 fusion polypeptide comprises a fusion junction of the sequence of exon 6 from TMPRSS2 and the sequence of exons 16-19 from MX1.

In certain embodiments, the TMPRSS2-MX1 fusion comprises the amino acid sequence corresponding to exon 16 or a fragment thereof from TMPRSS2, and the amino acid sequence corresponding to exons 16-19 or a fragment thereof from MX1 (e.g., as shown in FIG. 56 (SEQ ID NO:56) and FIG. 58 (SEQ ID NO:58)). In one embodiment, the TMPRSS2-MX1 fusion comprises at least 5, 10, 15, 20 or more amino acids from exon 6 of TMPRSS2 (e.g., from the amino acid sequence of TMPRSS2 preceding the fusion junction with MX1, e.g., of the TMPRSS2 sequence shown in FIG. 56 (SEQ ID NO:56)), and at least 5, 10, 15, 20 or more amino acids from exons 16-19 of MX1 (e.g., from the amino acid sequence of MX1 following the fusion junction with TMPRSS2, e.g., of the MX1 sequence shown in FIG. 58 (SEQ ID NO:58)).

In one embodiment, the TMPRSS2-MX1 fusion polypeptide includes a tyrosine kinase domain or a functional fragment thereof. In a related aspect, the invention features TMPRSS2-MX1 fusion polypeptide or fragments operatively linked to heterologous polypeptides to form fusion proteins.

In another embodiment, the TMPRSS2-MX1 fusion polypeptide or fragment is a peptide, e.g., an immunogenic peptide or protein, that contains a fusion junction described herein. Such immunogenic peptides or proteins can be used to raise antibodies specific to the fusion protein. In other embodiments, such immunogenic peptides or proteins can be used for vaccine preparation. The vaccine preparation can include other components, e.g., an adjuvant.

In another aspect, the invention features antibody molecules that bind to a TMPRSS2-MX1 fusion polypeptide or fragment described herein. In embodiments, the antibody can distinguish wild type MX1 (or TMPRSS2) from TMPRSS2-MX1.

Detection Reagents and Detection of Mutations

In another aspect, the invention features a detection reagent, e.g., a purified or an isolated preparation thereof.

Detection reagents can distinguish a nucleic acid, or protein sequence, having a breakpoint, e.g., a TMPRSS2-MX1 breakpoint; from a reference sequence. In one embodiment, the detection reagent detects (e.g., specifically detects) a TMPRSS2-MX1 fusion nucleic acid or a polypeptide (e.g., distinguishes a wild type MX1 or another MX1 fusion (or TMPRSS2) from a TMPRSS2-MX1 nucleic acid (e.g., as described herein in FIGS. 55A-55B (SEQ ID NO:55) and FIGS. 57A-57B (SEQ ID NO:57); or a TMPRSS2-MX1 polypeptide (e.g., as described herein in FIG. 56 (SEQ ID NO:56) and FIG. 58 (SEQ ID NO:58).

Detection reagents, e.g., nucleic acid-based detection reagents, can be used to identify mutations in a target nucleic acid, e.g., DNA, e.g., genomic DNA or cDNA, or RNA, e.g., in a sample, e.g., a sample of nucleic acid derived from a neoplastic or tumor cell, e.g., a melanocytic neoplasm, melanoma or metastatic cell. Detection reagents, e.g., antibody-based detection reagents, can be used to identify mutations in a target protein, e.g., in a sample, e.g., a sample of protein derived from, or produced by, a neoplastic or tumor cell, e.g., a melanocytic neoplasm, melanoma or metastatic cell.

Method of Treatment

The TMPRSS2-MX1 fusion described herein in prostate carcinoma has not been previously described. However, it is possible that this complex TMPRSS2-MX1 fusion may involve ERG as well, resulting in a TMPRSS2-MX1-ERG fusion gene. The TMPRSS2-ERG fusion is a frequent genomic abnormalities in prostate cancer. Fusions of ERG and other transcription factors in the ETS family are seen in approximately 50% of patients (Scheble V J, Braun M, Beroukhim R, et al. (2010) ERG rearrangement is specific to prostate cancer and does not occur in any other common tumor. Mod Pathol 23(8):1061-7). A definitive relationship between TMPRSS2-ERG fusions and prognosis has been difficult to establish and is an area of ongoing study (reviewed in Clark J P, Cooper C S (2009) ETS gene fusions in prostate cancer. Nat Rev Urol 6(8):429-39), possibly due to the heterogeneity of the genetic fusions (Clark J, Merson S, Jhavar S, et al. (2007) Diversity of TMPRSS2-ERG fusion transcripts in the human prostate. Oncogene 26(18): 2667-73). Studies have suggested sensitivity to agents targeting HDACs (Bjorkman M, Iljin K, Halonen P, et al. (2008) Defining the molecular action of HDAC inhibitors and synergism with androgen deprivation in ERG-positive prostate cancer. Int J Cancer 123(12):2774-81), the PTEN pathway (Carver B S, Tran J, Gopalan A, et al. (2009) Aberrant ERG expression cooperates with loss of PTEN to promote cancer progression in the prostate. Nat Genet 41(5):619-24, King J C, Xu J, Wongvipat J, et al. (2009) Cooperativity of TMPRSS2-ERG with PI3-kinase pathway activation in prostate oncogenesis. Nat Genet 41(5):524-6), and PARP (Brenner J C, Ateeq B, Li Y, et al. (2011) Mechanistic rationale for inhibition of poly(ADP-ribose) polymerase in ETS gene fusion-positive prostate cancer. Cancer Cell 19(5):664-78).

The TMPRSS2-ERG fusion is a chimeric gene, in which the promoter of the TMPRSS2 gene drives high level, aberrant expression of the ERG gene. TMPRSS2 is expressed in many tissues but most significantly in prostate (Lucas J M, True L, Hawley S, et al. (2008) The androgen-regulated type II serine protease TMPRSS2 is differentially expressed and mislocalized in prostate adenocarcinoma. J Pathol 215(2):118-25). The ERG gene belongs to the ETS family of transcription factors, which includes 29 family members. ERG is thought to play a role in self-renewal and proliferation (Loughran S J, Kruse E A, Hacking D F, et al.

(2008) The transcription factor Erg is essential for definitive hematopoiesis and the function of adult hematopoietic stem cells. Nat Immunol 9(7):810-9), which likely play a role in early prostate cancer pathogenesis.

The TMPRSS2-MX1 fusion described in this tumor has not been previously reported. MX1 encodes a cytoplasmic protein that is a member of the dynamin family and large GTPase family. In mouse, this protein is inducible by interferon and may play a role against influenza virus infection. It is possible that the fusion reported here is part of a complex rearrangement which also contains ERG.

The TMPRSS2-ERG fusion is one of several different types of fusions that occur with ETS-family members such as ERG. To date, the TMPRSS2-ERG fusion itself, which is found in 50% of prostate cancers, has not been identified in any other tumor type (Scheble V J, Braun M, Beroukhim R, et al. (2010) ERG rearrangement is specific to prostate cancer and does not occur in any other common tumor. Mod Pathol 23(8):1061-7). The precise type of fusion can involve multiple different ETS family members including ERG but also ETV1, ETV4 and ETV6. Almost all of these fusions are partnered with the 5' sequence of the androgen-responsive gene TMPRSS2, which likely accounts for the high level of the ETS-family members in prostate cancer. The most common genomic abnormality is a deletion of sequence between the TMPRSS2 and ERG genes with heterogeneity at both end points (Tomlins S A, Rhodes D R, Perner S, et al. (2005) Recurrent fusion of TMPRSS2 and ETS transcription factor genes in prostate cancer. Science 310(5748):644-8, Perner S, Demichelis F, Beroukhim R, et al. (2006) TMPRSS2:ERG fusion-associated deletions provide insight into the heterogeneity of prostate cancer. Cancer Res 66(17): 8337-41, Lapointe J, Kim Y H, Miller M A, et al. (2007) A variant TMPRSS2 isoform and ERG fusion product in prostate cancer with implications for molecular diagnosis. Mod Pathol 20(4):467-73, Hermans K G, Boormans J L, Gasi D, et al. (2009) Overexpression of prostate-specific TMPRSS2 (exon 0)-ERG fusion transcripts corresponds with favorable prognosis of prostate cancer. Clin Cancer Res 15(20):6398-403). However, other more complex re-arrangements have been noted, including insertions (Scheble V J, Braun M, Beroukhim R, et al. (2010) ERG rearrangement is specific to prostate cancer and does not occur in any other common tumor. Mod Pathol 23(8):1061-7). Although most published studies only describe DNA or RNA detection of the fusion gene TMPRSS2-ERG, at least one study with human prostate tumor tissue showed that almost all of the gene re-arrangements resulted in the overexpression of the expected truncated Erg protein in the nucleus (Tomlins S A, Rhodes D R, Perner S, et al. (2005) Recurrent fusion of TMPRSS2 and ETS transcription factor genes in prostate cancer. Science 310(5748):644-8). Some authors have suggested that oncogenesis ascribed to the TMPRSS2-ERG rearrangements within chromosome region 21q22.2-3 might be due, in part, to deletion of other genes with putative roles in cancer, such as HMGN1 and/or ETS-2 (Perner S, Demichelis F, Beroukhim R, et al. (2006) TMPRSS2:ERG fusion-associated deletions provide insight into the heterogeneity of prostate cancer. Cancer Res 66(17):8337-41, Scheble V J, Braun M, Beroukhim R, et al. (2010) ERG rearrangement is specific to prostate cancer and does not occur in any other common tumor. Mod Pathol 23(8):1061-7).

The rearrangement observed in this tumor is described as a TMPRSS2-MX1 fusion. However, this complex fusion may also include ERG. Complex rearrangements have been reported for TMPRSS2 in prostate cancers (Tomlins S A, Rhodes D R, Perner S, et al. (2005) Recurrent fusion of TMPRSS2 and ETS transcription factor genes in prostate cancer. Science 310(5748):644-8, Perner S, Demichelis F, Beroukhim R, et al. (2006) TMPRSS2:ERG fusion-associated deletions provide insight into the heterogeneity of prostate cancer. Cancer Res 66(17):8337-41, Lapointe J, Kim Y H, Miller M A, et al. (2007) A variant TMPRSS2 isoform and ERG fusion product in prostate cancer with implications for molecular diagnosis. Mod Pathol 20(4): 467-73, Clark J, Merson S, Jhavar S, et al. (2007) Diversity of TMPRSS2-ERG fusion transcripts in the human prostate. Oncogene 26(18):2667-73, Hermans K G, Boormans J L, Gasi D, et al. (2009) Overexpression of prostate-specific TMPRSS2 (exon 0)-ERG fusion transcripts corresponds with favorable prognosis of prostate cancer. Clin Cancer Res 15(20):6398-403, Scheble V J, Braun M, Beroukhim R, et al. (2010) ERG rearrangement is specific to prostate cancer and does not occur in any of her common tumor. Mod Pathol 23(8):1061-7, Nacu S, Yuan W, Kan Z, et al. (2011) Deep RNA sequencing analysis of readthrough gene fusions in human prostate adenocarcinoma and reference samples. BMC Med Genomics 4:11). Assessment of RNA or protein expression would be required to determine the presence of Erg protein in this case.

Transgenic mouse studies of the fusion genes suggests that TMPRSS2-ERG is an early event in prostate cancer pathogenesis (Klezovitch O, Risk M, Coleman I, et al. (2008) A causal role for ERG in neoplastic transformation of prostate epithelium. Proc Natl Acad Sci USA 105(6):2105-10) but likely requires additional genomic alterations (Tomlins S A, Laxman B, Varambally S, et al. (2008) Role of the TMPRSS2-ERG gene fusion in prostate cancer. Neoplasia 10(2):177-88) such as PTEN inactivation (Carver B S, Tran J, Gopalan A, et al. (2009) Aberrant ERG expression cooperates with loss of PTEN to promote cancer progressio n in the prostate. Nat Genet 41(5):619-24, King J C, Xu J, Wongvipat J, et al. (2009) Cooperativity of TMPRSS2-ERG with PI3-kinase pathway activation in prostate oncogenesis. Nat Genet 41(5):524-6).

The TMPRSS2-MX1 fusion described in this tumor has not been previously described. The TMPRSS2-MX1 fusion may result in a TMPRSS2-MX1-ERG fusion gene. Because the TMPRSS2-ERG fusion, or related ETS-family fusions, are common in prostate cancer, targeting of ERG-dependent prostate cancer growth is an area of intense study.

Prostate cancers with the TMPRSS2-ERG fusion have been shown to upregulate expression of HDAC1 (histone deacetylase 1), a gene required for epigenetic marking of certain genes. Epigenetic "marks" mediate changes in gene expression via acetylation (amongst other modifications) of histone proteins. Because of this, the utility of HDAC inhibitors in ERG-positive prostate cancer has been investigated preclinically, and showed significant synergy with androgen deprivation therapies (Bjorkman M, Iljin K, Halonen P, et al. (2008) Defining the molecular action of HDAC inhibitors and synergism with androgen deprivation in ERG-positive prostate cancer. Int J Cancer 123(12):2774-81). The HDAC inhibitor SB939 (aka Pracinostat) was studied in a Phase 2 trial in recurrent or metastatic prostate cancer, and reported a tolerable toxicity profile although only a 7% response rate (Eigl B J, North S, Murray N, et al. (2011) A phase II study of SB939 in patients with recurrent or metastatic castration resistant prostate cancer (CRPC). Molecular Cancer Therapeutics 10:11 (suppl; abstr A221); AACR #A221).

The TMPRSS2-ERG fusion protein has been shown to interact with the enzyme poly (ADP-ribose) polymerase 1 (PARP1) in cell culture and mouse xenograft studies (Brenner J C, Ateeq B, Li Y, et al. (2011) Mechanistic rationale for inhibition of poly(ADP-ribose) polymerase in ETS gene fusion-positive prostate cancer. Cancer Cell 19(5): 664-78). TMPRSS2-ERG positive prostate cancer cells were found to be much more sensitive to PARP inhibition than negative cells, suggesting a rationale for therapeutic targeting of PARP in prostate cancer. PARP inhibitors are being studied in clinical trials for a variety of tumor types, including prostate cancer.

Accordingly, in another aspect, a method of inhibiting, reducing, or treating a hyperproliferative disorder, e.g., a neoplasm (including benign, pre-malignant or malignant (e.g., a cancer), in a subject is provided. The method includes administering to the subject a preselected therapeutic agent, e.g., an anti-cancer agent (e.g., a kinase inhibitor), as a single agent, or in combination, in an amount sufficient to reduce, inhibit or treat the activity or expression of TMPRSS2-MX1 (e.g., a TMPRSS2-MX1 fusion described herein), thereby inhibiting, reducing, or treating the hyperproliferative disorder in the subject.

In one embodiment, the subject treated has a TMPRSS2-MX1 fusion; e.g., the subject has a tumor or cancer harboring a TMPRSS2-MX1 fusion. In other embodiments, the subject has been previously identified as having a TMPRSS2-MX1 fusion. In yet other embodiments, the subject has been previously identified as being likely or unlikely to respond to treatment with a protein kinase inhibitor, e.g., a subject that has previously participated in a clinical trial. In other embodiments, the subject has been previously identified as being likely or unlikely to respond to treatment with a protein kinase inhibitor, based on the presence of the TMPRSS2-MX1 fusion. In one embodiment, the subject is a mammal, e.g., a human. In one embodiment, the subject has, or at risk of having a cancer at any stage of disease. In other embodiments, the subject is a patient, e.g., a cancer patient.

In certain embodiments, the neoplasm or neoplastic cell is a benign, pre-malignant, malignant (cancer) or metastasis. In certain embodiments, the cancer is a solid tumor, a soft tissue tumor, or a metastatic lesion.

In one embodiment, the neoplasm or neoplastic cell is a benign, pre-malignant, malignant (cancer) or metastasis. In certain embodiments, the cancer is a solid tumor, a soft tissue tumor, or a metastatic lesion. In one embodiment, the cancer is a carcinoma. In one embodiment, the cancer is a prostate carcinoma. In one embodiment, the cancer is chosen from a lung cancer, a pancreatic cancer, melanoma, a colorectal cancer, an esophageal-gastric cancer, a thyroid cancer, or an adenocarcinoma. In one embodiment, the cancer is a lung adenocarcinoma. In other embodiment, the lung cancer is chosen from one or more of the following: non-small cell lung cancer (NSCLC), small cell lung cancer (SCLC), squamous cell carcinoma (SCC), adenocarcinoma of the lung, bronchogenic carcinoma, or a combination thereof. In one embodiment, the lung cancer is NSCLC or SCC.

In one embodiment, the anti-cancer agent is a MX1 inhibitor. In one embodiment, the anti-cancer agent is a TMPRSS2 inhibitor. In one embodiment, the anti-cancer agent is a kinase inhibitor. In some embodiments the MX1 inhibitor is a MX1 inhibitor described herein. In some embodiments the TMPRSS2 inhibitor is a TMPRSS2 inhibitor described herein.

TPM3-NTRK1 Fusions

In one embodiment, a fusion includes an in-frame fusion of an exon of tropomyosin 3 (TPM3), e.g., one more exons of TPM3 (e.g., one or more of exons 1-7 of TPM3) or a fragment thereof, and an exon of neurotrophic tyrosine kinase receptor type 1 (NTRK1), e.g., one or more exons of a NTRK1 (e.g., one or more of exons 9-17 of NTRK1) or a fragment thereof. For example, the TPM3-NTRK1 fusion can include an in-frame fusion within an intron of TPM3 (e.g., intron 7) or a fragment thereof, with an intron of NTRK1 (e.g., intron 8) or a fragment thereof. In one embodiment, the fusion of the TPM3-NTRK1 fusion comprises the nucleotide sequence of: chromosome 1 at nucleotide 154,132,770 (plus or minus 10, 20, 30, 50, 60, 70, 80, 100 or more nucleotides) and chromosome 1 at nucleotide 156,844,170 (plus or minus 10, 20, 30, 50, 60, 70, 80, 100 or more nucleotides). In one embodiment, the TPM3-NTRK1 fusion is an inversion, e.g., an inversion of a portion of chromosome 1.

In certain embodiments, the TPM3-NTRK1 fusion is in a 5'-TPM3 to 3'-NTRK1 configuration (also referred to herein as "5'-TPM3-NTRK1-3')." The term "fusion" or "fusion molecule" can refer to a polypeptide or a nucleic acid fusion, depending on the context. It may include a full-length sequence or a fragment thereof, e.g., a fusion junction (e.g., a fragment including a portion of TPM3 and a portion of NTRK1, e.g., a portion of the TPM3-NTRK1 fusion described herein). In one embodiment, the TPM3-NTRK1 fusion polypeptide includes the amino acid sequence shown in FIGS. 67A-67D (SEQ ID NO:68) or FIGS. 69 and 22 (SEQ ID NOs:70 and 22), or an amino acid sequence substantially identical thereto. In another embodiment, the TPM3-NTRK1 fusion nucleic acid includes the nucleotide sequence shown in FIGS. 67A-67D (SEQ ID NO:67) or FIGS. 68A-68B and 21A-21B (SEQ ID NOs:69 and 21), or a nucleotide sequence substantially identical thereto. In one embodiment, the TPM3-NTRK1 fusion polypeptide comprises sufficient TPM3 and sufficient NTRK1 sequence such that the 5' TPM3-3' NTRK1 fusion has kinase activity, e.g., has elevated activity, e.g., NTRK1 tyrosine kinase activity, as compared with wild type NTRK1, e.g., in a cell of a cancer referred to herein (e.g., colorectal cancer; lung adenocarcinoma, bile duct adenocarcinoma).

In certain embodiments, the TPM3-NTRK1 fusion comprises one or more (or all of) exons 1-7 from TPM3 and one or more (or all of) exons 9-17 from NTRK1 (e.g., one or more of the exons shown in FIGS. 67A-67D or FIGS. 68A-68B and 21A-21B). In another embodiment, the TPM3-NTRK1 fusion comprises one or more (or all of) exons 1-7 of TPM3 and one or more (or all of) exons 9-17 of NTRK1. In certain embodiments, the TFM3-NTRK1 fusion comprises at least 1, 2, 3, 4, 5, 6, 7 or more exons from TPM3 and at least 1, 2, 3, 4, 5, 6, 7, 8, 9 or more exons from NTRK1 (e.g., from the TPM3 and NTRK1 sequences shown in FIGS. 67A-67D (SEQ ID NO:67 and 68) or FIGS. 68A-68B, 69, 21A-21B and 22 (SEQ ID NOs:69, 70, 21, and 22).

In certain embodiments, the TPM3-NTRK1 fusion comprises exon 7 or a fragment thereof from TPM3, and exon 9 or a fragment thereof from NTRK1 (e.g., as shown in FIGS. 67A-67D (SEQ ID NOs:67 and 68)). In one embodiment, the TPM3-NTRK1 fusion comprises at least 5, 10, 15, 20, 30, 40, 50 or more amino acids from exon 7 of TPM3 (e.g., from the amino acid sequence of TPM3 preceding the fusion junction with NTRK1, e.g., the TPM3 sequence shown in FIG. 67A-67D (SEQ ID NO:68) or FIG. 69 (SEQ ID NO:70)), and at least 5, 10, 15, 20, 30, 40, 50 or more amino acids from exon 9 of NTRK1 (e.g., from the amino acid sequence of NTRK1 following the fusion junction with TPM3, e.g., the NTRK1 sequence shown in FIGS. 67A-67D (SEQ ID NO:68) or FIG. 22 (SEQ ID NO:22)). In another embodiment, the TPM3-NTRK1 fusion comprises at least 6, 12, 15, 20, 25, 50, 75, 100 or more nucleotides from exon 7 of TPM3 (e.g., from the nucleotide sequence of TPM3 preceding the fusion junction with NTRK1, e.g., the TPM3 sequence shown in FIGS. 67A-67D (SEQ ID NO:67) or FIGS. 68A-68B (SEQ ID NO:69)), and at least 6, 12, 15, 20, 25, 50, 75, 100 or more nucleotides from exon 9 of NTRK1 (e.g., from the nucleotide sequence of NTRK1 following the fusion junction with TPM3, e.g., the NTRK1 sequence shown in FIGS. 67A-67D (SEQ ID NO:67) or FIGS. 21A-21B (SEQ ID NO:21)).

TPM3-NTRK1 Nucleic Acid Molecules

In one aspect, the invention features a nucleic acid molecule (e.g., an isolated or purified) nucleic acid molecule that includes a fragment of a TPM3 gene and a fragment of a NTRK1 gene. In one embodiment, the nucleotide sequence encodes a TPM3-NTRK1 fusion polypeptide that includes a NTRK1 tyrosine kinase domain or a functional fragment thereof. In another embodiment, the nucleotide sequence encodes a fragment of the TPM3 polypeptide of SEQ ID NO:68 or 70, or a fragment thereof; or a sequence substantially identical thereto. In other embodiments, the nucleic acid molecule includes a fragment of the NTRK1 gene encoding the amino acid sequence of SEQ ID NO:68 or 22, or a fragment thereof; or a sequence substantially identical thereto. In yet other embodiments, the nucleic acid molecule includes a nucleotide sequence encoding the amino acid sequence shown in FIGS. 67A-67D (e.g., SEQ ID NO:68) or a fragment thereof, or a sequence substantially identical thereto.

In one embodiment, the nucleic acid molecule includes a fusion, e.g., an in-frame fusion, between an intron of TPM3 (e.g., intron 7, or a fragment thereof), and an intron of NTRK1 (e.g., intron 8, or a fragment thereof). The TPM3-NTRK1 fusion can comprise a fusion of the nucleotide sequence of: chromosome 1 at nucleotide 154,132,770 (plus or minus 10, 20, 30, 50, 60, 70, 80, 100 nucleotides) and chromosome 1 at nucleotide 156,844,170 (plus or minus 10, 20, 30, 50, 60, 70, 80, 100 nucleotides), or a fragment thereof. In one embodiment, the TPM3-NTRK1 fusion comprises a fusion of the nucleotide sequence of: chromosome 1 at nucleotide 154,132,770 plus or minus 10, 20, 30, 40, 50, 100, 150, 200, 250, 300, 350, 400, 450, 500, 1000, 2000, or 3000 nucleotides and chromosome 1 at nucleotide 156,844,170 plus or minus 10, 20, 30, 40, 50, 100, 150, 200, 250, 300, 350, 400, 450, 500, 1000, 2000, or 3000 nucleotides, or a fragment thereof.

In another embodiment, the TPM3-NTRK1 fusion comprises a nucleotide sequence shown in FIGS. 67A-67D (SEQ ID NO:67) or FIGS. 68A-68B (SEQ ID NO:69) and FIGS. 21A-21B (SEQ ID NO:21), or a fragment thereof. In one embodiment, the TPM3-NTRK1 fusion comprises a nucleotide sequence substantially identical to the nucleotide sequence shown in FIGS. 67A-67D (SEQ ID NO: 67) or FIGS. 68A-68B (SEQ ID NO:69) and FIGS. 21A-21B (SEQ ID NO:21), or a fragment thereof. In one embodiment, the TPM3-NTRK1 fusion comprises a nucleotide sequence at least 70%, at least 75%, at least 80%, at least 85%, at least 90%, at least 95%, at least 99%, at least 99.5 or greater, identical to the nucleotide sequence shown in FIGS. 67A-67D (SEQ ID NO: 67) or FIGS. 68A-68B (SEQ ID NO:69) and FIGS. 21A-21B (SEQ ID NO:21). In one embodiment, the TPM3-NTRK1 fusion comprises a nucleotide sequence containing at least 50, 100, 150, 200, 500, 1000, 1500, 2000, 2500, 3000, or more nucleotides of the nucleotide sequence shown in FIGS. 67A-67D (SEQ ID NO: 67) or FIGS. 68A-68B (SEQ ID NO:69) and FIGS. 21A-21B (SEQ ID NO:21). In one embodiment, the TPM3-NTRK1 fusion comprises a nucleotide sequence containing at least 50, 100, 150, 200, 500, 1000, 1500, 2000, 2500, 3000, or more contiguous nucleotides of the nucleotide sequence shown in FIGS. 67A-67D (SEQ ID NO: 67) or FIGS. 68A-68B (SEQ ID NO:69) and FIGS. 21A-21B (SEQ ID NO:21).

In another embodiment, the nucleic acid molecule includes a fusion, e.g., an in-frame fusion, of at least exon 7 of TPM3 or a fragment thereof (e.g., one or more of exons 1-7 of TPM3 or a fragment thereof), and at least exon 9 or a fragment thereof (e.g., one or more of exons 9-17 of NTRK1 or a fragment thereof). In one embodiment, the nucleic acid molecule includes the nucleotides sequence corresponding to exons 1-7, of a TPM3 gene, (SEQ ID NO:67 or 69) or a fragment thereof, or a sequence substantially identical thereto. In another embodiment, the nucleic acid molecule includes the nucleotide sequence corresponding to exons 9-17, of NTRK1 (SEQ ID NO:67 or 21) or a fragment thereof, or a sequence substantially identical thereto. In yet other embodiments, the nucleic acid molecule includes the nucleotide sequence shown in FIGS. 67A-67D (e.g., SEQ ID NO:67) or FIGS. 68A-68B (e.g., SEQ ID NO:69) and FIGS. 21A-21B (e.g., SEQ ID NO:21), or a fragment thereof, or a sequence substantially identical thereto.

In one embodiment, the nucleic acid molecule is complementary to at least a portion of a nucleotide sequence disclosed herein, e.g., is capable of hybridizing under a stringency condition described herein to SEQ ID NO:67 or SEQ ID NO:69 and/or SEQ ID NO:21, or a fragment thereof. In yet another embodiment, the nucleic acid molecule hybridizes to a nucleotide sequence that is complementary to at least a portion of a nucleotide sequence disclosed herein, e.g., is capable of hybridizing under a stringency condition to a nucleotide sequence complementary to SEQ ID NO:67 or SEQ ID NO:69 and/or SEQ ID NO:21, or a fragment thereof. The nucleotide sequence of a cDNA encoding an exemplary 5' TPM3-3' NTRK1 fusion is shown in SEQ ID NO:67 or a fragment of SEQ ID NO:69 and SEQ ID NO:21, and the predicted amino acid sequence is shown in SEQ ID NO:68 and a fragment of SEQ ID NO:70 and SEQ ID NO:22, respectively.

In an embodiment, the TPM3-NTRK1 nucleic acid molecule comprises sufficient TPM3 and sufficient NTRK1 sequence such that the encoded 5' TPM3-3' NTRK1 fusion has kinase activity, e.g., has elevated activity, e.g., NTRK1 kinase activity, as compared with wild type NTRK1, e.g., in a cell of a cancer referred to herein. In certain embodiments, the 5' TPM3-3' NTRK1 fusion comprises exons 1-7 from TPM3 and exons 9-17 from NTRK1. In certain embodiments, the TPM3-NTRK1 fusion comprises at least 1, 2, 3, 4, 5, 6, 7 or more exons from TPM3 and at least 1, 2, 3, 4, 5, 6, 7, 8, 9 or more exons from NTRK1. In certain embodiments, the TPM3-NTRK1 fusion comprises a fusion of exon 7 from TPM3 and exon 9 from NTRK1. In another embodiment, the TPM3-NTRK1 fusion comprises at least 1, 2, 3, 4, 5, 6, 7 exons from TPM3; and at least 1, 2, 3, 4, 5, 6, 7, 8, 9 exons from NTRK1 (e.g., the corresponding exons from SEQ ID NO:69 and SEQ ID NO:21).

In one embodiment, the nucleic acid molecule includes a nucleotide sequence that has an in-frame fusion of intron 7 of TPM3 (e.g., NM_1536949) with intron 9 of NTRK1 (e.g., NM_002529). In another embodiment, the nucleic acid molecule includes a nucleotide sequence that includes a breakpoint. For example, the nucleic acid molecule includes a nucleotide sequence that includes the fusion junction between the TPM3 gene and the NTRK1 gene, e.g., the breakpoint between intron 7 of TPM3 and intron 8 of NTRK1. In other embodiments, the nucleic acid molecules includes a nucleotide sequence of one or more of nucleotide 154,132,770 of chromosome 1 coupled to (e.g., directly or indirectly juxtaposed to) one or more of nucleotide 156,844, 170 of chromosome 1. In one embodiment, the nucleic acid molecule includes the nucleotide sequence of: chromosome 1 at nucleotide 154,132,770 plus or minus 10, 20, 30, 40 50, 60, 80, 100, 150 nucleotides and chromosome 1 at nucleotide 156,844,170 plus or minus 10, 20, 30, 40 50, 60, 80, 100, 150 nucleotides (corresponding to the breakpoint of a TPM3-NTRK1 fusion), or a fragment thereof, or a sequence substantially identical thereto. In one embodiment, the nucleic acid molecule is complementary to at least a portion of a nucleotide sequence disclosed herein, e.g., is capable of hybridizing under a stringency condition described herein to SEQ ID NO:67 or 69, and 21, or a fragment thereof. In yet other embodiment, the nucleic acid molecule hybridizes to a nucleotide sequence that is complementary to at least a portion of a nucleotide sequence disclosed herein, e.g., is capable of hybridizing under a stringency condition described herein to a nucleotide sequence complementary to SEQ ID NO:67 or 69, and 21, or a fragment thereof.

In another embodiment, the TPM3-NTRK1 fusion nucleic acid comprises at least 6, 12, 15, 20, 25, 50, 75, 100 or more nucleotides from exon 7 of TPM3 (e.g., from the nucleotide sequence of TPM3 preceding the fusion junction with NTRK1, e.g., the TPM3 sequence shown in FIGS. 67A-67D (SEQ ID NO:67) or FIGS. 68A-68B (SEQ ID NO:69)), and at least 6, 12, 15, 20, 25, 50, 75, 100 or more nucleotides from exon 9 of NTRK1 (e.g., from the nucleotide sequence of NTRK1 following the fusion junction with TPM3, e.g., the NTRK1 sequence shown in FIGS. 67A-67D (SEQ ID NO:67) or FIGS. 21A-21B (SEQ ID NO:21)).

In other embodiments, the nucleic acid molecule includes a nucleotide sequence encoding a TPM3-NTRK1 fusion polypeptide that includes a fragment of a TPM3 gene and a fragment of a NTRK1 gene. In one embodiment, the nucleotide sequence encodes a TPM3-NTRK1 fusion polypeptide that includes e.g., a NTRK1 tyrosine kinase domain or a functional fragment thereof. In another embodiment, the nucleotide sequence encodes a fragment of the NTRK1 polypeptide of SEQ ID NO:68 or 22 or a fragment thereof, or a sequence substantially identical thereto. For example, the nucleic acid molecule can include a nucleotide sequence encoding a NTRK1 kinase domain of SEQ ID NO:68 or SEQ ID NO:22 or a fragment thereof. In yet other embodiments, the nucleic acid molecule includes a nucleotide sequence encoding the amino acid sequence shown in FIGS. 67A-67D (e.g., SEQ ID NO:68) or FIGS. 69 and 22 (e.g., SEQ ID NOs:70 and 22), or a fragment thereof, or a sequence substantially identical thereto. In one embodiment, the encoded TPM3-NTRK1 fusion polypeptide includes a NTRK1 tyrosine kinase domain or a functional fragment thereof.

In a related aspect, the invention features nucleic acid constructs that include the TPM3-NTRK1 nucleic acid molecules described herein. In certain embodiments, the nucleic acid molecules are operatively linked to a native or a heterologous regulatory sequence. Also included are vectors and host cells that include the TPM3-NTRK1 nucleic acid molecules described herein, e.g., vectors and host cells suitable for producing the nucleic acid molecules and polypeptides described herein.

In a related aspect, methods of producing the nucleic acid molecules and polypeptides described herein are also described.

In another aspect, the invention features nucleic acid molecules that reduce or inhibit the expression of a nucleic acid molecule that encodes a TPM3-NTRK1 fusion described herein. Examples of such nucleic acid molecules include, for example, antisense molecules, ribozymes, RNAi, triple helix molecules that hybridize to a nucleic acid encoding TPM3-NTRK1, or a transcription regulatory region of TPM3-NTRK1, and blocks or reduces mRNA expression of TPM3-NTRK1.

Nucleic Acid Detection and Capturing Reagents

The invention also features a nucleic acid molecule, e.g., nucleic acid fragment, suitable as probe, primer, bait or library member that includes, flanks, hybridizes to, which are useful for identifying, or are otherwise based on, the TPM3-NTRK1 fusions described herein. In certain embodiments, the probe, primer or bait molecule is an oligonucleotide that allows capture, detection or isolation of a TPM3-NTRK1 fusion nucleic acid molecule described herein. The oligonucleotide can comprise a nucleotide sequence substantially complementary to a fragment of the TPM3-NTRK1 fusion nucleic acid molecules described herein. The sequence identity between the nucleic acid fragment, e.g., the oligonucleotide, and the target TPM3-NTRK1 sequence need not be exact, so long as the sequences are sufficiently complementary to allow the capture, detection or isolation of the target sequence. In one embodiment, the nucleic acid fragment is a probe or primer that includes an oligonucleotide between about 5 and 25, e.g., between 10 and 20, or 10 and 15 nucleotides in length. In other embodiments, the nucleic acid fragment is a bait that includes an oligonucleotide between about 100 to 300 nucleotides, 130 and 230 nucleotides, or 150 and 200 nucleotides, in length.

In one embodiment, the nucleic acid fragment can be used to identify or capture, e.g., by hybridization, a TPM3-NTRK1 fusion. For example, the nucleic acid fragment can be a probe, a primer, or a bait, for use in identifying or capturing, e.g., by hybridization, a TPM3-NTRK1 fusion described herein. In one embodiment, the nucleic acid fragment can be useful for identifying or capturing a TPM3-NTRK1 breakpoint, e.g., the nucleotide sequence of: chromosome 1 at nucleotide 154,132,770 plus or minus 10, 20, 30, 40 50, 60, 80, 100, 150 nucleotides and chromosome 1 at nucleotide 156,844,170 plus or minus 10, 20, 30, 40 50, 60, 80, 100, 150 nucleotides.

In one embodiment, the nucleic acid fragment hybridizes to a nucleotide sequence within a chromosomal rearrangement that creates an in-frame fusion of intron 7 of TPM3 with intron 8 of NTRK1. In one embodiment, the nucleic acid fragment hybridizes to a nucleotide sequence in the region In other embodiments, the nucleic acid molecules includes a nucleotide sequence in the region of nucleotides 154,132,770 of chromosome 1 coupled to (e.g., juxtaposed to) nucleotides in the region of nucleotides 156,844,170 of chromosome 1. In one embodiment, the nucleic acid fragment hybridizes to a nucleotide sequence that includes a breakpoint, e.g., the nucleotide sequence of: chromosome 1 at nucleotide 154,132,770 plus or minus 10, 20, 30, 40 50, 60, 80, 100, 150 or more nucleotides and chromosome 1 at nucleotide 156,844,170 plus or minus 10, 20, 30, 40 50, 60, 80, 100, 150 or more nucleotides. For example, the nucleic acid fragment can hybridize to a nucleotide sequence that includes the fusion junction between the TPM3 gene and the NTRK1 gene, e.g., a nucleotide sequence that includes a portion of a nucleotide sequence within intron 7 of a TPM3 gene and 8 of a NTRK1 gene.

In another embodiment, the nucleic acid fragment hybridizes to a nucleotide sequence that comprises at least 6, 12, 15, 20, 25, 50, 75, 100, 150 or more nucleotides from exon 7 of TPM3 (e.g., from the nucleotide sequence of TPM3 preceding the fusion junction with NTRK1, e.g., the TPM3 sequence shown in FIGS. 67A-67D (SEQ ID NO:67) or FIG. 68 (SEQ ID NO:69), and at least 6, 12, 15, 20, 25, 50, 75, 100, 150 or more nucleotides from exon 9 of NTRK1 (e.g., from the nucleotide sequence of NTRK1 following the fusion junction with TPM3, e.g., the NTRK1 sequence shown in FIGS. 67A-67D (SEQ ID NO:67) or FIGS. 21A-21B (SEQ ID NO:21)).

The probes or primers described herein can be used, for example, for FISH detection or PCR amplification. In one exemplary embodiment where detection is based on PCR, amplification of the TPM3-NTRK1 fusion junction fusion junction can be performed using a primer or a primer pair, e.g., for amplifying a sequence flanking the fusion junctions described herein, e.g., the mutations or the junction of a chromosomal rearrangement described herein, e.g., TPM3-NTRK1.

In one embodiment, a pair of isolated oligonucleotide primers can amplify a region containing or adjacent to a position in the NTRK1-TPM3 fusion. For example, forward primers can be designed to hybridize to a nucleotide sequence within TPM3 genomic or mRNA sequence (e.g., a nucleotide sequence within exon 7 of TPM3 of SEQ ID NO:67 or 69), and the reverse primers can be designed to hybridize to a nucleotide sequence of NTRK1 (e.g., a nucleotide sequence within exon 9 of NTRK1, of SEQ ID NO:67 or 21).

In another embodiment, the nucleic acid fragments can be used to identify, e.g., by hybridization, a TPM3-NTRK1 fusion. In one embodiment, the nucleic acid fragment hybridizes to a nucleotide sequence that includes a fusion junction between the TPM3 transcript and the NTRK1 transcript.

In other embodiments, the nucleic acid fragment includes a bait that comprises a nucleotide sequence that hybridizes to a TPM3-NTRK1 fusion nucleic acid molecule described herein, and thereby allows the capture or isolation said nucleic acid molecule. In one embodiment, a bait is suitable for solution phase hybridization. In other embodiments, a bait includes a binding entity, e.g., an affinity tag, that allows capture and separation, e.g., by binding to a binding entity, of a hybrid formed by a bait and a nucleic acid hybridized to the bait.

In other embodiments, the nucleic acid fragment includes a library member comprising a TPM3-NTRK1 nucleic acid molecule described herein. In one embodiment, the library member includes a rearrangement that results in a TPM3-NTRK1 fusion described herein.

The nucleic acid fragment can be detectably labeled with, e.g., a radiolabel, a fluorescent label, a bioluminescent label, a chemiluminescent label, an enzyme label, a binding pair label, or can include an affinity tag; a tag, or identifier (e.g., an adaptor, barcode or other sequence identifier).

TPM3-NTRK1 Fusion Polypeptides

In another embodiment, the TPM3-NTRK1 fusion comprises an amino acid sequence shown in FIGS. 67A-67D (SEQ ID NO:68) or FIG. 69 (SEQ ID NO:70) and FIG. 22 (SEQ ID NO:22), or a fragment thereof. In one embodiment, the TPM3-NTRK1 fusion comprises an amino acid sequence substantially identical to the amino acid sequence shown in FIGS. 67A-67D (SEQ ID NO:68) or FIG. 69 (SEQ ID NO:70) and FIG. 22 (SEQ ID NO:22), or a fragment thereof. In one embodiment, the TPM3-NTRK1 fusion comprises an amino acid sequence at least 70%, at least 75%, at least 80%, at least 85%, at least 90%, at least 95%, at least 99%, at least 99.5 or greater, identical to the amino acid sequence shown in FIGS. 67A-67D (SEQ ID NO:68) or FIG. 69 (SEQ ID NO:70) and FIG. 22 (SEQ ID NO:22)). In one embodiment, the TPM3-NTRK1 fusion comprises a sequence containing at least 10, 20, 50, 100, 500, 600, 700, 800, 900, 1000, or more amino acids of the amino acid sequence shown in FIGS. 67A-67D (SEQ ID NO:68); or at least 5, 10, 20, 50, 100, 500, 600, 700, 800, 900, 1000, or more amino acids of the amino acid sequence shown in FIG. 69 (SEQ ID NO:70) and at least 5, 10, 20, 50, 100, 500, 600, 700, 800, 900, 1000, or more amino acids of the amino acid sequence shown in FIG. 22 (SEQ ID NO:22). In one embodiment, the TPM3-NTRK1 fusion comprises an amino acid sequence containing at least 10, 20, 50, 100, 500, 600, 700, 800, 900, 1000, or more contiguous amino acids of the amino acid sequence shown in FIGS. 67A-67D (SEQ ID NO:68); or at least 5, 10, 20, 50, 100, 500, 600, 700, 800, 900, 1000, or more contiguous amino acids of the amino acid sequence shown in FIG. 69 (SEQ ID NO:70) and at least 5, 10, 20, 50, 100, 500, 600, 700, 800, 900, 1000, or more contiguous amino acids of the amino acid sequence shown in FIG. 22 (SEQ ID NO:22). In one embodiment, the 5' TPM3-3' NTRK1 fusion polypeptide includes a TPM3 receptor tyrosine kinase domain or a functional fragment thereof. In an embodiment, the 5'TPM3-3'NTRK1 fusion polypeptide comprises sufficient NTRK1 and sufficient TPM3 sequence such that it has kinase activity, e.g., has elevated activity, e.g., NTRK1 kinase activity, as compared with wild type NTRK1, e.g., in a cell of a cancer referred to herein.

In another aspect, the invention features a TPM3-NTRK1 fusion polypeptide (e.g., a purified TPM3-NTRK1 fusion polypeptide), a biologically active or antigenic fragment thereof, as well as reagents (e.g., antibody molecules that bind to a TPM3-NTRK1 fusion polypeptide), methods for modulating a TPM3-NTRK1 polypeptide activity and detection of a TPM3-NTRK1 polypeptide.

In one embodiment, the TPM3-NTRK1 fusion polypeptide has at least one biological activity, e.g., a NTRK1 kinase activity. In one embodiment, at least one biological activity of the TPM3-NTRK1 fusion polypeptide is reduced or inhibited by an anti-cancer drug, e.g., a kinase inhibitor (e.g., a multikinase inhibitor or a NTRK1-specific inhibitor). In one embodiment, at least one biological activity of the TPM3-NTRK1 fusion polypeptide is reduced or inhibited by a NTRK1 kinase inhibitor chosen from e.g., lestaurtinib (CEP-701); AZ-23; indenopyrrolocarboazole 12a; oxindole 3; isothiazole 5n; thiazole 20 h.

In yet other embodiments, the TPM3-NTRK1 fusion polypeptide is encoded by a nucleic acid molecule described herein. In one embodiment, the TPM3-NTRK1 fusion polypeptide is encoded by an in-frame fusion of intron 7 of TPM3 with intron 8 of NTRK1 (e.g., a sequence on chromosome 1). In another embodiment, the TPM3-NTRK1 fusion polypeptide includes an amino acid sequence encoded by a nucleotide sequence comprising a fusion junction between the TPM3 transcript and the NTRK1 transcript.

In certain embodiments, the TPM3-NTRK1 fusion polypeptide comprises one or more of encoded exons 1-7 from TPM3 and one or more of encoded exons 9-17 from NTRK1. In certain embodiments, the TPM3-NTRK1 fusion polypeptide comprises at least 1, 2, 3, 4, 5, 6, 7 or more encoded exons from TPM3 and at least 1, 2, 3, 4, 5, 6, 7, 8, 9 or more, encoded exons from NTRK1. In certain embodiments, the TPM3-NTRK1 fusion polypeptide comprises a fusion of encoded exon 7 from TPM3 and encoded exon 9 from NTRK1 (or a fragment thereof). In certain embodiments, the 5' TPM3-3' NTRK1 fusion polypeptide comprises a fusion junction of the sequence of exon 7 from TPM3 and the sequence of exon 9 from NTRK1 (e.g., as shown in SEQ ID NOs:68, 70 and 22).

In certain embodiments, the TPM3-NTRK1 fusion comprises the amino acid sequence corresponding to exon 7 or a fragment thereof from TPM3, and the amino acid sequence corresponding to exon 9 or a fragment thereof from NTRK1 (e.g., as shown in FIGS. 67A-67D (SEQ ID NO:68) or FIGS. 69 and 22 (SEQ ID NO:70 and 22, respectively)). In one embodiment, the TPM3-NTRK1 fusion comprises at least 5, 10, 15, 20 or more amino acids from exon 7 of TPM3 (e.g., from the amino acid sequence of TPM3 preceding the fusion junction with NTRK1, e.g., the TPM3 sequence shown in FIGS. 67A-67D (SEQ ID NO:68) or FIG. 69 (SEQ ID NO:70), and at least 5, 10, 15, 20 or more amino acids from exon 9 of NTRK1 (e.g., from the amino acid sequence of NTRK1 following the fusion junction with TPM3, e.g., the NTRK1 sequence shown in FIGS. 67A-67D (SEQ ID NO:68) or FIG. 22 (SEQ ID NO:22)).

In one embodiment, the TPM3-NTRK1 fusion polypeptide includes a NTRK1 tyrosine kinase domain or a functional fragment thereof. In a related aspect, the invention features TPM3-NTRK1 fusion polypeptide or fragments operatively linked to heterologous polypeptides to form fusion proteins.

In another embodiment, the TPM3-NTRK1 fusion polypeptide or fragment is a peptide, e.g., an immunogenic peptide or protein, that contains a fusion junction described herein. Such immunogenic peptides or proteins can be used to raise antibodies specific to the fusion protein. In other embodiments, such immunogenic peptides or proteins can be used for vaccine preparation. The vaccine preparation can include other components, e.g., an adjuvant.

In another aspect, the invention features antibody molecules that bind to a TPM3-NTRK1 fusion polypeptide or fragment described herein. In embodiments the antibody can distinguish wild type NTRK1 (or TPM3) from TPM3-NTRK1.

Detection Reagents and Detection of Mutations

In another aspect, the invention features a detection reagent, e.g., a purified or an isolated preparation thereof. Detection reagents can distinguish a nucleic acid, or protein sequence, having a breakpoint, e.g., a TPM3-NTRK1 breakpoint; from a reference sequence. In one embodiment, the detection reagent detects (e.g., specifically detects) a TPM3-NTRK1 fusion nucleic acid or a polypeptide (e.g., distinguishes a wild type NTRK1 or another NTRK1 fusion (or TPM3) from a TPM3-NTRK1 nucleic acid (e.g., as described herein in FIGS. 67A-67D (SEQ ID NO:67) or FIGS. 68A-68B (SEQ ID NO:69) and FIGS. 21A-21B (SEQ ID NO:21); or a TPM3-NTRK1 polypeptide (e.g., as described herein in FIGS. 67A-67D (SEQ ID NO:68) or FIGS. 69 and 22 (SEQ ID NO:70 and 22, respectively).

Detection reagents, e.g., nucleic acid-based detection reagents, can be used to identify mutations in a target nucleic acid, e.g., DNA, e.g., genomic DNA or cDNA, or RNA, e.g., in a sample, e.g., a sample of nucleic acid derived from a neoplastic or tumor cell, e.g., a melanocytic neoplasm, melanoma or metastatic cell. Detection reagents, e.g., antibody-based detection reagents, can be used to identify mutations in a target protein, e.g., in a sample, e.g., a sample of protein derived from, or produced by, a neoplastic or tumor cell, e.g., a melanocytic neoplasm, melanoma or metastatic cell.

Method of Treatment

NTRK1 encodes the receptor tyrosine kinase TrkA, which plays a role in the development of the nervous system by regulating cell proliferation, differentiation, and survival of neurons. TrkA is activated upon binding of its ligand NGF to promote several downstream signaling pathways including GRB2-Ras-MAPK, NF-Kappa-B, and Ras-PI3 kinase-AKT1 (Klein R, Jing S Q, Nanduri V, et al. (1991) The trk proto-oncogene encodes a receptor for nerve growth factor. Cell 65(1):189-97, Wooten M W, Seibenhener M L, Mamidipudi V, et al. (2001) The atypical protein kinase C-interacting protein p62 is a scaffold for NF-kappaB activation by nerve growth factor. J Biol Chem 276(11):7709-12, Stephens R M, Loeb D M, Copeland T D, et al. (1994) Trk receptors use redundant signal transduction pathways involving SHC and PLC-gamma 1 to mediate NGF responses. Neuron 12(3):691-705, Tacconelli A, Farina A R, Cappabianca L, et al. (2004) TrkA alternative splicing: a regulated tumor-promoting switch in human neuroblastoma. Cancer Cell 6(4):347-60). The fusion detected in this tumor contains exons 1-7 of TPM3 fused with exons 8-17 of NTRK1 (Mapback, http://cbio.mskcc.org/Mapback/). It has been reported that TPM3-NTRK1 fusions result in oncogenic proteins with constitutive kinase activity and tyrosine phosphorylation (Greco A, Miranda C, Pierotti M A (2010) Rearrangements of NTRK1 gene in papillary thyroid carcinoma. Mol Cell Endocrinol 321(1):44-9, Beimfohr C, Klugbauer S, Demidchik E P, et al. (1999) NTRK1 rearrangement in papillary thyroid carcinomas of children after the Chernobyl reactor accident. Int J Cancer 80(6):842-7, Butti M G, Bongarzone I, Ferraresi G, et al. (1995) A sequence analysis of the genomic regions involved in the rearrangements between TPM3 and NTRK1 genes producing TRK oncogenes in papillary thyroid carcinomas. Genomics 28(1):15-24). NTRK1 mutations in biliary tract cancers have not been reported in COSMIC (COSMIC, April 2013). NTRK1 has not been analyzed or studied in cholangiocarcinoma. (PubMed, April 2013) (Mayr D, Hirschmann A, Lars U, et al. (2006) KRAS and BRAF mutations in ovarian tumors: a comprehensive study of invasive carcinomas, borderline tumors and extraovarian implants. Gynecol Oncol 103(3):883-7, Mayer A, Takimoto M, Fritz E, et al. (1993) The prognostic significance of proliferating cell nuclear antigen, epidermal growth factor receptor, and mdr gene expression in colorectal cancer. Cancer 71(8):2454-60). However, oncogenic fusion genes resulting from rearrangement involving NTRK1 have been reported in other carcinomas (Martin-Zanca D, Hughes S H, Barbacid M A human oncogene formed by the fusion of truncated tropomyosin and protein tyrosine kinase sequences. Nature 319(6056):743-8, Nakagawara A (2001) Trk receptor tyrosine kinases: a bridge between cancer and neural development. Cancer Lett 169(2):107-14, Greco A, Miranda C, Pierotti M A (2010) Rearrangements of NTRK1 gene in papillary thyroid carcinoma. Mol Cell Endocrinol 321(1):44-9). Both oncogenic and tumor suppressor roles for Ntrk1 have been suggested in thyroid carcinoma and neuroblastoma respectively (Greco A, Miranda C, Pierotti M A (2010) Rearrangements of NTRK1 gene in papillary thyroid carcinoma. Mol Cell Endocrinol 321(1):44-9, Brodeur G M, Minturn J E, Ho R, et al. (2009) Trk receptor expression and inhibition in neuroblastomas. Clin Cancer Res 15(10):3244-50). Pan-Trk inhibitors, including lestaurtinib (CEP-701) and AZD7451, have been evaluated in clinical trials in several tumor types, and additional studies are in progress in certain cancers (Minturn J E, Evans A E, Villablanca J G, et al. (2011) Phase I trial of lestaurtinib for children with refractory neuroblastoma: a new approaches to neuroblastoma therapy consortium study. Cancer Chemother Pharmacol 68(4):1057-65, Chan E, Mulkerin D, Rothenberg M, et al. (2008) A phase I trial of CEP-701+ gemcitabine in patients with advanced adenocarcinoma of the pancreas. Invest New Drugs 26(3):241-7, Marshall J L, Kindler H, Deeken J, et al. (2005) Phase I trial of orally administered CEP-701, a novel neurotrophin receptor-linked tyrosine kinase inhibitor. Invest New Drugs 23(1):31-7).

Accordingly, in another aspect, a method of inhibiting, reducing, or treating a hyperproliferative disorder, e.g., a neoplasm (including benign, pre-malignant or malignant (e.g., a cancer), in a subject is provided. The method includes administering to the subject a preselected therapeutic agent, e.g., an anti-cancer agent (e.g., a kinase inhibitor), as a single agent, or in combination, in an amount sufficient to reduce, inhibit or treat the activity or expression of TPM3-NTRK1 (e.g., a TPM3-NTRK1 fusion described herein), thereby inhibiting, reducing, or treating the hyperproliferative disorder in the subject.

In one embodiment, the subject treated has a TPM3-NTRK1 fusion; e.g., the subject has a tumor or cancer harboring a TPM3-NTRK1 fusion. In other embodiments, the subject has been previously identified as having a TPM3-NTRK1 fusion. In yet other embodiments, the subject has been previously identified as being likely or unlikely to respond to treatment with a protein kinase inhibitor, e.g., a subject that has previously participated in a clinical trial. In other embodiments, the subject has been previously identified as being likely or unlikely to respond to treatment with a protein kinase inhibitor, based on the presence of the TPM3-NTRK1 fusion. In one embodiment, the subject is a mammal, e.g., a human. In one embodiment, the subject has, or at risk of having a cancer at any stage of disease. In other embodiments, the subject is a patient, e.g., a cancer patient.

In certain embodiments, the neoplasm or neoplastic cell is a benign, pre-malignant, malignant (cancer) or metastasis. In certain embodiments, the cancer is a solid tumor, a soft tissue tumor, or a metastatic lesion. In one embodiment, the cancer is colorectal cancer. In one embodiment, the cancer is a bile duct adenocarcinoma. In one embodiment, the cancer is a lung adenocarcinoma. In one embodiment, the cancer is a cervical adenocarcinoma. In one embodiment, the cancer is a uterus endometrial adenocarcinoma. In other embodiment, the lung cancer is chosen from one or more of the following: non-small cell lung cancer (NSCLC), small cell lung cancer (SCLC), squamous cell carcinoma (SCC), adenocarcinoma of the lung, bronchogenic carcinoma, or a combination thereof. In one embodiment, the lung cancer is NSCLC or SCC. In one embodiment, the cancer is chosen from a lung cancer, a pancreatic cancer, melanoma, a colorectal cancer, an esophageal-gastric cancer, a thyroid cancer, or an adenocarcinoma.

In one embodiment, the anti-cancer agent is a kinase inhibitor. For example, the kinase inhibitor is a multi-kinase inhibitor or a NTRK1-specific inhibitor. In one embodiment, the kinase inhibitor is a NTRK1 inhibitor including, but not limited to, lestaurtinib (CEP-701); AZ-23; indenopyrrolocarboazole 12a; oxindole 3; isothiazole 5n; thiazole 20 h. In some embodiments the NTRK1 inhibitor is a NTRK1 inhibitor described herein.

SNAPC4-NOTCH1 Fusions

In one embodiment, a fusion includes an in-frame fusion of an exon of small nuclear RNA activating complex polypeptide 4 (SNAPC4), e.g., one more exons of SNAPC4 (e.g., exon 1 of SNAPC4) or a fragment thereof, and an exon of notch (drosophila) homolog 1 (translocation-associated) (NOTCH1), e.g., one or more exons of a NOTCH1 (e.g., one or more of exons 28-34 of NOTCH1) or a fragment thereof. For example, the SNAPC4-NOTCH1 fusion can include an in-frame fusion within an intron of SNAPC4 (e.g., intron 1) or a fragment thereof, with an intron of NOTCH1 (e.g., intron 27) or a fragment thereof. In one embodiment, the fusion of the SNAPC4-NOTCH1 fusion comprises the nucleotide sequence of: chromosome 9 at nucleotide 139,292,300 (plus or minus 10, 20, 30, 50, 60, 70, 80, 100 or more nucleotides) and chromosome 9 at nucleotide 139,397,700 (plus or minus 10, 20, 30, 50, 60, 70, 80, 100 or more nucleotides). In one embodiment, the SNAPC4-NOTCH1 fusion is a tandem duplication, e.g., a tandem duplication of a portion of chromosome 9.

In certain embodiments, the SNAPC4-NOTCH1 fusion is in a 5'-SNAPC4 to 3'-NOTCH1 configuration (also referred to herein as "5'-SNAPC4-NOTCH1-3')." The term "fusion" or "fusion molecule" can refer to a polypeptide or a nucleic acid fusion, depending on the context. It may include a full-length sequence or a fragment thereof, e.g., a fusion junction (e.g., a fragment including a portion of SNAPC4 and a portion of NOTCH1, e.g., a portion of the SNAPC4-NOTCH1 fusion described herein). In one embodiment, the SNAPC4-NOTCH1 fusion polypeptide includes the amino acid sequence shown in FIGS. 70A-70D (SEQ ID NO:72) or FIGS. 72 and 74 (SEQ ID NOs:74 and 76), or an amino acid sequence substantially identical thereto. In another embodiment, the SNAPC4-NOTCH1 fusion nucleic acid includes the nucleotide sequence shown in FIGS. 70A-70D (SEQ ID NO:71) or FIGS. 71A-71B and 73A-73B (SEQ ID NOs:73 and 75), or a nucleotide sequence substantially identical thereto.

In certain embodiments, the SNAPC4-NOTCH1 fusion comprises exon 1 from SNAPC4 and one or more (or all of) exons 28-34 from NOTCH1 (e.g., one or more of the exons shown in FIGS. 70A-70D or FIGS. 71A-71B and 73A-73B). In another embodiment, the SNAPC4-NOTCH1 fusion comprises exon 1 of SNAPC4 and one or more (or all of) exons 28-34 of NOTCH1. In certain embodiments, the SNAPC4-NOTCH1 fusion comprises at least 1 or more exons from SNAPC4 and at least 1, 2, 3, 4, 5, 6, 7 or more exons from NOTCH1 (e.g., from the SNAPC4 and NOTCH1 sequences shown in FIGS. 70A-70D (SEQ ID NO:71 and 72) or FIGS. 71A-71B, 72, 73A-73B and 74 (SEQ ID NOs:73, 74, 75, and 76).

In certain embodiments, the SNAPC4-NOTCH1 fusion comprises exon 1 or a fragment thereof from SNAPC4, and exon 28 or a fragment thereof from NOTCH1 (e.g., as shown in FIGS. 70A-70D (SEQ ID NOs:71 and 72)). In one embodiment, the SNAPC4-NOTCH1 fusion comprises at least 5, 10, 15, 20, 30, 40, 50 or more amino acids from exon 1 of SNAPC4 (e.g., from the amino acid sequence of SNAPC4 preceding the fusion junction with NOTCH1, e.g., the SNAPC4 sequence shown in FIGS. 70A-70D (SEQ ID NO:72) or FIG. 72 (SEQ ID NO:74)), and at least 5, 10, 15, 20, 30, 40, 50 or more amino acids from exon 28 of NOTCH1 (e.g., from the amino acid sequence of NOTCH1 following the fusion junction with SNAPC4, e.g., the NOTCH1 sequence shown in FIGS. 70A-70D (SEQ ID NO:72) or FIG. 74 (SEQ ID NO:76)). In another embodiment, the SNAPC4-NOTCH1 fusion comprises at least 6, 12, 15, 20, 25, 50, 75, 100 or more nucleotides from exon 1 of SNAPC4 (e.g., from the nucleotide sequence of SNAPC4 preceding the fusion junction with NOTCH1, e.g., the SNAPC4 sequence shown in FIGS. 70A-70D (SEQ ID NO:71) or FIGS. 71A-71B (SEQ ID NO:73)), and at least 6, 12, 15, 20, 25, 50, 75, 100 or more nucleotides from exon 28 of NOTCH1 (e.g., from the nucleotide sequence of NOTCH1 following the fusion junction with SNAPC4, e.g., the NOTCH1 sequence shown in FIGS. 70A-70D (SEQ ID NO:71) or FIGS. 73A-73B (SEQ ID NO:75)).

SNAPC4-NOTCH1 Nucleic Acid Molecules

In one aspect, the invention features a nucleic acid molecule (e.g., an isolated or purified) nucleic acid molecule that includes a fragment of a SNAPC4 gene and a fragment of a NOTCH1 gene. In another embodiment, the nucleotide sequence encodes a fragment of the SNAPC4 polypeptide of SEQ ID NO:72 or 74, or a fragment thereof; or a sequence substantially identical thereto. In other embodiments, the nucleic acid molecule includes a fragment of the NOTCH1 gene encoding the amino acid sequence of SEQ ID NO:72 or 76, or a fragment thereof; or a sequence substantially identical thereto. In yet other embodiments, the nucleic acid molecule includes a nucleotide sequence encoding the amino acid sequence shown in FIGS. 70A-70D (e.g., SEQ ID NO:72) or a fragment thereof, or a sequence substantially identical thereto.

In one embodiment, the nucleic acid molecule includes a fusion, e.g., an in-frame fusion, between an intron of SNAPC4 (e.g., intron 1, or a fragment thereof), and an intron of NOTCH1 (e.g., intron 1, or a fragment thereof). The SNAPC4-NOTCH1 fusion can comprise a fusion of the nucleotide sequence of: chromosome 9 at nucleotide 139, 292,300 (plus or minus 10, 20, 30, 50, 60, 70, 80, 100 nucleotides) and chromosome 9 at nucleotide 139,397,700 (plus or minus 10, 20, 30, 50, 60, 70, 80, 100 nucleotides), or a fragment thereof. In one embodiment, the SNAPC4-NOTCH1 fusion comprises a fusion of the nucleotide sequence of: chromosome 9 at nucleotide 139,292,300 plus or minus 10, 20, 30, 40, 50, 100, 150, 200, 250, 300, 350, 400, 450, 500, 1000, 2000, or 3000 nucleotides and chromosome 9 at nucleotide 139,397,700 plus or minus 10, 20, 30, 40, 50, 100, 150, 200, 250, 300, 350, 400, 450, 500, 1000, 2000, or 3000 nucleotides, or a fragment thereof.

In another embodiment, the SNAPC4-NOTCH1 fusion comprises a nucleotide sequence shown in FIGS. 70A-70D (SEQ ID NO:71) or FIGS. 71A-71B (SEQ ID NO:73) and FIGS. 73A-73B (SEQ ID NO:75), or a fragment thereof. In one embodiment, the SNAPC4-NOTCH1 fusion comprises a nucleotide sequence substantially identical to the nucleotide sequence shown in FIGS. 70A-70D (SEQ ID NO: 71) or FIGS. 71A-71B (SEQ ID NO:73) and FIGS. 73A-73B (SEQ ID NO:75), or a fragment thereof. In one embodiment, the SNAPC4-NOTCH1 fusion comprises a nucleotide sequence at least 70%, at least 75%, at least 80%, at least 85%, at least 90%, at least 95%, at least 99%, at least 99.5 or greater, identical to the nucleotide sequence shown in FIGS. 70A-70D (SEQ ID NO: 71) or FIGS. 71A-71B (SEQ ID NO:73) and FIGS. 73A-73B (SEQ ID NO:75). In one embodiment, the SNAPC4-NOTCH1 fusion comprises a nucleotide sequence containing at least 50, 100, 150, 200, 500, 1000, 1500, 2000, 2500, 3000, or more nucleotides of the nucleotide sequence shown in FIGS. 70A-70D (SEQ ID NO: 71) or FIGS. 71A-71B (SEQ ID NO:73) and FIGS. 73A-73B (SEQ ID NO:75). In one embodiment, the SNAPC4-NOTCH1 fusion comprises a nucleotide sequence containing at least 50, 100, 150, 200, 500, 1000, 1500, 2000, 2500, 3000, or more contiguous nucleotides of the nucleotide sequence shown in FIGS. 70A-70D (SEQ ID NO: 71) or FIGS. 71A-71B (SEQ ID NO:73) and FIGS. 73A-73B (SEQ ID NO:75).

In another embodiment, the nucleic acid molecule includes a fusion, e.g., an in-frame fusion, of at least exon 1 of SNAPC4 or a fragment thereof (e.g., exon 1 of SNAPC4 or a fragment thereof), and at least exon 28 or a fragment thereof (e.g., one or more of exons 28-34 of NOTCH1 or a fragment thereof). In one embodiment, the nucleic acid molecule includes the nucleotides sequence corresponding to exon 1, of a SNAPC4 gene, (SEQ ID NO:71 or 73) or a fragment thereof, or a sequence substantially identical thereto. In another embodiment, the nucleic acid molecule includes the nucleotide sequence corresponding to exons 28-34, of NOTCH1 (SEQ ID NO:71 or 75) or a fragment thereof, or a sequence substantially identical thereto. In yet other embodiments, the nucleic acid molecule includes the nucleotide sequence shown in FIGS. 70A-70D (e.g., SEQ ID NO:71) or FIGS. 71A-71B (e.g., SEQ ID NO:73) and FIGS. 73A-73B (e.g., SEQ ID NO:75), or a fragment thereof, or a sequence substantially identical thereto.

In one embodiment, the nucleic acid molecule is complementary to at least a portion of a nucleotide sequence disclosed herein, e.g., is capable of hybridizing under a stringency condition described herein to SEQ ID NO:71 or SEQ ID NO:73 and/or SEQ ID NO:75, or a fragment thereof. In yet another embodiment, the nucleic acid molecule hybridizes to a nucleotide sequence that is complementary to at least a portion of a nucleotide sequence disclosed herein, e.g., is capable of hybridizing under a stringency condition to a nucleotide sequence complementary to SEQ ID NO:71 or SEQ ID NO:73 and/or SEQ ID NO:75, or a fragment thereof. The nucleotide sequence of a cDNA encoding an exemplary 5' SNAPC4-3' NOTCH1 fusion is shown in SEQ ID NO:71 or a fragment of SEQ ID NO:73 and SEQ ID NO:75, and the predicted amino acid sequence is shown in SEQ ID NO:72 and a fragment of SEQ ID NO:74 and SEQ ID NO:76, respectively.

In certain embodiments, the 5' SNAPC4-3' NOTCH1 fusion comprises exon 1 from SNAPC4 and exons 28-34 from NOTCH1. In certain embodiments, the SNAPC4-NOTCH1 fusion comprises at least 1 or more exons from SNAPC4 and at least 1, 2, 3, 4, 5, 6, 7 or more exons from NOTCH1. In certain embodiments, the SNAPC4-NOTCH1 fusion comprises a fusion of exon 1 from SNAPC4 and exon 28 from NOTCH I. In another embodiment, the SNAPC4-NOTCH1 fusion comprises at least 1 exons from SNAPC4; and at least 1, 2, 3, 4, 5, 6, 7 exons from NOTCH1 (e.g., the corresponding exons from SEQ ID NO:73 and SEQ ID NO:75).

In one embodiment, the nucleic acid molecule includes a nucleotide sequence that has an in-frame fusion of intron 1 of SNAPC4 (e.g., NM_003086) with intron 27 of NOTCH1 (e.g., NM_017617). In another embodiment, the nucleic acid molecule includes a nucleotide sequence that includes a breakpoint. For example, the nucleic acid molecule includes a nucleotide sequence that includes the fusion junction between the SNAPC4 gene and the NOTCH1 gene, e.g., the breakpoint between intron 1 of SNAPC4 and intron 27 of NOTCH1. In other embodiments, the nucleic acid molecules includes a nucleotide sequence of one or more of nucleotide 139,292,300 of chromosome 9 coupled to (e.g., directly or indirectly juxtaposed to) one or more of nucleotide 139,397, 700 of chromosome 9. In one embodiment, the nucleic acid molecule includes the nucleotide sequence of: chromosome 9 at nucleotide 139,292,300 plus or minus 10, 20, 30, 40 50, 60, 80, 100, 150 nucleotides and chromosome 9 at nucleotide 139,397,700 plus or minus 10, 20, 30, 40 50, 60, 80, 100, 150 nucleotides (corresponding to the breakpoint of a SNAPC4-NOTCH1 fusion), or a fragment thereof, or a sequence substantially identical thereto. In one embodiment, the nucleic acid molecule is complementary to at least a portion of a nucleotide sequence disclosed herein, e.g., is capable of hybridizing under a stringency condition described herein to SEQ ID NO:71 or 73, and 75, or a fragment thereof. In yet other embodiment, the nucleic acid molecule hybridizes to a nucleotide sequence that is complementary to at least a portion of a nucleotide sequence disclosed herein, e.g., is capable of hybridizing under a stringency condition described herein to a nucleotide sequence complementary to SEQ ID NO:71 or 73, and 75, or a fragment thereof.

In another embodiment, the SNAPC4-NOTCH1 fusion nucleic acid comprises at least 6, 12, 15, 20, 25, 50, 75, 100 or more nucleotides from exon 1 of SNAPC4 (e.g., from the nucleotide sequence of SNAPC4 preceding the fusion junction with NOTCH I, e.g., the SNAPC4 sequence shown in FIGS. 70A-70D (SEQ ID NO:71) or FIGS. 71A-71B (SEQ ID NO:73)), and at least 6, 12, 15, 20, 25, 50, 75, 100 or more nucleotides from exon 28 of NOTCH1 (e.g., from the nucleotide sequence of NOTCH1 following the fusion junction with SNAPC4, e.g., the NOTCH1 sequence shown in FIGS. 70A-70D (SEQ ID NO:71) or FIGS. 73A-73B (SEQ ID NO:75)).

In other embodiments, the nucleic acid molecule includes a nucleotide sequence encoding a SNAPC4-NOTCH1 fusion polypeptide that includes a fragment of a SNAPC4 gene and a fragment of a NOTCH1 gene. In one embodiment, the nucleotide sequence encodes a SNAPC4-NOTCH1 fusion polypeptide that includes e.g., a NOTCH1 functional domain or a functional fragment thereof. In another embodiment, the nucleotide sequence encodes a fragment of the NOTCH1 polypeptide of SEQ ID NO:72 or 76 or a fragment thereof, or a sequence substantially identical thereto. For example, the nucleic acid molecule can include a nucleotide sequence encoding a NOTCH1 functional domain of SEQ ID NO:72 or SEQ ID NO:76 or a fragment thereof. In yet other embodiments, the nucleic acid molecule includes a nucleotide sequence encoding the amino acid sequence shown in FIGS. 70A-70D (e.g., SEQ ID NO:72) or FIGS. 72 and 74 (e.g., SEQ ID NOs:74 and 76), or a fragment thereof, or a sequence substantially identical thereto In a related aspect, the invention features nucleic acid constructs that include the SNAPC4-NOTCH1 nucleic acid molecules described herein. In certain embodiments, the nucleic acid molecules are operatively linked to a native or a heterologous regulatory sequence. Also included are vectors and host cells that include the SNAPC4-NOTCH1 nucleic acid molecules described herein, e.g., vectors and host cells suitable for producing the nucleic acid molecules and polypeptides described herein.

In a related aspect, methods of producing the nucleic acid molecules and polypeptides described herein are also described.

In another aspect, the invention features nucleic acid molecules that reduce or inhibit the expression of a nucleic acid molecule that encodes a SNAPC4-NOTCH1 fusion described herein. Examples of such nucleic acid molecules include, for example, antisense molecules, ribozymes, RNAi, triple helix molecules that hybridize to a nucleic acid encoding SNAPC4-NOTCH1, or a transcription regulatory region of SNAPC4-NOTCH1, and blocks or reduces mRNA expression of SNAPC4-NOTCH1.

Nucleic Acid Detection and Capturing Reagents

The invention also features a nucleic acid molecule, e.g., nucleic acid fragment, suitable as probe, primer, bait or library member that includes, flanks, hybridizes to, which are useful for identifying, or are otherwise based on, the SNAPC4-NOTCH1 fusions described herein. In certain embodiments, the probe, primer or bait molecule is an oligonucleotide that allows capture, detection or isolation of a SNAPC4-NOTCH1 fusion nucleic acid molecule described herein. The oligonucleotide can comprise a nucleotide sequence substantially complementary to a fragment of the SNAPC4-NOTCH1 fusion nucleic acid molecules described herein. The sequence identity between the nucleic acid fragment, e.g., the oligonucleotide, and the target SNAPC4-NOTCH1 sequence need not be exact, so long as the sequences are sufficiently complementary to allow the capture, detection or isolation of the target sequence. In one embodiment, the nucleic acid fragment is a probe or primer that includes an oligonucleotide between about 5 and 25, e.g., between 10 and 20, or 10 and 15 nucleotides in length. In other embodiments, the nucleic acid fragment is a bait that includes an oligonucleotide between about 100 to 300 nucleotides, 130 and 230 nucleotides, or 150 and 200 nucleotides, in length.

In one embodiment, the nucleic acid fragment can be used to identify or capture, e.g., by hybridization, a SNAPC4-NOTCH1 fusion. For example, the nucleic acid fragment can be a probe, a primer, or a bait, for use in identifying or capturing, e.g., by hybridization, a SNAPC4-NOTCH1 fusion described herein. In one embodiment, the nucleic acid fragment can be useful for identifying or capturing a SNAPC4-NOTCH1 breakpoint, e.g., the nucleotide sequence of: chromosome 9 at nucleotide 139,292,300 plus or minus 10, 20, 30, 40 50, 60, 80, 100, 150 nucleotides and chromosome 9 at nucleotide 139,397,700 plus or minus 10, 20, 30, 40 50, 60, 80, 100, 150 nucleotides.

In one embodiment, the nucleic acid fragment hybridizes to a nucleotide sequence within a chromosomal rearrangement that creates an in-frame fusion of intron 1 of SNAPC4 with intron 1 of NOTCH1. In one embodiment, the nucleic acid fragment hybridizes to a nucleotide sequence in the region In other embodiments, the nucleic acid molecules includes a nucleotide sequence in the region of nucleotides 139,292,300 of chromosome 9 coupled to (e.g., juxtaposed to) nucleotides in the region of nucleotides 139,397,700 of chromosome 9. In one embodiment, the nucleic acid fragment hybridizes to a nucleotide sequence that includes a breakpoint, e.g., the nucleotide sequence of: chromosome 9 at nucleotide 139,292,300 plus or minus 10, 20, 30, 40 50, 60, 80, 100, 150 or more nucleotides and chromosome 9 at nucleotide 139,397,700 plus or minus 10, 20, 30, 40 50, 60, 80, 100, 150 or more nucleotides. For example, the nucleic acid fragment can hybridize to a nucleotide sequence that includes the fusion junction between the SNAPC4 gene and the NOTCH1 gene, e.g., a nucleotide sequence that includes a portion of a nucleotide sequence within intron 1 of a SNAPC4 gene and 27 of a NOTCH1 gene.

In another embodiment, the nucleic acid fragment hybridizes to a nucleotide sequence that comprises at least 6, 12, 15, 20, 25, 50, 75, 100, 150 or more nucleotides from exon 1 of SNAPC4 (e.g., from the nucleotide sequence of SNAPC4 preceding the fusion junction with NOTCH1, e.g., the SNAPC4 sequence shown in FIGS. 70A-70D (SEQ ID NO:71) or FIG. 71 (SEQ ID NO:73), and at least 6, 12, 15, 20, 25, 50, 75, 100, 150 or more nucleotides from exon 28 of NOTCH1 (e.g., from the nucleotide sequence of NOTCH I following the fusion junction with SNAPC4, e.g., the NOTCH1 sequence shown in FIGS. 70A-70D (SEQ ID NO:71) or FIG. 73 (SEQ ID NO:75)).

The probes or primers described herein can be used, for example, for FISH detection or PCR amplification. In one exemplary embodiment where detection is based on PCR, amplification of the SNAPC4-NOTCH1 fusion junction fusion junction can be performed using a primer or a primer pair, e.g., for amplifying a sequence flanking the fusion junctions described herein, e.g., the mutations or the junction of a chromosomal rearrangement described herein, e.g., SNAPC4-NOTCH1.

In one embodiment, a pair of isolated oligonucleotide primers can amplify a region containing or adjacent to a position in the NOTCH1-SNAPC4 fusion. For example, forward primers can be designed to hybridize to a nucleotide sequence within SNAPC4 genomic or mRNA sequence (e.g., a nucleotide sequence within exon 1 of SNAPC4 of SEQ ID NO:71 or 73), and the reverse primers can be designed to hybridize to a nucleotide sequence of NOTCH1 (e.g., a nucleotide sequence within exon 28 of NOTCH1, of SEQ ID NO:71 or 75).

In another embodiment, the nucleic acid fragments can be used to identify, e.g., by hybridization, a SNAPC4-NOTCH1 fusion. In one embodiment, the nucleic acid fragment hybridizes to a nucleotide sequence that includes a fusion junction between the SNAPC4 transcript and the NOTCH1 transcript.

In other embodiments, the nucleic acid fragment includes a bait that comprises a nucleotide sequence that hybridizes to a SNAPC4-NOTCH1 fusion nucleic acid molecule described herein, and thereby allows the capture or isolation said nucleic acid molecule. In one embodiment, a bait is suitable for solution phase hybridization. In other embodiments, a bait includes a binding entity, e.g., an affinity tag, that allows capture and separation, e.g., by binding to a binding entity, of a hybrid formed by a bait and a nucleic acid hybridized to the bait.

In other embodiments, the nucleic acid fragment includes a library member comprising a SNAPC4-NOTCH1 nucleic acid molecule described herein. In one embodiment, the library member includes a rearrangement that results in a SNAPC4-NOTCH1 fusion described herein.

The nucleic acid fragment can be detectably labeled with, e.g., a radiolabel, a fluorescent label, a bioluminescent label, a chemiluminescent label, an enzyme label, a binding pair label, or can include an affinity tag; a tag, or identifier (e.g., an adaptor, barcode or other sequence identifier).

SNAPC4-NOTCH1 Fusion Polypeptides

In another embodiment, the SNAPC4-NOTCH1 fusion comprises an amino acid sequence shown in FIGS. 70A-70D (SEQ ID NO:72) or FIG. 72 (SEQ ID NO:74) and FIG. 74 (SEQ ID NO:76), or a fragment thereof. In one embodiment, the SNAPC4-NOTCH1 fusion comprises an amino acid sequence substantially identical to the amino acid sequence shown in FIGS. 70A-70D (SEQ ID NO:72) or FIG. 72 (SEQ ID NO:74) and FIG. 74 (SEQ ID NO:76), or a fragment thereof. In one embodiment, the SNAPC4-NOTCH1 fusion comprises an amino acid sequence at least 70%, at least 75%, at least 80%, at least 85%, at least 90%, at least 95%, at least 99%, at least 99.5 or greater, identical to the amino acid sequence shown in FIGS. 70A-70D (SEQ ID NO:72) or FIG. 72 (SEQ ID NO:74) and FIG. 74 (SEQ ID NO:76)). In one embodiment, the SNAPC4-NOTCH1 fusion comprises a sequence containing at least 10, 20, 50, 100, 500, 600, 700, 800, 900, 1000, or more amino acids of the amino acid sequence shown in FIGS. 70A-70D (SEQ ID NO:72); or at least 5, 10, 20, 50, 100, 500, 600, 700, 800, 900, 1000, or more amino acids of the amino acid sequence shown in FIG. 72 (SEQ ID NO:74) and at least 5, 10, 20, 50, 100, 500, 600, 700, 800, 900, 1000, or more amino acids of the amino acid sequence shown in FIG. 74 (SEQ ID NO:76). In one embodiment, the SNAPC4-NOTCH1 fusion comprises an amino acid sequence containing at least 10, 20, 50, 100, 500, 600, 700, 800, 900, 1000, or more contiguous amino acids of the amino acid sequence shown in FIGS. 70A-70D (SEQ ID NO:72); or at least 5, 10, 20, 50, 100, 500, 600, 700, 800, 900, 1000, or more contiguous amino acids of the amino acid sequence shown in FIG. 72 (SEQ ID NO:74) and at least 5, 10, 20, 50, 100, 500, 600, 700, 800, 900, 1000, or more contiguous amino acids of the amino acid sequence shown in FIG. 74 (SEQ ID NO:76).

In another aspect, the invention features a SNAPC4-NOTCH1 fusion polypeptide (e.g., a purified SNAPC4-NOTCH1 fusion polypeptide), a biologically active or antigenic fragment thereof, as well as reagents (e.g., antibody molecules that bind to a SNAPC4-NOTCH1 fusion polypeptide), methods for modulating a SNAPC4-NOTCH1 polypeptide activity and detection of a SNAPC4-NOTCH1 polypeptide.

In one embodiment, the SNAPC4-NOTCH1 fusion polypeptide has at least one biological activity. In one embodiment, at least one biological activity of the SNAPC4-NOTCH1 fusion polypeptide is reduced or inhibited by an anti-cancer drug, e.g., a NOTCH1 inhibitor. In one embodiment, at least one biological activity of the SNAPC4-NOTCH1 fusion polypeptide is reduced or inhibited by a NOTCH1 inhibitor. In certain embodiments, the NOTCH1 inhibitor includes but is not limited to, is a pan NOTCH inhibitor, a NOTCH1 inhibitor compound, an anti-NOTCH1 antibody, an anti-NOTCH1 negative regulatory region antibody, or a gamma-secretase inhibitor (GSI).

In yet other embodiments, the SNAPC4-NOTCH1 fusion polypeptide is encoded by a nucleic acid molecule described herein. In one embodiment, the SNAPC4-NOTCH1 fusion polypeptide is encoded by an in-frame fusion of intron 1 of SNAPC4 with intron 27 of NOTCH1 (e.g., a sequence on chromosome 9). In another embodiment, the SNAPC4-NOTCH1 fusion polypeptide includes an amino acid sequence encoded by a nucleotide sequence comprising a fusion junction between the SNAPC4 transcript and the NOTCH1 transcript.

In certain embodiments, the SNAPC4-NOTCH1 fusion polypeptide comprises one or more of encoded exon 1 from SNAPC4 and one or more of encoded exons 28-34 from NOTCH1. In certain embodiments, the SNAPC4-NOTCH1 fusion polypeptide comprises at least 1 or more encoded exons from SNAPC4 and at least 1, 2, 3, 4, 5, 6, 7 or more, encoded exons from NOTCH1. In certain embodiments, the SNAPC4-NOTCH1 fusion polypeptide comprises a fusion of encoded exon 1 from SNAPC4 and encoded exon 28 from NOTCH1 (or a fragment thereof). In certain embodiments, the 5' SNAPC4-3' NOTCH1 fusion polypeptide comprises a fusion junction of the sequence of exon 1 from SNAPC4 and the sequence of exon 28 from NOTCH1 (e.g., as shown in SEQ ID NOs:72, 74 and 76).

In certain embodiments, the SNAPC4-NOTCH1 fusion comprises the amino acid sequence corresponding to exon 1 or a fragment thereof from SNAPC4, and the amino acid sequence corresponding to exon 28 or a fragment thereof from NOTCH1 (e.g., as shown in FIGS. 70A-70D (SEQ ID NO:72) or FIGS. 72 and 74 (SEQ ID NO:74 and 76, respectively)). In one embodiment, the SNAPC4-NOTCH1 fusion comprises at least 5, 10, 15, 20 or more amino acids from exon 1 of SNAPC4 (e.g., from the amino acid sequence of SNAPC4 preceding the fusion junction with NOTCH1, e.g., the SNAPC4 sequence shown in FIGS. 70A-70D (SEQ ID NO:72) or FIG. 72 (SEQ ID NO:74), and at least 5, 10, 15, 20 or more amino acids from exon 28 of NOTCH1 (e.g., from the amino acid sequence of NOTCH1 following the fusion junction with SNAPC4, e.g., the NOTCH1 sequence shown in FIGS. 70A-70D (SEQ ID NO:72) or FIG. 74 (SEQ ID NO:76)).

In one embodiment, the SNAPC4-NOTCH1 fusion polypeptide includes a NOTCH1 functional domain or a functional fragment thereof. In a related aspect, the invention features SNAPC4-NOTCH1 fusion polypeptide or fragments operatively linked to heterologous polypeptides to form fusion proteins.

In another embodiment, the SNAPC4-NOTCH1 fusion polypeptide or fragment is a peptide, e.g., an immunogenic peptide or protein, that contains a fusion junction described herein. Such immunogenic peptides or proteins can be used to raise antibodies specific to the fusion protein. In other embodiments, such immunogenic peptides or proteins can be used for vaccine preparation. The vaccine preparation can include other components, e.g., an adjuvant.

In another aspect, the invention features antibody molecules that bind to a SNAPC4-NOTCH1 fusion polypeptide or fragment described herein. In embodiments the antibody can distinguish wild type NOTCH1 (or SNAPC4) from SNAPC4-NOTCH1.

Detection Reagents and Detection of Mutations

In another aspect, the invention features a detection reagent, e.g., a purified or an isolated preparation thereof. Detection reagents can distinguish a nucleic acid, or protein sequence, having a breakpoint, e.g., a SNAPC4-NOTCH1 breakpoint; from a reference sequence. In one embodiment, the detection reagent detects (e.g., specifically detects) a SNAPC4-NOTCH1 fusion nucleic acid or a polypeptide (e.g., distinguishes a wild type NOTCH1 or another NOTCH1 fusion (or SNAPC4) from a SNAPC4-NOTCH1 nucleic acid (e.g., as described herein in FIGS. 70A-70D (SEQ ID NO:71) or FIGS. 71A-71B (SEQ ID NO:73) and FIGS. 73A-73B (SEQ ID NO:75); or a SNAPC4-NOTCH1 polypeptide (e.g., as described herein in FIGS. 70A-70D (SEQ ID NO:72) or FIGS. 72 and 74 (SEQ ID NO:74 and 76, respectively).

Detection reagents, e.g., nucleic acid-based detection reagents, can be used to identify mutations in a target nucleic acid, e.g., DNA, e.g., genomic DNA or cDNA, or RNA, e.g., in a sample, e.g., a sample of nucleic acid derived from a neoplastic or tumor cell, e.g., a melanocytic neoplasm, melanoma or metastatic cell. Detection reagents, e.g., antibody-based detection reagents, can be used to identify mutations in a target protein, e.g., in a sample, e.g., a sample of protein derived from, or produced by, a neoplastic or tumor cell, e.g., a melanocytic neoplasm, melanoma or metastatic cell.

Method of Treatment

In a related aspect, a method of inhibiting, reducing, or treating a hyperproliferative disorder, e.g., a neoplasm (including benign, pre-malignant or malignant (e.g., a cancer), in a subject is provided. The method includes administering to the subject a preselected therapeutic agent, e.g., an anti-cancer agent (e.g., a kinase inhibitor), as a single agent, or in combination, in an amount sufficient to reduce, inhibit or treat the activity or expression of SNAPC4-NOTCH1 (e.g., a SNAPC4-NOTCH1 fusion described herein), thereby inhibiting, reducing, or treating the hyperproliferative disorder in the subject.

In one embodiment, the subject treated has a SNAPC4-NOTCH1 fusion; e.g., the subject has a tumor or cancer harboring a SNAPC4-NOTCH1 fusion. In other embodiments, the subject has been previously identified as having a SNAPC4-NOTCH1 fusion. In yet other embodiments, the subject has been previously identified as being likely or unlikely to respond to treatment with a protein kinase inhibitor, e.g., a subject that has previously participated in a clinical trial. In other embodiments, the subject has been previously identified as being likely or unlikely to respond to treatment with a protein kinase inhibitor, based on the presence of the SNAPC4-NOTCH1 fusion. In one embodiment, the subject is a mammal, e.g., a human. In one embodiment, the subject has, or at risk of having a cancer at any stage of disease. In other embodiments, the subject is a patient, e.g., a cancer patient.

In certain embodiments, the neoplasm or neoplastic cell is a benign, pre-malignant, malignant (cancer) or metastasis. In certain embodiments, the cancer is a solid tumor, a soft tissue tumor, or a metastatic lesion. In one embodiment, the cancer is a breast cancer. In certain embodiments, the cancer is metastatic breast cancer. In one embodiment, the cancer is chosen from a lung cancer, a pancreatic cancer, melanoma, a colorectal cancer, an esophageal-gastric cancer, a thyroid cancer, or an adenocarcinoma.

In one embodiment, the anti-cancer agent is a NOTCH1 inhibitor. In certain embodiments, the NOTCH1 inhibitor can include, but not limited to, a pan NOTCH inhibitor, a NOTCH1 inhibitor compound, an anti-NOTCH1 antibody, an anti-NOTCH1 negative regulatory region antibody, or a gamma-secretase inhibitor (GSI). In some embodiments, the NOTCH1 inhibitor is chosen forom: MEDI0639; MK0752; OMP-59R5; PF03084014; and/or BMS-906024. In some embodiments the NOTCH1 inhibitor is a NOTCH1 inhibitor described herein.

TSC2-CREBBP Fusions

In one embodiment, a fusion includes an in-frame fusion of an exon of tuberous sclerosis 2 (TSC2), e.g., one more exons of TSC2 (e.g., one or more of exons of exons 1-35 of TSC2) or a fragment thereof, and an exon of CREB binding protein (CREBBP), e.g., one or more exons of a CREBBP (e.g., one or more of exons 24-31 of CREBBP) or a fragment thereof. For example, the TSC2-CREBBP fusion can include an in-frame fusion within an intron of TSC2 (e.g., intron 35) or a fragment thereof, with an intron of CREBBP (e.g., intron 23) or a fragment thereof. In one embodiment, the fusion of the TSC2-CREBBP fusion comprises the nucleotide sequence of: chromosome 16 at nucleotide 2,136,500 (plus or minus 10, 20, 30, 50, 60, 70, 80, 100 or more nucleotides) and chromosome 16 at nucleotide 3,793,550 (plus or minus 10, 20, 30, 50, 60, 70, 80, 100 or more nucleotides). In one embodiment, the TSC2-CREBBP fusion is an inversion, e.g., an inversion of a portion of chromosome 16.

In certain embodiments, the TSC2-CREBBP fusion is in a 5'-TSC2 to 3'-CREBBP configuration (also referred to herein as "5'-TSC2-CREBBP-3')." The term "fusion" or "fusion molecule" can refer to a polypeptide or a nucleic acid fusion, depending on the context. It may include a full-length sequence or a fragment thereof, e.g., a fusion junction (e.g., a fragment including a portion of TSC2 and a portion of CREBBP, e.g., a portion of the TSC2-CREBBP fusion described herein). In one embodiment, the TSC2-CREBBP fusion polypeptide includes the amino acid sequence shown in FIGS. 75A-75D (SEQ ID NO:78) or FIGS. 77 and 79 (SEQ ID NOs:80 and 82), or an amino acid sequence substantially identical thereto. In another embodiment, the TSC2-CREBBP fusion nucleic acid includes the nucleotide sequence shown in FIGS. 75A-75D (SEQ ID NO:77) or FIGS. 76A-76B and 78A-78B (SEQ ID NOs:79 and 81), or a nucleotide sequence substantially identical thereto.

In certain embodiments, the TSC2-CREBBP fusion comprises one or more (or all of) exons exons 1-35 from TSC2 and one or more (or all of) exons 24-31 from CREBBP (e.g., one or more of the exons shown in FIGS. 75A-75D or FIGS. 76A-76B and 78A-78B). In another embodiment, the TSC2-CREBBP fusion comprises one or more (or all of) exons exons 1-35 of TSC2 and one or more (or all of) exons 24-31 of CREBBP. In certain embodiments, the TSC2-CREBBP fusion comprises at least 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35 or more exons from TSC2 and at least 1, 2, 3, 4, 5, 6, 7, 8 or more exons from CREBBP (e.g., from the TSC2 and CREBBP sequences shown in FIGS. 75A-75D (SEQ ID NO:77 and 77) or FIGS. 76A-76B, 77, 78A-78B and 74 (SEQ ID NOs:79, 80, 81, and 82).

In certain embodiments, the TSC2-CREBBP fusion comprises exon 35 or a fragment thereof from TSC2, and exon 24 or a fragment thereof from CREBBP (e.g., as shown in FIGS. 75A-75D (SEQ ID NOs:77 and 78)). In one embodiment, the TSC2-CREBBP fusion comprises at least 5, 10, 15, 20, 30, 40, 50 or more amino acids from exon 35 of TSC2 (e.g., from the amino acid sequence of TSC2 preceding the fusion junction with CREBBP, e.g., the TSC2 sequence shown in FIGS. 75A-75D (SEQ ID NO:78) or FIG. 77 (SEQ ID NO:80)), and at least 5, 10, 15, 20, 30, 40, 50 or more amino acids from exon 24 of CREBBP (e.g., from the amino acid sequence of CREBBP following the fusion junction with TSC2, e.g., the CREBBP sequence shown in FIGS. 75A-75D (SEQ ID NO:78) or FIG. 79 (SEQ ID NO:82)). In another embodiment, the TSC2-CREBBP fusion comprises at least 6, 12, 15, 20, 25, 50, 75, 100 or more nucleotides from exon 35 of TSC2 (e.g., from the nucleotide sequence of TSC2 preceding the fusion junction with CREBBP, e.g., the TSC2 sequence shown in FIGS. 75A-75D (SEQ ID NO:77) or FIGS. 76A-76B (SEQ ID NO:79)), and at least 6, 12, 15, 20, 25, 50, 75, 100 or more nucleotides from exon 24 of CREBBP (e.g., from the nucleotide sequence of CREBBP following the fusion junction with TSC2, e.g., the CREBBP sequence shown in FIGS. 75A-75D (SEQ ID NO:77) or FIGS. 78A-78B (SEQ ID NO:81)).

TSC2-CREBBP Nucleic Acid Molecules

In one aspect, the invention features a nucleic acid molecule (e.g., an isolated or purified) nucleic acid molecule that includes a fragment of a TSC2 gene and a fragment of a CREBBP gene. In another embodiment, the nucleotide sequence encodes a fragment of the TSC2 polypeptide of SEQ ID NO:78 or 80, or a fragment thereof; or a sequence substantially identical thereto. In other embodiments, the nucleic acid molecule includes a fragment of the CREBBP gene encoding the amino acid sequence of SEQ ID NO:78 or 82, or a fragment thereof; or a sequence substantially identical thereto. In yet other embodiments, the nucleic acid molecule includes a nucleotide sequence encoding the amino acid sequence shown in FIGS. 75A-75D (e.g., SEQ ID NO:78) or a fragment thereof, or a sequence substantially identical thereto.

In one embodiment, the nucleic acid molecule includes a fusion, e.g., an in-frame fusion, between an intron of TSC2 (e.g., intron 35, or a fragment thereof), and an intron of CREBBP (e.g., intron 23, or a fragment thereof). The TSC2-CREBBP fusion can comprise a fusion of the nucleotide sequence of: chromosome 16 at nucleotide 2,136,500 (plus or minus 10, 20, 30, 50, 60, 70, 80, 100 nucleotides) and chromosome 16 at nucleotide 3,793,550 (plus or minus 10, 20, 30, 50, 60, 70, 80, 100 nucleotides), or a fragment thereof. In one embodiment, the TSC2-CREBBP fusion comprises a fusion of the nucleotide sequence of: chromosome 16 at nucleotide 2,136,500 plus or minus 10, 20, 30, 40, 50, 100, 150, 200, 250, 300, 350, 400, 450, 500, 1000, 2000, or 3000 nucleotides and chromosome 16 at nucleotide 3,793,550 plus or minus 10, 20, 30, 40, 50, 100, 150, 200, 250, 300, 350, 400, 450, 500, 1000, 2000, or 3000 nucleotides, or a fragment thereof.

In another embodiment, the TSC2-CREBBP fusion comprises a nucleotide sequence shown in FIGS. 75A-75D (SEQ ID NO:77) or FIGS. 76A-76B (SEQ ID NO:79) and FIGS. 78A-78B (SEQ ID NO:81), or a fragment thereof. In one embodiment, the TSC2-CREBBP fusion comprises a nucleotide sequence substantially identical to the nucleotide sequence shown in FIGS. 75A-75D (SEQ ID NO: 77) or FIGS. 76A-76B (SEQ ID NO:79) and FIGS. 78A-78B (SEQ ID NO:81), or a fragment thereof. In one embodiment, the TSC2-CREBBP fusion comprises a nucleotide sequence at least 70%, at least 75%, at least 80%, at least 85%, at least 90%, at least 95%, at least 99%, at least 99.5 or greater, identical to the nucleotide sequence shown in FIGS. 75A-75D (SEQ ID NO: 77) or FIGS. 76A-76B (SEQ ID NO:79) and FIGS. 78A-78B (SEQ ID NO:81). In one embodiment, the TSC2-CREBBP fusion comprises a nucleotide sequence containing at least 50, 100, 150, 200, 500, 1000, 1500, 2000, 2500, 3000, or more nucleotides of the nucleotide sequence shown in FIGS. 75A-75D (SEQ ID NO: 77) or FIGS. 76A-76B (SEQ ID NO:79) and FIGS. 78A-78B (SEQ ID NO:81). In one embodiment, the TSC2-CREBBP fusion comprises a nucleotide sequence containing at least 50, 100, 150, 200, 500, 1000, 1500, 2000, 2500, 3000, or more contiguous nucleotides of the nucleotide sequence shown in FIGS. 75A-75D (SEQ ID NO: 77) or FIGS. 76A-76B (SEQ ID NO:79) and FIGS. 78A-78B (SEQ ID NO:81).

In another embodiment, the nucleic acid molecule includes a fusion, e.g., an in-frame fusion, of at least exon 35 of TSC2 or a fragment thereof (e.g., one or more of exons 1-35 of TSC2 or a fragment thereof), and at least exon 24 or a fragment thereof (e.g., one or more of exons 24-31 of CREBBP or a fragment thereof). In one embodiment, the nucleic acid molecule includes the nucleotides sequence corresponding to exon 35, of a TSC2 gene, (SEQ ID NO:77 or 79) or a fragment thereof, or a sequence substantially identical thereto. In another embodiment, the nucleic acid molecule includes the nucleotide sequence corresponding to exons 24-31, of CREBBP (SEQ ID NO:77 or 81) or a fragment thereof, or a sequence substantially identical thereto. In yet other embodiments, the nucleic acid molecule includes the nucleotide sequence shown in FIGS. 75A-75D (e.g., SEQ ID NO:77) or FIGS. 76A-76B (e.g., SEQ ID NO:79) and FIGS. 78A-78B (e.g., SEQ ID NO:81), or a fragment thereof, or a sequence substantially identical thereto.

In one embodiment, the nucleic acid molecule is complementary to at least a portion of a nucleotide sequence disclosed herein, e.g., is capable of hybridizing under a stringency condition described herein to SEQ ID NO:77 or SEQ ID NO:79 and/or SEQ ID NO:81, or a fragment thereof. In yet another embodiment, the nucleic acid molecule hybridizes to a nucleotide sequence that is complementary to at least a portion of a nucleotide sequence disclosed herein, e.g., is capable of hybridizing under a stringency condition to a nucleotide sequence complementary to SEQ ID NO:77 or SEQ ID NO:79 and/or SEQ ID NO:81, or a fragment thereof. The nucleotide sequence of a cDNA encoding an exemplary 5' TSC2-3' CREBBP fusion is shown in SEQ ID NO:77 or a fragment of SEQ ID NO:79 and SEQ ID NO:81, and the predicted amino acid sequence is shown in SEQ ID NO:78 and a fragment of SEQ ID NO:70 and SEQ ID NO:82, respectively.

In certain embodiments, the 5' TSC2-3' CREBBP fusion comprises exons 1-35 from TSC2 and exons 24-31 from CREBBP. In certain embodiments, the TSC2-CREBBP fusion comprises at least 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35 or more exons from TSC2 and at least 1, 2, 3, 4, 5, 6, 7, 8 or more exons from CREBBP. In certain embodiments, the TSC2-CREBBP fusion comprises a fusion of exon 35 from TSC2 and exon 24 from CREBBP. In another embodiment, the TSC2-CREBBP fusion comprises at least 1 exons from TSC2; and at least 1, 2, 3, 4, 5, 6, 7, 8 exons from CREBBP (e.g., the corresponding exons from SEQ ID NO:79 and SEQ ID NO:81).

In one embodiment, the nucleic acid molecule includes a nucleotide sequence that has an in-frame fusion of intron 35 of TSC2 (e.g., NM_001077183) with intron 23 of CREBBP (e.g., NM_017617). In another embodiment, the nucleic acid molecule includes a nucleotide sequence that includes a breakpoint. For example, the nucleic acid molecule includes a nucleotide sequence that includes the fusion junction between the TSC2 gene and the CREBBP gene, e.g., the breakpoint between intron 35 of TSC2 and intron 23 of CREBBP. In other embodiments, the nucleic acid molecules includes a nucleotide sequence of one or more of nucleotide 2,136,500 of chromosome 16 coupled to (e.g., directly or indirectly juxtaposed to) one or more of nucleotide 3,793, 550 of chromosome 16. In one embodiment, the nucleic acid molecule includes the nucleotide sequence of: chromosome 16 at nucleotide 2,136,500 plus or minus 10, 20, 30, 40 50, 60, 80, 100, 150 nucleotides and chromosome 16 at nucleotide 3,793,550 plus or minus 10, 20, 30, 40 50, 60, 80, 100, 150 nucleotides (corresponding to the breakpoint of a TSC2-CREBBP fusion), or a fragment thereof, or a sequence substantially identical thereto. In one embodiment, the nucleic acid molecule is complementary to at least a portion of a nucleotide sequence disclosed herein, e.g., is capable of hybridizing under a stringency condition described herein to SEQ ID NO:77 or 79, and 81, or a fragment thereof. In yet other embodiment, the nucleic acid molecule hybridizes to a nucleotide sequence that is complementary to at least a portion of a nucleotide sequence disclosed herein, e.g., is capable of hybridizing under a stringency condition described herein to a nucleotide sequence complementary to SEQ ID NO:77 or 79, and 81, or a fragment thereof.

In another embodiment, the TSC2-CREBBP fusion nucleic acid comprises at least 6, 12, 15, 20, 25, 50, 75, 100 or more nucleotides from exon 35 of TSC2 (e.g., from the nucleotide sequence of TSC2 preceding the fusion junction with CREBBP, e.g., the TSC2 sequence shown in FIGS. 75A-75D (SEQ ID NO:77) or FIGS. 76A-76B (SEQ ID NO:79)), and at least 6, 12, 15, 20, 25, 50, 75, 100 or more nucleotides from exon 24 of CREBBP (e.g., from the nucleotide sequence of CREBBP following the fusion junction with TSC2, e.g., the CREBBP sequence shown in FIGS. 75A-75D (SEQ ID NO:77) or FIGS. 78A-78B (SEQ ID NO:81)).

In other embodiments, the nucleic acid molecule includes a nucleotide sequence encoding a TSC2-CREBBP fusion polypeptide that includes a fragment of a TSC2 gene and a fragment of a CREBBP gene. In one embodiment, the nucleotide sequence encodes a TSC2-CREBBP fusion polypeptide that includes e.g., a CREBBP functional domain or a functional fragment thereof. In another embodiment, the nucleotide sequence encodes a fragment of the CREBBP polypeptide of SEQ ID NO:78 or 82 or a fragment thereof, or a sequence substantially identical thereto. For example, the nucleic acid molecule can include a nucleotide sequence encoding a CREBBP functional domain of SEQ ID NO:78 or SEQ ID NO:82 or a fragment thereof. In yet other embodiments, the nucleic acid molecule includes a nucleotide sequence encoding the amino acid sequence shown in FIGS. 75A-75D (e.g., SEQ ID NO:78) or FIGS. 77 and 79 (e.g., SEQ ID NOs:80 and 82), or a fragment thereof, or a sequence substantially identical thereto.

In a related aspect, the invention features nucleic acid constructs that include the TSC2-CREBBP nucleic acid molecules described herein. In certain embodiments, the nucleic acid molecules are operatively linked to a native or a heterologous regulatory sequence. Also included are vectors and host cells that include the TSC2-CREBBP nucleic acid molecules described herein, e.g., vectors and host cells suitable for producing the nucleic acid molecules and polypeptides described herein.

In a related aspect, methods of producing the nucleic acid molecules and polypeptides described herein are also described.

In another aspect, the invention features nucleic acid molecules that reduce or inhibit the expression of a nucleic acid molecule that encodes a TSC2-CREBBP fusion described herein. Examples of such nucleic acid molecules include, for example, antisense molecules, ribozymes, RNAi, triple helix molecules that hybridize to a nucleic acid encoding TSC2-CREBBP, or a transcription regulatory region of TSC2-CREBBP, and blocks or reduces mRNA expression of TSC2-CREBBP.

Nucleic Acid Detection and Capturing Reagents

The invention also features a nucleic acid molecule, e.g., nucleic acid fragment, suitable as probe, primer, bait or library member that includes, flanks, hybridizes to, which are useful for identifying, or are otherwise based on, the TSC2-CREBBP fusions described herein. In certain embodiments, the probe, primer or bait molecule is an oligonucleotide that allows capture, detection or isolation of a TSC2-CREBBP fusion nucleic acid molecule described herein. The oligonucleotide can comprise a nucleotide sequence substantially complementary to a fragment of the TSC2-CREBBP fusion nucleic acid molecules described herein. The sequence identity between the nucleic acid fragment, e.g., the oligonucleotide, and the target TSC2-CREBBP sequence need not be exact, so long as the sequences are sufficiently complementary to allow the capture, detection or isolation of the target sequence. In one embodiment, the nucleic acid fragment is a probe or primer that includes an oligonucleotide between about 5 and 25, e.g., between 10 and 20, or 10 and 15 nucleotides in length. In other embodiments, the nucleic acid fragment is a bait that includes an oligonucleotide between about 100 to 300 nucleotides, 130 and 230 nucleotides, or 150 and 200 nucleotides, in length.

In one embodiment, the nucleic acid fragment can be used to identify or capture, e.g., by hybridization, a TSC2-CREBBP fusion. For example, the nucleic acid fragment can be a probe, a primer, or a bait, for use in identifying or capturing, e.g., by hybridization, a TSC2-CREBBP fusion described herein. In one embodiment, the nucleic acid fragment can be useful for identifying or capturing a TSC2-CREBBP breakpoint, e.g., the nucleotide sequence of: chromosome 16 at nucleotide 2,136,500 plus or minus 10, 20, 30, 40 50, 60, 80, 100, 150 nucleotides and chromosome 16 at nucleotide 3,793,550 plus or minus 10, 20, 30, 40 50, 60, 80, 100, 150 nucleotides.

In one embodiment, the nucleic acid fragment hybridizes to a nucleotide sequence within a chromosomal rearrangement that creates an in-frame fusion of intron 35 of TSC2 with intron 35 of CREBBP. In one embodiment, the nucleic acid fragment hybridizes to a nucleotide sequence in the region In other embodiments, the nucleic acid molecules includes a nucleotide sequence in the region of nucleotides 2,136,500 of chromosome 16 coupled to (e.g., juxtaposed to) nucleotides in the region of nucleotides 3,793,550 of chromosome 16. In one embodiment, the nucleic acid fragment hybridizes to a nucleotide sequence that includes a breakpoint, e.g., the nucleotide sequence of: chromosome 16 at nucleotide 2,136,500 plus or minus 10, 20, 30, 40 50, 60, 80, 100, 150 or more nucleotides and chromosome 16 at nucleotide 3,793,550 plus or minus 10, 20, 30, 40 50, 60, 80, 100, 150 or more nucleotides. For example, the nucleic acid fragment can hybridize to a nucleotide sequence that includes the fusion junction between the TSC2 gene and the CREBBP gene, e.g., a nucleotide sequence that includes a portion of a nucleotide sequence within intron 35 of a TSC2 gene and 23 of a CREBBP gene.

In another embodiment, the nucleic acid fragment hybridizes to a nucleotide sequence that comprises at least 6, 12, 15, 20, 25, 50, 75, 100, 150 or more nucleotides from exon 35 of TSC2 (e.g., from the nucleotide sequence of TSC2 preceding the fusion junction with CREBBP, e.g., the TSC2 sequence shown in FIGS. 75A-75D (SEQ ID NO:77) or FIG. 71 (SEQ ID NO:79), and at least 6, 12, 15, 20, 25, 50, 75, 100, 150 or more nucleotides from exon 24 of CREBBP (e.g., from the nucleotide sequence of CREBBP following the fusion junction with TSC2, e.g., the CREBBP sequence shown in FIGS. 75A-75D (SEQ ID NO:77) or FIG. 78 (SEQ ID NO:81)).

The probes or primers described herein can be used, for example, for FISH detection or PCR amplification. In one exemplary embodiment where detection is based on PCR, amplification of the TSC2-CREBBP fusion junction fusion junction can be performed using a primer or a primer pair, e.g., for amplifying a sequence flanking the fusion junctions described herein, e.g., the mutations or the junction of a chromosomal rearrangement described herein, e.g., TSC2-CREBBP.

In one embodiment, a pair of isolated oligonucleotide primers can amplify a region containing or adjacent to a position in the CREBBP-TSC2 fusion. For example, forward primers can be designed to hybridize to a nucleotide sequence within TSC2 genomic or mRNA sequence (e.g., a nucleotide sequence within exon 35 of TSC2 of SEQ ID NO:77 or 79), and the reverse primers can be designed to hybridize to a nucleotide sequence of CREBBP (e.g., a nucleotide sequence within exon 24 of CREBBP, of SEQ ID NO:77 or 81).

In another embodiment, the nucleic acid fragments can be used to identify, e.g., by hybridization, a TSC2-CREBBP fusion. In one embodiment, the nucleic acid fragment hybridizes to a nucleotide sequence that includes a fusion junction between the TSC2 transcript and the CREBBP transcript.

In other embodiments, the nucleic acid fragment includes a bait that comprises a nucleotide sequence that hybridizes to a TSC2-CREBBP fusion nucleic acid molecule described herein, and thereby allows the capture or isolation said nucleic acid molecule. In one embodiment, a bait is suitable for solution phase hybridization. In other embodiments, a bait includes a binding entity, e.g., an affinity tag, that allows capture and separation, e.g., by binding to a binding entity, of a hybrid formed by a bait and a nucleic acid hybridized to the bait.

In other embodiments, the nucleic acid fragment includes a library member comprising a TSC2-CREBBP nucleic acid molecule described herein. In one embodiment, the library member includes a rearrangement that results in a TSC2-CREBBP fusion described herein.

The nucleic acid fragment can be detectably labeled with, e.g., a radiolabel, a fluorescent label, a bioluminescent label, a chemiluminescent label, an enzyme label, a binding pair label, or can include an affinity tag; a tag, or identifier (e.g., an adaptor, barcode or other sequence identifier).

TSC2-CREBBP Fusion Polypeptides

In another embodiment, the TSC2-CREBBP fusion comprises an amino acid sequence shown in FIGS. 75A-75D (SEQ ID NO:78) or FIG. 77 (SEQ ID NO:80) and FIG. 79 (SEQ ID NO:82), or a fragment thereof. In one embodiment, the TSC2-CREBBP fusion comprises an amino acid sequence substantially identical to the amino acid sequence shown in FIGS. 75A-75D (SEQ ID NO:78) or FIG. 77 (SEQ ID NO:80) and FIG. 79 (SEQ ID NO:82), or a fragment thereof. In one embodiment, the TSC2-CREBBP fusion comprises an amino acid sequence at least 70%, at least 75%, at least 80%, at least 85%, at least 90%, at least 95%, at least 99%, at least 99.5 or greater, identical to the amino acid sequence shown in FIGS. 75A-75D (SEQ ID NO:78) or FIG. 77 (SEQ ID NO:80) and FIG. 79 (SEQ ID NO:82)). In one embodiment, the TSC2-CREBBP fusion comprises a sequence containing at least 10, 20, 50, 100, 500, 600, 700, 800, 900, 1000, or more amino acids of the amino acid sequence shown in FIGS. 75A-75D (SEQ ID NO:78); or at least 5, 10, 20, 50, 100, 500, 600, 700, 800, 900, 1000, or more amino acids of the amino acid sequence shown in FIG. 77 (SEQ ID NO:80) and at least 5, 10, 20, 50, 100, 500, 600, 700, 800, 900, 1000, or more amino acids of the amino acid sequence shown in FIG. 79 (SEQ ID NO:82). In one embodiment, the TSC2-CREBBP fusion comprises an amino acid sequence containing at least 10, 20, 50, 100, 500, 600, 700, 800, 900, 1000, or more contiguous amino acids of the amino acid sequence shown in FIGS. 75A-75D (SEQ ID NO:78); or at least 5, 10, 20, 50, 100, 500, 600, 700, 800, 900, 1000, or more contiguous amino acids of the amino acid sequence shown in FIG. 77 (SEQ ID NO:80) and at least 5, 10, 20, 50, 100, 500, 600, 700, 800, 900, 1000, or more contiguous amino acids of the amino acid sequence shown in FIG. 79 (SEQ ID NO:82).

In another aspect, the invention features a TSC2-CREBBP fusion polypeptide (e.g., a purified TSC2-CREBBP fusion polypeptide), a biologically active or antigenic fragment thereof, as well as reagents (e.g., antibody molecules that bind to a TSC2-CREBBP fusion polypeptide), methods for modulating a TSC2-CREBBP polypeptide activity and detection of a TSC2-CREBBP polypeptide.

In one embodiment, the TSC2-CREBBP fusion polypeptide has at least one biological activity. In one embodiment, at least one biological activity of the TSC2-CREBBP fusion polypeptide is reduced or inhibited by an anti-cancer drug, e.g., a TSC2 activator or stabilizer. In one embodiment, at least one biological activity of the TSC2-CREBBP fusion polypeptide is increased or activated by a TSC2 activator or stabilizer.

In yet other embodiments, the TSC2-CREBBP fusion polypeptide is encoded by a nucleic acid molecule described herein. In one embodiment, the TSC2-CREBBP fusion polypeptide is encoded by an in-frame fusion of intron 35 of TSC2 with intron 23 of CREBBP (e.g., a sequence on chromosome 16). In another embodiment, the TSC2-CREBBP fusion polypeptide includes an amino acid sequence encoded by a nucleotide sequence comprising a fusion junction between the TSC2 transcript and the CREBBP transcript.

In certain embodiments, the TSC2-CREBBP fusion polypeptide comprises one or more of encoded exon 35 from TSC2 and one or more of encoded exons 24-31 from CREBBP. In certain embodiments, the TSC2-CREBBP fusion polypeptide comprises at least 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35 or more encoded exons from TSC2 and at least 1, 2, 3, 4, 5, 6, 7, 8 or more, encoded exons from CREBBP. In certain embodiments, the TSC2-CREBBP fusion polypeptide comprises a fusion of encoded exon 35 from TSC2 and encoded exon 24 from CREBBP (or a fragment thereof). In certain embodiments, the 5' TSC2-3' CREBBP fusion polypeptide comprises a fusion junction of the sequence of exon 35 from TSC2 and the sequence of exon 24 from CREBBP (e.g., as shown in SEQ ID NOs:78, 80 and 82).

In certain embodiments, the TSC2-CREBBP fusion comprises the amino acid sequence corresponding to exon 35 or a fragment thereof from TSC2, and the amino acid sequence corresponding to exon 24 or a fragment thereof from CREBBP (e.g., as shown in FIGS. 75A-75D (SEQ ID NO:78) or FIGS. 77 and 79 (SEQ ID NO:80 and 82, respectively)). In one embodiment, the TSC2-CREBBP fusion comprises at least 5, 10, 15, 20 or more amino acids from exon 35 of TSC2 (e.g., from the amino acid sequence of TSC2 preceding the fusion junction with CREBBP, e.g., the TSC2 sequence shown in FIGS. 75A-75D (SEQ ID NO:78) or FIG. 77 (SEQ ID NO:80), and at least 5, 10, 15, 20 or more amino acids from exon 24 of CREBBP (e.g., from the amino acid sequence of CREBBP following the fusion junction with TSC2, e.g., the CREBBP sequence shown in FIGS. 75A-75D (SEQ ID NO:78) or FIG. 79 (SEQ ID NO:82)).

In one embodiment, the TSC2-CREBBP fusion polypeptide includes a CREBBP functional domain or a functional fragment thereof. In a related aspect, the invention features TSC2-CREBBP fusion polypeptide or fragments operatively linked to heterologous polypeptides to form fusion proteins.

In another embodiment, the TSC2-CREBBP fusion polypeptide or fragment is a peptide, e.g., an immunogenic peptide or protein, that contains a fusion junction described herein. Such immunogenic peptides or proteins can be used to raise antibodies specific to the fusion protein. In other embodiments, such immunogenic peptides or proteins can be used for vaccine preparation. The vaccine preparation can include other components, e.g., an adjuvant.

In another aspect, the invention features antibody molecules that bind to a TSC2-CREBBP fusion polypeptide or fragment described herein. In embodiments the antibody can distinguish wild type CREBBP (or TSC2) from TSC2-CREBBP.

Detection Reagents and Detection of Mutations

In another aspect, the invention features a detection reagent, e.g., a purified or an isolated preparation thereof. Detection reagents can distinguish a nucleic acid, or protein sequence, having a breakpoint, e.g., a TSC2-CREBBP breakpoint; from a reference sequence. In one embodiment, the detection reagent detects (e.g., specifically detects) a TSC2-CREBBP fusion nucleic acid or a polypeptide (e.g., distinguishes a wild type CREBBP or another CREBBP fusion (or TSC2) from a TSC2-CREBBP nucleic acid (e.g., as described herein in FIGS. 75A-75D (SEQ ID NO:77) or FIGS. 76A-76B (SEQ ID NO:79) and FIGS. 78A-78B (SEQ ID NO:81); or a TSC2-CREBBP polypeptide (e.g., as described herein in FIGS. 75A-75D (SEQ ID NO:78) or FIGS. 77 and 79 (SEQ ID NO:80 and 82, respectively).

Detection reagents, e.g., nucleic acid-based detection reagents, can be used to identify mutations in a target nucleic acid, e.g., DNA, e.g., genomic DNA or cDNA, or RNA, e.g., in a sample, e.g., a sample of nucleic acid derived from a neoplastic or tumor cell, e.g., a melanocytic neoplasm, melanoma or metastatic cell. Detection reagents, e.g., antibody-based detection reagents, can be used to identify mutations in a target protein, e.g., in a sample, e.g., a sample of protein derived from, or produced by, a neoplastic or tumor cell, e.g., a melanocytic neoplasm, melanoma or metastatic cell.

Method of Treatment

In a related aspect, a method of inhibiting, reducing, or treating a hyperproliferative disorder, e.g., a neoplasm (including benign, pre-malignant or malignant (e.g., a cancer), in a subject is provided. The method includes administering to the subject a preselected therapeutic agent, e.g., an anti-cancer agent (e.g., a kinase inhibitor), as a single agent, or in combination, in an amount sufficient to reduce, inhibit or treat the activity or expression of TSC2-CREBBP (e.g., a TSC2-CREBBP fusion described herein), thereby inhibiting, reducing, or treating the hyperproliferative disorder in the subject.

In one embodiment, the subject treated has a TSC2-CREBBP fusion; e.g., the subject has a tumor or cancer harboring a TSC2-CREBBP fusion. In other embodiments, the subject has been previously identified as having a TSC2-CREBBP fusion. In yet other embodiments, the subject has been previously identified as being likely or unlikely to respond to treatment with a protein kinase inhibitor, e.g., a subject that has previously participated in a clinical trial. In other embodiments, the subject has been previously identified as being likely or unlikely to respond to treatment with a protein kinase inhibitor, based on the presence of the TSC2-CREBBP fusion. In one embodiment, the subject is a mammal, e.g., a human. In one embodiment, the subject has, or at risk of having a cancer at any stage of disease. In other embodiments, the subject is a patient, e.g., a cancer patient.

In certain embodiments, the neoplasm or neoplastic cell is a benign, pre-malignant, malignant (cancer) or metastasis. In certain embodiments, the cancer is a solid tumor, a soft tissue tumor, or a metastatic lesion. In one embodiment, the cancer is a breast cancer. In certain embodiments, the cancer is metastatic breast cancer. In one embodiment, the cancer is chosen from a lung cancer, a pancreatic cancer, melanoma, a colorectal cancer, an esophageal-gastric cancer, a thyroid cancer, or an adenocarcinoma.

In one embodiment, the anti-cancer agent is a TSC2 activator or stabilizer. In certain embodiments, the TSC2 activator or stabilizer can include, but not limited to, 14-3-3 beta. In some embodiments the TSC2 inhibitor is a TSC2 inhibitor described herein.

C5ORF42-ERBB4 Fusions

In one embodiment, a fusion includes an in-frame fusion of an exon of chromosome 5 open reading frame 42 (C5ORF42), e.g., one more exons of C5ORF42 (e.g., one or more of exons 1-40 of C5ORF42) or a fragment thereof, and an exon of tyrosine kinase-type cell surface receptor HER4 (ERBB4), e.g., one or more exons of an ERBB4 (e.g., one or more of exons 11-28 of ERBB4) or a fragment thereof. For example, the C5ORF42-ERBB4 fusion can include an in-frame fusion within an intron of C5ORF42 (e.g., intron 40) or a fragment thereof, with an intron of ERBB4 (e.g., intron 10) or a fragment thereof. In one embodiment, the fusion of the C5ORF42-ERBB4 fusion comprises the nucleotide sequence of: chromosome 5 at nucleotide 37,156,250 (plus or minus 10, 20, 30, 50, 60, 70, 80, 100 or more nucleotides) and chromosome 2 at nucleotide 212,568,950 (plus or minus 10, 20, 30, 50, 60, 70, 80, 100 or more nucleotides). In one embodiment, the C5ORF42-ERBB4 fusion is a translocation, e.g., a translocation of a portion of chromosome 5; or a translocation of a portion of chromosome 2.

In certain embodiments, the C5ORF42-ERBB4 fusion is in a 5'-C5ORF42 to 3'-ERBB4 configuration (also referred to herein as "5'-C5ORF42-ERBB4-3')." The term "fusion" or "fusion molecule" can refer to a polypeptide or a nucleic acid fusion, depending on the context. It may include a full-length sequence or a fragment thereof, e.g., a fusion junction (e.g., a fragment including a portion of C5ORF42 and a portion of ERBB4, e.g., a portion of the C5ORF42-ERBB4 fusion described herein). In one embodiment, the C5ORF42-ERBB4 fusion polypeptide includes the amino acid sequence shown in FIGS. 80A-80D (SEQ ID NO:84) or FIGS. 82 and 28 (SEQ ID NOs:86 and 28), or an amino acid sequence substantially identical thereto. In another embodiment, the C5ORF42-ERBB4 fusion nucleic acid includes the nucleotide sequence shown in FIGS. 80A-80D (SEQ ID NO:83) or FIGS. 81A-81B and 27A-27B (SEQ ID NOs:85 and 27), or a nucleotide sequence substantially identical thereto. In one embodiment, the C5ORF42-ERBB4 fusion polypeptide comprises sufficient C5ORF42 and sufficient ERBB4 sequence such that the 5' C5ORF42-3' ERBB4 fusion has kinase activity, e.g., has elevated activity, e.g., ERBB4 tyrosine kinase activity, as compared with wild type ERBB4, e.g., in a cell of a cancer referred to herein (e.g., breast cancer, e.g., triple negative breast cancer).

In certain embodiments, the C5ORF42-ERBB4 fusion comprises one or more (or all of) exons 1-40 from C5ORF42 and one or more (or all of) exons 11-28 from ERBB4 (e.g., one or more of the exons shown in FIGS. 80A-80D or FIGS. 81A-81B and 27A-27B). In another embodiment, the C5ORF42-ERBB4 fusion comprises one or more (or all of) exons 1-40 of C5ORF42 and one or more (or all of) exons 11-28 of ERBB4. In certain embodiments, the C5ORF42-ERBB4 fusion comprises at least 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40 or more exons from C5ORF42 and at least 1, 2, 3, 4, 5, 6, 7, 8, 9, 10, 11, 12, 13, 14, 15, 16, 17, 18 or more exons from ERBB4 (e.g., from the C5ORF42 and ERBB4 sequences shown in FIGS. 80A-80D (SEQ ID NO:83 and 84) or FIGS. 81A-81B, 82, 27A-27B and 28 (SEQ ID NOs:85, 86, 27, and 28)).

In certain embodiments, the C5ORF42-ERBB4 fusion comprises exon 40 or a fragment thereof from C5ORF42, and exon 11 or a fragment thereof from ERBB4 (e.g., as shown in FIGS. 80A-80D (SEQ ID NOs:83 and 84)). In one embodiment, the C5ORF42-ERBB4 fusion comprises at least 5, 10, 15, 20, 30, 40, 50 or more amino acids from exon 40 of C5ORF42 (e.g., from the amino acid sequence of C5ORF42 preceding the fusion junction with ERBB4, e.g., the C5ORF42 sequence shown in FIGS. 80A-80D (SEQ ID NO:84) or FIG. 82 (SEQ ID NO:86)), and at least 5, 10, 15, 20, 30, 40, 50 or more amino acids from exon 40 of ERBB4 (e.g., from the amino acid sequence of ERBB4 following the fusion junction with C5ORF42, e.g., the ERBB4 sequence shown in FIGS. 80A-80D (SEQ ID NO:84) or FIG. 28 (SEQ ID NO:28)). In another embodiment, the C5ORF42-ERBB4 fusion comprises at least 6, 12, 15, 20, 25, 50, 75, 100 or more nucleotides from exon 40 of C5ORF42 (e.g., from the nucleotide sequence of C5ORF42 preceding the fusion junction with ERBB4, e.g., the C5ORF42 sequence shown in FIGS. 80A-80D (SEQ ID NO:83) or FIGS. 81A-81B (SEQ ID NO:85)), and at least 6, 12, 15, 20, 25, 50, 75, 100 or more nucleotides from exon 40 of ERBB4 (e.g., from the nucleotide sequence of ERBB4 following the fusion junction with C5ORF42, e.g., the ERBB4 sequence shown in FIGS. 80A-80D (SEQ ID NO:83) or FIGS. 27A-27E (SEQ ID NO:27)).

C5ORF42-ERBB4 Nucleic Acid Molecules

In one aspect, the invention features a nucleic acid molecule (e.g., an isolated or purified) nucleic acid molecule that includes a fragment of a C5ORF42 gene and a fragment of an ERBB4 gene. In one embodiment, the nucleotide sequence encodes a C5ORF42-ERBB4 fusion polypeptide that includes an ERBB4 tyrosine kinase domain or a functional fragment thereof. In another embodiment, the nucleotide sequence encodes a fragment of the C5ORF42 polypeptide of SEQ ID NO:84 or 86, or a fragment thereof; or a sequence substantially identical thereto. In other embodiments, the nucleic acid molecule includes a fragment of the ERBB4 gene encoding the amino acid sequence of SEQ ID NO:84 or 28, or a fragment thereof; or a sequence substantially identical thereto. In yet other embodiments, the nucleic acid molecule includes a nucleotide sequence encoding the amino acid sequence shown in FIGS. 80A-80D (e.g., SEQ ID NO:84) or a fragment thereof, or a sequence substantially identical thereto.

In one embodiment, the nucleic acid molecule includes a fusion, e.g., an in-frame fusion, between an intron of C5ORF42 (e.g., intron 40, or a fragment thereof), and an intron of ERBB4 (e.g., intron 10, or a fragment thereof). The C5ORF42-ERBB4 fusion can comprise a fusion of the nucleotide sequence of: chromosome 5 at nucleotide 37,156,250 (plus or minus 10, 20, 30, 50, 60, 70, 80, 100 nucleotides) and chromosome 2 at nucleotide 212,568,950 (plus or minus 10, 20, 30, 50, 60, 70, 80, 100 nucleotides), or a fragment thereof. In one embodiment, the C5ORF42-ERBB4 fusion comprises a fusion of the nucleotide sequence of: chromosome 5 at nucleotide 37,156,250 plus or minus 10, 20, 30, 40, 50, 100, 150, 200, 250, 300, 350, 400, 450, 500, 1000, 2000, or 3000 nucleotides and chromosome 2 at nucleotide 212,568,950 plus or minus 10, 20, 30, 40, 50, 100, 150, 200, 250, 300, 350, 400, 450, 500, 1000, 2000, or 3000 nucleotides, or a fragment thereof.

In another embodiment, the C5ORF42-ERBB4 fusion comprises a nucleotide sequence shown in FIGS. 80A-80D (SEQ ID NO:83) or FIGS. 81A-81B (SEQ ID NO:85) and FIGS. 27A-27E (SEQ ID NO:27), or a fragment thereof. In one embodiment, the C5ORF42-ERBB4 fusion comprises a nucleotide sequence substantially identical to the nucleotide sequence shown in FIGS. 80A-80D (SEQ ID NO: 83) or FIGS. 81A-81B (SEQ ID NO:85) and FIGS. 27A-27E (SEQ ID NO:27), or a fragment thereof. In one embodiment, the C5ORF42-ERBB4 fusion comprises a nucleotide sequence at least 70%, at least 75%, at least 80%, at least 85%, at least 90%, at least 95%, at least 99%, at least 99.5 or greater, identical to the nucleotide sequence shown in FIGS. 80A-80D (SEQ ID NO: 83) or FIGS. 81A-81B (SEQ ID NO:85) and FIGS. 27A-27E (SEQ ID NO:27). In one embodiment, the C5ORF42-ERBB4 fusion comprises a nucleotide sequence containing at least 50, 100, 150, 200, 500, 1000, 1500, 2000, 2500, 3000, or more nucleotides of the nucleotide sequence shown in FIGS. 80A-80D (SEQ ID NO: 83) or FIGS. 81A-81B (SEQ ID NO:85) and FIGS. 27A-27E (SEQ ID NO:27). In one embodiment, the C5ORF42-ERBB4 fusion comprises a nucleotide sequence containing at least 50, 100, 150, 200, 500, 1000, 1500, 2000, 2500, 3000, or more contiguous nucleotides of the nucleotide sequence shown in FIGS. 80A-80D (SEQ ID NO: 83) or FIGS. 81A-81B (SEQ ID NO:85) and FIGS. 27A-27E (SEQ ID NO:27).

In another embodiment, the nucleic acid molecule includes a fusion, e.g., an in-frame fusion, of at least exon 40 of C5ORF42 or a fragment thereof (e.g., one or more of exons 1-40 of C5ORF42 or a fragment thereof), and at least exon 11 or a fragment thereof (e.g., one or more of exons 11-28 of ERBB4 or a fragment thereof). In one embodiment, the nucleic acid molecule includes the nucleotides sequence corresponding to exons 1-40, of a C5ORF42 gene, (SEQ ID NO:83 or 85) or a fragment thereof, or a sequence substantially identical thereto. In another embodiment, the nucleic acid molecule includes the nucleotide sequence corresponding to exons 11-28, of ERBB4 (SEQ ID NO:83 or 27) or a fragment thereof, or a sequence substantially identical thereto. In yet other embodiments, the nucleic acid molecule includes the nucleotide sequence shown in FIGS. 80A-80D (e.g., SEQ ID NO:83) or FIGS. 81A-81B (e.g., SEQ ID NO:85) and FIGS. 27A-27E (e.g., SEQ ID NO:27), or a fragment thereof, or a sequence substantially identical thereto.

In one embodiment, the nucleic acid molecule is complementary to at least a portion of a nucleotide sequence disclosed herein, e.g., is capable of hybridizing under a stringency condition described herein to SEQ ID NO:83 or SEQ ID NO:85 and/or SEQ ID NO:27, or a fragment thereof. In yet another embodiment, the nucleic acid molecule hybridizes to a nucleotide sequence that is complementary to at least a portion of a nucleotide sequence disclosed herein, e.g., is capable of hybridizing under a stringency condition to a nucleotide sequence complementary to SEQ ID NO:83 or SEQ ID NO:85 and/or SEQ ID NO:27, or a fragment thereof. The nucleotide sequence of a cDNA encoding an exemplary 5' C5ORF42-3' ERBB4 fusion is shown in SEQ ID NO:83 or a fragment of SEQ ID NO:85 and SEQ ID NO:27, and the predicted amino acid sequence is shown in SEQ ID NO:84 and a fragment of SEQ ID NO:86 and SEQ ID NO:28, respectively.

In an embodiment, the C5ORF42-ERBB4 nucleic acid molecule comprises sufficient C5ORF42 and sufficient ERBB4 sequence such that the encoded 5' C5ORF42-3' ERBB4 fusion has kinase activity, e.g., has elevated activity, e.g., ERBB4 kinase activity, as compared with wild type ERBB4, e.g., in a cell of a cancer referred to herein. In certain embodiments, the 5' C5ORF42-3' ERBB4 fusion comprises exons 1-40 from C5ORF42 and exons 11-28 from ERBB4. In certain embodiments, the C5ORF42-ERBB4 fusion comprises at least 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40 or more exons from C5ORF42 and at least 1, 2, 3, 4, 5, 6, 7, 8, 9, 10, 11, 12, 13, 14, 15, 16, 17, 18 or more exons from ERBB4. In certain embodiments, the C5ORF42-ERBB4 fusion comprises a fusion of exon 40 from C5ORF42 and exon 11 from ERBB4. In another embodiment, the C5ORF42-ERBB4 fusion comprises at least 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40 exons from C5ORF42; and at least, 2, 3, 4, 5, 6, 7, 8, 9, 10, 11, 12, 13, 14, 15, 16, 17, 18 exons from ERBB4 (e.g., the corresponding exons from SEQ ID NO:85 and SEQ ID NO:27).

In one embodiment, the nucleic acid molecule includes a nucleotide sequence that has an in-frame fusion of intron 40 of C5ORF42 (e.g., NM_023073) with intron 9 of ERBB4 (e.g., NM_005235). In another embodiment, the nucleic acid molecule includes a nucleotide sequence that includes a breakpoint. For example, the nucleic acid molecule includes a nucleotide sequence that includes the fusion junction between the C5ORF42 gene and the ERBB4 gene, e.g., the breakpoint between intron 40 of C5ORF42 and intron 10 of ERBB4. In other embodiments, the nucleic acid molecules includes a nucleotide sequence of one or more of nucleotide 37,156,250 of chromosome 5 coupled to (e.g., directly or indirectly juxtaposed to) one or more of nucleotide 156,844, 170 of chromosome 2. In one embodiment, the nucleic acid molecule includes the nucleotide sequence of: chromosome 5 at nucleotide 37,156,250 plus or minus 10, 20, 30, 40 50, 60, 80, 100, 150 nucleotides and chromosome 2 at nucleotide 212,568,950 plus or minus 10, 20, 30, 40 50, 60, 80, 100, 150 nucleotides (corresponding to the breakpoint of a C5ORF42-ERBB4 fusion), or a fragment thereof, or a sequence substantially identical thereto. In one embodiment, the nucleic acid molecule is complementary to at least a portion of a nucleotide sequence disclosed herein, e.g., is capable of hybridizing under a stringency condition described herein to SEQ ID NO:83 or 85, and 27, or a fragment thereof. In yet other embodiment, the nucleic acid molecule hybridizes to a nucleotide sequence that is complementary to at least a portion of a nucleotide sequence disclosed herein, e.g., is capable of hybridizing under a stringency condition described herein to a nucleotide sequence complementary to SEQ ID NO:83 or 85, and 27, or a fragment thereof.

In another embodiment, the C5ORF42-ERBB4 fusion nucleic acid comprises at least 6, 12, 15, 20, 25, 50, 75, 100 or more nucleotides from exon 40 of C5ORF42 (e.g., from the nucleotide sequence of C5ORF42 preceding the fusion junction with ERBB4, e.g., the C5ORF42 sequence shown in FIGS. 80A-80D (SEQ ID NO:83) or FIGS. 81A-81B (SEQ ID NO:85)), and at least 6, 12, 15, 20, 25, 50, 75, 100 or more nucleotides from exon 11 of ERBB4 (e.g., from the nucleotide sequence of ERBB4 following the fusion junction with C5ORF42, e.g., the ERBB4 sequence shown in FIGS. 80A-80D (SEQ ID NO:83) or FIGS. 27A-27E (SEQ ID NO:27)).

In other embodiments, the nucleic acid molecule includes a nucleotide sequence encoding a C5ORF42-ERBB4 fusion polypeptide that includes a fragment of a C5ORF42 gene and a fragment of an ERBB4 gene. In one embodiment, the nucleotide sequence encodes a C5ORF42-ERBB4 fusion polypeptide that includes e.g., an ERBB4 tyrosine kinase domain or a functional fragment thereof. In another embodiment, the nucleotide sequence encodes a fragment of the ERBB4 polypeptide of SEQ ID NO:84 or 28 or a fragment thereof, or a sequence substantially identical thereto. For example, the nucleic acid molecule can include a nucleotide sequence encoding an ERBB4 kinase domain of SEQ ID NO:84 or SEQ ID NO:28 or a fragment thereof. In yet other embodiments, the nucleic acid molecule includes a nucleotide sequence encoding the amino acid sequence shown in FIGS. 80A-80D (e.g., SEQ ID NO:84) or FIGS. 82 and 28 (e.g., SEQ ID NOs:86 and 28), or a fragment thereof, or a sequence substantially identical thereto. In one embodiment, the encoded C5ORF42-ERBB4 fusion polypeptide includes an ERBB4 tyrosine kinase domain or a functional fragment thereof.

In a related aspect, the invention features nucleic acid constructs that include the C5ORF42-ERBB4 nucleic acid molecules described herein. In certain embodiments, the nucleic acid molecules are operatively linked to a native or a heterologous regulatory sequence. Also included are vectors and host cells that include the C5ORF42-ERBB4 nucleic acid molecules described herein, e.g., vectors and host cells suitable for producing the nucleic acid molecules and polypeptides described herein.

In a related aspect, methods of producing the nucleic acid molecules and polypeptides described herein are also described.

In another aspect, the invention features nucleic acid molecules that reduce or inhibit the expression of a nucleic acid molecule that encodes a C5ORF42-ERBB4 fusion described herein. Examples of such nucleic acid molecules include, for example, antisense molecules, ribozymes, RNAi, triple helix molecules that hybridize to a nucleic acid encoding C5ORF42-ERBB4, or a transcription regulatory region of C5ORF42-ERBB4, and blocks or reduces mRNA expression of C5ORF42-ERBB4.

Nucleic Acid Detection and Capturing Reagents

The invention also features a nucleic acid molecule, e.g., nucleic acid fragment, suitable as probe, primer, bait or library member that includes, flanks, hybridizes to, which are useful for identifying, or are otherwise based on, the C5ORF42-ERBB4 fusions described herein. In certain embodiments, the probe, primer or bait molecule is an oligonucleotide that allows capture, detection or isolation of a C5ORF42-ERBB4 fusion nucleic acid molecule described herein. The oligonucleotide can comprise a nucleotide sequence substantially complementary to a fragment of the C5ORF42-ERBB4 fusion nucleic acid molecules described herein. The sequence identity between the nucleic acid fragment, e.g., the oligonucleotide, and the target C5ORF42-ERBB4 sequence need not be exact, so long as the sequences are sufficiently complementary to allow the capture, detection or isolation of the target sequence. In one embodiment, the nucleic acid fragment is a probe or primer that includes an oligonucleotide between about 5 and 25, e.g., between 10 and 20, or 10 and 15 nucleotides in length. In other embodiments, the nucleic acid fragment is a bait that includes an oligonucleotide between about 100 to 300 nucleotides, 130 and 230 nucleotides, or 150 and 200 nucleotides, in length.

In one embodiment, the nucleic acid fragment can be used to identify or capture, e.g., by hybridization, a C5ORF42-ERBB4 fusion. For example, the nucleic acid fragment can be a probe, a primer, or a bait, for use in identifying or capturing, e.g., by hybridization, a C5ORF42-ERBB4 fusion described herein. In one embodiment, the nucleic acid fragment can be useful for identifying or capturing a C5ORF42-ERBB4 breakpoint, e.g., the nucleotide sequence of: chromosome 5 at nucleotide 37,156,250 plus or minus 10, 20, 30, 40 50, 60, 80, 100, 150 nucleotides and chromosome 2 at nucleotide 212,568,950 plus or minus 10, 20, 30, 40 50, 60, 80, 100, 150 nucleotides.

In one embodiment, the nucleic acid fragment hybridizes to a nucleotide sequence within a chromosomal rearrangement that creates an in-frame fusion of intron 40 of C5ORF42 with intron 10 of ERBB4. In one embodiment, the nucleic acid fragment hybridizes to a nucleotide sequence in the region In other embodiments, the nucleic acid molecules includes a nucleotide sequence in the region of nucleotides 37,156,250 of chromosome 5 coupled to (e.g., juxtaposed to) nucleotides in the region of nucleotides 156,844,170 of chromosome 2. In one embodiment, the nucleic acid fragment hybridizes to a nucleotide sequence that includes a breakpoint, e.g., the nucleotide sequence of: chromosome 5 at nucleotide 37,156,250 plus or minus 10, 20, 30, 40 50, 60, 80, 100, 150 or more nucleotides and chromosome 2 at nucleotide 212,568,950 plus or minus 10, 20, 30, 40 50, 60, 80, 100, 150 or more nucleotides. For example, the nucleic acid fragment can hybridize to a nucleotide sequence that includes the fusion junction between the C5ORF42 gene and the ERBB4 gene, e.g., a nucleotide sequence that includes a portion of a nucleotide sequence within intron 40 of a C5ORF42 gene and 8 of an ERBB4 gene.

In another embodiment, the nucleic acid fragment hybridizes to a nucleotide sequence that comprises at least 6, 12, 15, 20, 25, 50, 75, 100, 150 or more nucleotides from exon 40 of C5ORF42 (e.g., from the nucleotide sequence of C5ORF42 preceding the fusion junction with ERBB4, e.g., the C5ORF42 sequence shown in FIGS. 80A-80D (SEQ ID NO:83) or FIG. 68 (SEQ ID NO:85), and at least 6, 12, 15, 20, 25, 50, 75, 100, 150 or more nucleotides from exon 40 of ERBB4 (e.g., from the nucleotide sequence of ERBB4 following the fusion junction with C5ORF42, e.g., the ERBB4 sequence shown in FIGS. 80A-80D (SEQ ID NO:83) or FIG. 27 (SEQ ID NO:27)).

The probes or primers described herein can be used, for example, for FISH detection or PCR amplification. In one exemplary embodiment where detection is based on PCR, amplification of the C5ORF42-ERBB4 fusion junction fusion junction can be performed using a primer or a primer pair, e.g., for amplifying a sequence flanking the fusion junctions described herein, e.g., the mutations or the junction of a chromosomal rearrangement described herein, e.g., C5ORF42-ERBB4.

In one embodiment, a pair of isolated oligonucleotide primers can amplify a region containing or adjacent to a position in the ERBB4-05ORF42 fusion. For example, forward primers can be designed to hybridize to a nucleotide sequence within C5ORF42 genomic or mRNA sequence (e.g., a nucleotide sequence within exon 40 of C5ORF42 of SEQ ID NO:83 or 85), and the reverse primers can be designed to hybridize to a nucleotide sequence of ERBB4 (e.g., a nucleotide sequence within exon 11 of ERBB4, of SEQ ID NO:83 or 27).

In another embodiment, the nucleic acid fragments can be used to identify, e.g., by hybridization, a C5ORF42-ERBB4 fusion. In one embodiment, the nucleic acid fragment hybridizes to a nucleotide sequence that includes a fusion junction between the C5ORF42 transcript and the ERBB4 transcript.

In other embodiments, the nucleic acid fragment includes a bait that comprises a nucleotide sequence that hybridizes to a C5ORF42-ERBB4 fusion nucleic acid molecule described herein, and thereby allows the capture or isolation said nucleic acid molecule. In one embodiment, a bait is suitable for solution phase hybridization. In other embodiments, a bait includes a binding entity, e.g., an affinity tag, that allows capture and separation, e.g., by binding to a binding entity, of a hybrid formed by a bait and a nucleic acid hybridized to the bait.

In other embodiments, the nucleic acid fragment includes a library member comprising a C5ORF42-ERBB4 nucleic acid molecule described herein. In one embodiment, the library member includes a rearrangement that results in a C5ORF42-ERBB4 fusion described herein.

The nucleic acid fragment can be detectably labeled with, e.g., a radiolabel, a fluorescent label, a bioluminescent label, a chemiluminescent label, an enzyme label, a binding pair label, or can include an affinity tag; a tag, or identifier (e.g., an adaptor, barcode or other sequence identifier).

C5ORF42-ERBB4 Fusion Polypeptides

In another embodiment, the C5ORF42-ERBB4 fusion comprises an amino acid sequence shown in FIGS. 80A-

80D (SEQ ID NO:84) or FIG. 82 (SEQ ID NO:86) and FIG. 28 (SEQ ID NO:28), or a fragment thereof. In one embodiment, the C5ORF42-ERBB4 fusion comprises an amino acid sequence substantially identical to the amino acid sequence shown in FIGS. 80A-80D (SEQ ID NO:84) or FIG. 82 (SEQ ID NO:86) and FIG. 28 (SEQ ID NO:28), or a fragment thereof. In one embodiment, the C5ORF42-ERBB4 fusion comprises an amino acid sequence at least 70%, at least 75%, at least 80%, at least 85%, at least 90%, at least 95%, at least 99%, at least 99.5 or greater, identical to the amino acid sequence shown in FIGS. 80A-80D (SEQ ID NO:84) or FIG. 82 (SEQ ID NO:86) and FIG. 28 (SEQ ID NO:28)). In one embodiment, the C5ORF42-ERBB4 fusion comprises a sequence containing at least 10, 20, 50, 100, 500, 600, 700, 800, 900, 1000, or more amino acids of the amino acid sequence shown in FIGS. 80A-80D (SEQ ID NO:84); or at least 5, 10, 20, 50, 100, 500, 600, 700, 800, 900, 1000, or more amino acids of the amino acid sequence shown in FIG. 82 (SEQ ID NO:86) and at least 5, 10, 20, 50, 100, 500, 600, 700, 800, 900, 1000, or more amino acids of the amino acid sequence shown in FIG. 28 (SEQ ID NO:28). In one embodiment, the C5ORF42-ERBB4 fusion comprises an amino acid sequence containing at least 10, 20, 50, 100, 500, 600, 700, 800, 900, 1000, or more contiguous amino acids of the amino acid sequence shown in FIGS. 80A-80D (SEQ ID NO:84); or at least 5, 10, 20, 50, 100, 500, 600, 700, 800, 900, 1000, or more contiguous amino acids of the amino acid sequence shown in FIG. 82 (SEQ ID NO:86) and at least 5, 10, 20, 50, 100, 500, 600, 700, 800, 900, 1000, or more contiguous amino acids of the amino acid sequence shown in FIG. 28 (SEQ ID NO:28). In one embodiment, the 5' C5ORF42-3' ERBB4 fusion polypeptide includes a C5ORF42 receptor tyrosine kinase domain or a functional fragment thereof. In an embodiment, the 5'C5ORF42-3'ERBB4 fusion polypeptide comprises sufficient ERBB4 and sufficient C5ORF42 sequence such that it has kinase activity, e.g., has elevated activity, e.g., ERBB4 kinase activity, as compared with wild type ERBB4, e.g., in a cell of a cancer referred to herein.

In another aspect, the invention features a C5ORF42-ERBB4 fusion polypeptide (e.g., a purified C5ORF42-ERBB4 fusion polypeptide), a biologically active or antigenic fragment thereof, as well as reagents (e.g., antibody molecules that bind to a C5ORF42-ERBB4 fusion polypeptide), methods for modulating a C5ORF42-ERBB4 polypeptide activity and detection of a C5ORF42-ERBB4 polypeptide.

In one embodiment, the C5ORF42-ERBB4 fusion polypeptide has at least one biological activity, e.g., an ERBB4 kinase activity. In one embodiment, at least one biological activity of the C5ORF42-ERBB4 fusion polypeptide is reduced or inhibited by an anti-cancer drug, e.g., a kinase inhibitor (e.g., a multikinase inhibitor or an ERBB4-specific inhibitor). In one embodiment, at least one biological activity of the C5ORF42-ERBB4 fusion polypeptide is reduced or inhibited by an ERBB4 kinase inhibitor chosen from e.g., AST-1306; or dacamitinib (PF299804).

In yet other embodiments, the C5ORF42-ERBB4 fusion polypeptide is encoded by a nucleic acid molecule described herein. In one embodiment, the C5ORF42-ERBB4 fusion polypeptide is encoded by an in-frame fusion of intron 40 of C5ORF42 with intron 10 of ERBB4 (e.g., a sequence on chromosome 5, a sequence on chromosome 2). In another embodiment, the C5ORF42-ERBB4 fusion polypeptide includes an amino acid sequence encoded by a nucleotide sequence comprising a fusion junction between the C5ORF42 transcript and the ERBB4 transcript.

In certain embodiments, the C5ORF42-ERBB4 fusion polypeptide comprises one or more of encoded exons 1-40 from C5ORF42 and one or more of encoded exons 11-28 from ERBB4. In certain embodiments, the C5ORF42-ERBB4 fusion polypeptide comprises at least 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40 or more encoded exons from C5ORF42 and at least 1, 2, 3, 4, 5, 6, 7, 8, 9, 10, 11, 12, 13, 14, 15, 16, 17, 18 or more, encoded exons from ERBB4. In certain embodiments, the C5ORF42-ERBB4 fusion polypeptide comprises a fusion of encoded exon 40 from C5ORF42 and encoded exon 11 from ERBB4 (or a fragment thereof). In certain embodiments, the 5' C5ORF42-3' ERBB4 fusion polypeptide comprises a fusion junction of the sequence of exon 40 from C5ORF42 and the sequence of exon 11 from ERBB4 (e.g., as shown in SEQ ID NOs:68, 70 and 28).

In certain embodiments, the C5ORF42-ERBB4 fusion comprises the amino acid sequence corresponding to exon 40 or a fragment thereof from C5ORF42, and the amino acid sequence corresponding to exon 11 or a fragment thereof from ERBB4 (e.g., as shown in FIGS. 80A-80D (SEQ ID NO:84) or FIGS. 82 and 28 (SEQ ID NO:86 and 28, respectively)). In one embodiment, the C5ORF42-ERBB4 fusion comprises at least 5, 10, 15, 20 or more amino acids from exon 40 of C5ORF42 (e.g., from the amino acid sequence of C5ORF42 preceding the fusion junction with ERBB4, e.g., the C5ORF42 sequence shown in FIGS. 80A-80D (SEQ ID NO:84) or FIG. 82 (SEQ ID NO:86), and at least 5, 10, 15, 20 or more amino acids from exon 40 of ERBB4 (e.g., from the amino acid sequence of ERBB4 following the fusion junction with C5ORF42, e.g., the ERBB4 sequence shown in FIGS. 80A-80D (SEQ ID NO:84) or FIG. 28 (SEQ ID NO:28)).

In one embodiment, the C5ORF42-ERBB4 fusion polypeptide includes an ERBB4 tyrosine kinase domain or a functional fragment thereof. In a related aspect, the invention features C5ORF42-ERBB4 fusion polypeptide or fragments operatively linked to heterologous polypeptides to form fusion proteins.

In another embodiment, the C5ORF42-ERBB4 fusion polypeptide or fragment is a peptide, e.g., an immunogenic peptide or protein, that contains a fusion junction described herein. Such immunogenic peptides or proteins can be used to raise antibodies specific to the fusion protein. In other embodiments, such immunogenic peptides or proteins can be used for vaccine preparation. The vaccine preparation can include other components, e.g., an adjuvant.

In another aspect, the invention features antibody molecules that bind to a C5ORF42-ERBB4 fusion polypeptide or fragment described herein. In embodiments the antibody can distinguish wild type ERBB4 (or C5ORF42) from C5ORF42-ERBB4.

Detection Reagents and Detection of Mutations

In another aspect, the invention features a detection reagent, e.g., a purified or an isolated preparation thereof. Detection reagents can distinguish a nucleic acid, or protein sequence, having a breakpoint, e.g., a C5ORF42-ERBB4 breakpoint; from a reference sequence. In one embodiment, the detection reagent detects (e.g., specifically detects) a C5ORF42-ERBB4 fusion nucleic acid or a polypeptide (e.g., distinguishes a wild type ERBB4 or another ERBB4 fusion (or C5ORF42) from a C5ORF42-ERBB4 nucleic acid (e.g., as described herein in FIGS. 80A-80D (SEQ ID NO:83) or FIGS. 81A-81B (SEQ ID NO:85) and FIGS. 27A-27E (SEQ ID NO:27); or a C5ORF42-ERBB4 polypeptide (e.g., as described herein in FIGS. 80A-80D (SEQ ID NO:84) or FIGS. 82 and 28 (SEQ ID NO:86 and 28, respectively).

Detection reagents, e.g., nucleic acid-based detection reagents, can be used to identify mutations in a target nucleic acid, e.g., DNA, e.g., genomic DNA or cDNA, or RNA, e.g., in a sample, e.g., a sample of nucleic acid derived from a neoplastic or tumor cell, e.g., a melanocytic neoplasm, melanoma or metastatic cell. Detection reagents, e.g., antibody-based detection reagents, can be used to identify mutations in a target protein, e.g., in a sample, e.g., a sample of protein derived from, or produced by, a neoplastic or tumor cell, e.g., a melanocytic neoplasm, melanoma or metastatic cell.

Method of Treatment

In a related aspect, a method of inhibiting, reducing, or treating a hyperproliferative disorder, e.g., a neoplasm (including benign, pre-malignant or malignant (e.g., a cancer), in a subject is provided. The method includes administering to the subject a preselected therapeutic agent, e.g., an anti-cancer agent (e.g., a kinase inhibitor), as a single agent, or in combination, in an amount sufficient to reduce, inhibit or treat the activity or expression of C5ORF42-ERBB4 (e.g., a C5ORF42-ERBB4 fusion described herein), thereby inhibiting, reducing, or treating the hyperproliferative disorder in the subject.

In one embodiment, the subject treated has a C5ORF42-ERBB4 fusion; e.g., the subject has a tumor or cancer harboring a C5ORF42-ERBB4 fusion. In other embodiments, the subject has been previously identified as having a C5ORF42-ERBB4 fusion. In yet other embodiments, the subject has been previously identified as being likely or unlikely to respond to treatment with a protein kinase inhibitor, e.g., a subject that has previously participated in a clinical trial. In other embodiments, the subject has been previously identified as being likely or unlikely to respond to treatment with a protein kinase inhibitor, based on the presence of the C5ORF42-ERBB4 fusion. In one embodiment, the subject is a mammal, e.g., a human. In one embodiment, the subject has, or at risk of having a cancer at any stage of disease. In other embodiments, the subject is a patient, e.g., a cancer patient.

In certain embodiments, the neoplasm or neoplastic cell is a benign, pre-malignant, malignant (cancer) or metastasis. In certain embodiments, the cancer is a solid tumor, a soft tissue tumor, or a metastatic lesion. In one embodiment, the cancer is a breast cancer. In one embodiment, the cancer is triple negative breast cancer. In one embodiment, the cancer is chosen from a lung cancer, a pancreatic cancer, melanoma, a colorectal cancer, an esophageal-gastric cancer, a thyroid cancer, or an adenocarcinoma.

In one embodiment, the anti-cancer agent is a kinase inhibitor. For example, the kinase inhibitor is a multi-kinase inhibitor or an ERBB4-specific inhibitor. In one embodiment, the kinase inhibitor is an ERBB4 inhibitor including, but not limited to, AST-1306; or dacamitinib (PF299804). In some embodiments the ERBB4 inhibitor is a ERBB4 inhibitor described herein.

Nucleic Acid Molecules

In one aspect, the invention features, an isolated nucleic acid molecule, or an isolated preparation of nucleic acid molecules, that includes a genetic alteration or mutation, e.g., a rearrangement, disclosed herein, e.g., in this section entitled Nucleic Acid Molecules, or in FIG. 1A, 1B, 1C, 1D, 1E, 1F, 1G, or 1H. Such nucleic acid molecules or preparations thereof can be used to detect, e.g., sequence, a genetic alteration or mutation disclosed herein and to characterize a sample in which they are contained. The isolated nucleic acid can be a genomic or a transcribed sequence, e.g., cDNA sequence.

In another aspect, the invention features, a nucleic acid molecule (e.g., an isolated or purified) nucleic acid molecule that includes a fragment of a first gene, and a fragment of a second gene, typically a gene that encodes a kinase. In embodiments, the first gene is a gene from FIG. 1A, 1B, 1C, 1D, 1E, 1F, 1G, or 1H and the second gene is a gene, e.g., a kinase from FIG. 1A, 1B, 1C, 1D, 1E, 1F, 1G, or 1H. In an embodiment the fusion protein has the fusion partners of a fusion protein described in FIG. 1A, 1B, 1C, 1D, 1E, 1F, 1G, or 1H.

The isolated nucleic acid molecule can comprise the entire sequence of the first fragment and the entire sequence of the second fragment, e.g., as shown in FIG. 1A, 1B, 1C, 1D, 1E, 1F, 1G, or 1H.

In embodiments the isolated nucleic acid is a genomic nucleic acid molecule comprises sequence encoding the entire sequence, e.g., from the control region or beginning of the open reading frame, through the breakpoint, which may be in an intron or an exon, of the first gene, fused to the a sequence for the second gene which begins at its breakpoint and extends to the end of the gene, e.g., through the end of the open reading frame of that gene. In other embodiments the isolated nucleic acid will include the fusion junction but only a portion of the fragment of the first or second gene present in the rearrangement.

In embodiments the isolated nucleic acid is a transcribed nucleic acid, e.g., a cDNA or mRNA, and comprises sequence encoding the entire sequence, e.g., from the beginning of the mRNA through the breakpoint of the first gene fused to the a sequence for the second gene which begins at its breakpoint and extends to the end of the mRNA of the second gene. In other embodiments the isolated nucleic acid will include the fusion junction but only a portion of the fragment of the first or second gene present in the rearrangement. In embodiments a transcribed nucleic acid will have one or more exon from the first gene fused, in frame, to one or more exons of the second gene. In embodiments a transcribed nucleic acid will have comprise the fusion of the C terminus of C terminal exon of the first gene fragment with the N terminus of the N terminal exon of the second gene.

In embodiments the fusion puts the kinase activity of the second gene under the control of the first gene.

In embodiments the isolated nucleic acid, e.g., a genomic or transcribed nucleic acid, e.g., a cDNA or RNA, comprises the fusion junction, e.g., a fusion junction from FIG. 1A, 1B, or 1C, and is at least 10, 20, 30, 40, 50, 60, 70, 80, 100, 125, 150, 200, 250, 300, 350, or 400 nucleotides in length, but optionally less than 1,000, 1,500, or 2,000 nucleotides in length. In embodiments, the isolated nucleic acid, e.g., a genomic or transcribed nucleic acid, e.g., a cDNA or RNA, comprises the fusion junction, e.g., a fusion junction from FIG. 1A, 1B, or 1C, and is between 10 and 2,000, 10 and 1,500, 10 and 1,000, 10 and 500, 10 and 400, 10 and 300, 10 and 200, 10 and 100, 20 and 2,000, 20 and 1,500, 20 and 1,000, 20 and 500, 20 and 400, 20 and 300, 20 and 200, 20 and 100, 30 and 2,000, 30 and 1,500, 30 and 1,000, 30 and 500, 30 and 400, 30 and 300, 30 and 200, 30 and 100 nucleotides in length.

In one embodiment, the isolated nucleic acid, e.g., a transcribed nucleic acid, e.g., a cDNA or RNA, comprises a fusion, e.g., an in-frame fusion, from FIG. 1C or a fusion transcribed from a genomic fusion from FIG. 1A or FIG. 1B.

In an embodiment, the isolated nucleic acid, e.g., a transcribed nucleic acid, e.g., a cDNA or RNA, comprises a fusion, e.g., an in-frame fusion, of the 3' terminus of an exon of a fragment of the first gene of FIG. 1C to the 5' terminus of an exon of a fragment of the second gene of FIG. 1C. In an embodiment the fusion is between the exons listed in FIG. 1C. In embodiments, fusion is not be between the specific exons found in FIG. 1C but is between other exons of the first gene to other exons of the second gene of a fusion from FIG. 1C.

In an embodiment, the isolated nucleic acid, e.g., a transcribed nucleic acid, e.g., a cDNA or RNA, comprises a fusion, e.g., an in-frame fusion, of the C terminal exon of a fragment of first gene of FIG. 1C to the N terminus of an exon a fragment of the second gene other than the second gene exon shown in FIG. 1C. By way of example, an exon, e.g., exon 9 of TRIM24 is fused to an exon, of BRAF other than the exon listed in FIG. X1, e.g., it is fused to an exon other than exon 9.

In an embodiment, the isolated nucleic acid, e.g., a transcribed nucleic acid, e.g., a cDNA or RNA, comprises a fusion, e.g., an in-frame fusion, of the N terminal exon of a fragment of the second gene of FIG. X1 to the C terminus of an exon of a fragment of the first gene other than the first-gene exon shown in FIG. X1. By way of example, exon 9 of BRAF is fused to an exon of TRIM24 other than the exon listed in FIG. 1C (exon 9).

In an embodiment of the isolated nucleic acid, e.g., a genomic or transcribed nucleic acid, e.g., a cDNA or RNA, the second gene is a kinase and sufficient exonic sequence is present to confer kinase activity. In an embodiment of the isolated nucleic acid, e.g., a genomic or transcribed nucleic acid, e.g., a cDNA or mRNA, sufficient sequence of the first gene is present to allow expression of kinase activity of the fusion partner.

USP2-CBL Fusions

In one embodiment, a fusion includes an in-frame fusion of an exon of ubiquitin specific peptidase 2 (USP2), e.g., one more exons of USP2 (e.g., one or more of exons 1-2 of USP2) or a fragment thereof, and an exon of Cb1 proto-oncogene, E3 ubiquitin protein ligase (CBL), e.g., one or more exons of a CBL (e.g., one or more of exons 8-16 of CBL) or a fragment thereof. For example, the USP2-CBL fusion can include an in-frame fusion within an intron of USP2 (e.g., intron 2) or a fragment thereof, with an intron of CBL (e.g., intron 7) or a fragment thereof. In one embodiment, the fusion of the USP2-CBL fusion comprises the nucleotide sequence of: chromosome 11 at one or more of nucleotide 119,242,468 (plus or minus 10, 20, 30, 50, 60, 70, 80, 100 or more nucleotides) and chromosome 11 at one or more of nucleotide 119,148,790 (plus or minus 10, 20, 30, 50, 60, 70, 80, 100 or more nucleotides). In one embodiment, the USP2-CBL fusion is an inversion, e.g., an inversion of a portion of chromosome 11.

In certain embodiments, the USP2-CBL fusion is in a 5'-USP2 to 3'-CBL configuration (also referred to herein as "5'-USP2-CBL-3')." The term "fusion" or "fusion molecule" can refer to a polypeptide or a nucleic acid fusion, depending on the context. It may include a full-length sequence of a fusion or a fragment thereof, e.g., a fusion junction (e.g., a fragment including a portion of USP2 and a portion of CBL, e.g., a portion of the USP2-CBL fusion described herein). In one embodiment, the USP2-CBL fusion polypeptide includes a fragment of the amino acid sequence shown in FIG. 85 (SEQ ID NO:90) and a fragment of the amino acid sequence shown in FIG. 87 (SEQ ID NO:92), or an amino acid sequence substantially identical thereto. In another embodiment, the USP2-CBL fusion nucleic acid includes a fragment of the nucleotide sequence shown in FIG. 84 (SEQ ID NO:89) and a fragment of the nucleotide sequence shown in FIG. 86 (SEQ ID NO:91), or a nucleotide sequence substantially identical thereto. In one embodiment, the USP2-CBL fusion polypeptide comprises sufficient USP2 and sufficient CBL sequence such that the 5' USP2-3' CBL fusion has kinase activity, e.g., has elevated activity, e.g., tyrosine kinase activity, as compared with wild type, e.g., in a cell of a cancer referred to herein (e.g., carcinoma, e.g., spleen carcinoma). In certain embodiments, USP2 has protease activity. In certain embodiments, USP2 has peptidase activity.

In certain embodiments, the USP2-CBL fusion comprises one or more (or all of) exons 1-2 from USP2 and one or more (or all of) exons 8-16 of CBL (e.g., one or more of the exons shown in FIG. 84 (SEQ ID NO:89) and FIG. 86 (SEQ ID NO:91). In another embodiment, the USP2-CBL fusion comprises one or more (or all of) exons 1-2 of USP2 and one or more (or all of) exons 8-16 of CBL. In certain embodiments, the USP2-CBL fusion comprises at least 1, 2 or more exons (or encoded exons) from USP2 and at least 1, 2, 3, 4, 5, 6, 7, 8, 9 or more exons (or encoded exons) from CBL (e.g., from the USP2 and CBL sequences shown in FIG. 84 and FIG. 85 (SEQ ID NO:89 and 90) and FIG. 86 and FIG. 87 (SEQ ID NOs:91 and 92).

In certain embodiments, the USP2-CBL fusion comprises exon 1-2 or a fragment thereof from USP2, and exons 8-16 or a fragment thereof from CBL (e.g., as shown in FIG. 84 (SEQ ID NO:89) and FIG. 86 (SEQ ID NO:91)). In one embodiment, the USP2-CBL fusion comprises at least 5, 10, 15, 20, 30, 40, 50 or more amino acids from exon 1-2 of USP2 (e.g., from the amino acid sequence of USP2 as shown in FIG. 85 (SEQ ID NO:90) (e.g., from the amino acid sequence of USP2 preceding the fusion junction with CBL, and at least 5, 10, 15, 20, 30, 40, 50 or more amino acids from exons 8-16 of CBL (e.g., from the amino acid sequence of CBL as shown in FIG. 87 (SEQ ID NO:92)). In another embodiment, the USP2-CBL fusion comprises at least 6, 12, 15, 20, 25, 50, 75, 100 or more nucleotides from exons 1-2 of USP2 (e.g., from the nucleotide sequence of USP2 as shown in FIG. 84 (SEQ ID NO:89) (e.g., from the nucleotide sequence of USP2 preceding the fusion junction with CBL); and at least 6, 12, 15, 20, 25, 50, 75, 100 or more nucleotides from exons 8-16 of CBL (e.g., from the nucleotide sequence of CBL as shown in FIG. 86 (SEQ ID NO:91)).

USP2-CBL Nucleic Acid Molecules

In one aspect, the invention features a nucleic acid molecule (e.g., an isolated or purified) nucleic acid molecule that includes a fragment of a USP2 gene and a fragment of a CBL gene. In one embodiment, the nucleotide sequence encodes a USP2-CBL fusion polypeptide that includes a tyrosine kinase domain or a functional fragment thereof. In another embodiment, the nucleotide sequence encodes a fragment of the CBL polypeptide including the amino acid sequence of SEQ ID NO:92 or a fragment thereof, or a sequence substantially identical thereto. In other embodiments, the nucleic acid molecule includes a fragment of the USP2 gene encoding the amino acid sequence of SEQ ID NO:90 or a fragment thereof, or a sequence substantially identical thereto. In yet other embodiments, the nucleic acid molecule includes a nucleotide sequence encoding the amino acid sequence shown in FIG. 85 (SEQ ID NO:90), or a fragment thereof, and the amino acid sequence shown in FIG. 87 (SEQ ID NO:92) or a fragment thereof, or a sequence substantially identical thereto.

In one embodiment, the nucleic acid molecule includes a fusion, e.g., an in-frame fusion, between an intron of USP2 (e.g., intron 2, or a fragment thereof), and an intron of CBL (e.g., intron 7, or a fragment thereof). The USP2-CBL fusion can comprise a fusion of the nucleotide sequence of: chromosome 11 at one or more of nucleotide 119,242,468 (plus or minus 10, 20, 30, 50, 60, 70, 80, 100 nucleotides) and chromosome 11 at one or more of nucleotide 119,148,790 (plus or minus 10, 20, 30, 50, 60, 70, 80, 100 nucleotides), or a fragment thereof. In one embodiment, the USP2-CBL fusion comprises a fusion of the nucleotide sequence of: chromosome 11 at one or more of nucleotide 119,242,468 (plus or minus 10, 20, 30, 50, 60, 70, 80, 100 nucleotides) and chromosome 11 at one or more of nucleotide 119,148,790 (plus or minus 10, 20, 30, 50, 60, 70, 80, 100 nucleotides), or a fragment thereof.

In another embodiment, the USP2-CBL fusion comprises a nucleotide sequence (e.g., a fragment of a nucleotide sequence) shown in FIG. 84 (SEQ ID NO:89) and a nucleotide sequence (e.g., a fragment of a nucleotide sequence) shown in FIG. 86 (SEQ ID NO:91), or a fragment of the fusion. In one embodiment, the USP2-CBL fusion comprises a nucleotide sequence substantially identical to the nucleotide sequence (e.g., a fragment of a nucleotide sequence) shown in FIG. 84 (SEQ ID NO:89) and the nucleotide sequence (e.g., a fragment of a nucleotide sequence) shown FIGS. 45A-45C (SEQ ID NO:91), or a fragment of the fusion. In one embodiment, the USP2-CBL fusion comprises a nucleotide sequence at least 70%, at least 75%, at least 80%, at least 85%, at least 90%, at least 95%, at least 99%, at least 99.5 or greater, identical to the nucleotide sequence (e.g., a fragment of a nucleotide sequence) shown in FIG. 84 (SEQ ID NO:89) and to the nucleotide sequence (e.g., a fragment of a nucleotide sequence) shown in FIG. 86 (SEQ ID NO:91). In one embodiment, the USP2-CBL fusion comprises a nucleotide sequence containing at least 25, 50, 100, 150, 200, 500, 1000, 1500, 2000, 2500, 3000, or more nucleotides of the nucleotide sequence shown in FIG. 84 (SEQ ID NO:89) and a nucleotide sequence containing at least 25, 50, 100, 150, 200, 500, 1000, 1500, 2000, 2500, 3000, or more nucleotides of the nucleotide sequence shown in FIG. 86 (SEQ ID NO:91). In one embodiment, the USP2-CBL fusion comprises a nucleotide sequence containing at least 25, 50, 100, 150, 200, 500, 1000, 1500, 2000, 2500, 3000, or more contiguous nucleotides of the nucleotide sequence shown in FIG. 84 (SEQ ID NO:89) and a nucleotide sequence containing at least 25, 50, 100, 150, 200, 500, 1000, 1500, 2000, 2500, 3000, or more nucleotides of the nucleotide sequence shown in FIG. 86 (SEQ ID NO:91).

In another embodiment, the nucleic acid molecule includes a fusion, e.g., an in-frame fusion, of at least 1, 2 or more exons of USP2 or a fragment thereof (e.g., one or more of exons 1-2 of USP2 or a fragment thereof), and at least 1, 2, 3, 4, 5, 6, 7, 8, 9 or more exons or a fragment thereof (e.g., one or more of exons 8-16 of CBL or a fragment thereof). In yet other embodiments, the nucleic acid molecule includes a fragment the nucleotide sequence shown in FIG. 84 (SEQ ID NO:89) and a fragment of the nucleotide sequence shown in FIG. 86 (SEQ ID NO:91) or a fragment of the fusion, or a sequence substantially identical thereto.

In one embodiment, the nucleic acid molecule is complementary to at least a portion of a nucleotide sequence disclosed herein, e.g., is capable of hybridizing under a stringency condition described herein to SEQ ID NO:89 and/or SEQ ID NO:91, or a fragment thereof. In yet another embodiment, the nucleic acid molecule hybridizes to a nucleotide sequence that is complementary to at least a portion of a nucleotide sequence disclosed herein, e.g., is capable of hybridizing under a stringency condition to a nucleotide sequence complementary to SEQ ID NO:89 and/or SEQ ID NO:91, or a fragment thereof. The nucleotide sequence of a cDNA encoding an exemplary 5' USP2-3' CBL fusion is shown in at least exon 2 (e.g., exons 1-2) of SEQ ID NO:89 and at least exon 2 (e.g., exons 2-40) of SEQ ID NO:91, and the predicted amino acid sequence is shown in the corresponding encoded exons of SEQ ID NO:90 and the corresponding encoded exons of SEQ ID NO:92, respectively.

In an embodiment the USP2-CBL nucleic acid molecule comprises sufficient USP2 and sufficient CBL sequence such that the encoded 5' USP2-3' CBL fusion has kinase activity, e.g., has elevated activity. In certain embodiments, the 5' USP2-3' CBL fusion comprises exons 1-2 from USP2 and exons 8-16 from CBL. In certain embodiments, the USP2-CBL fusion comprises at least 1, 2 or more exons from USP2 and at least 1, 2, 3, 4, 5, 6, 7, 8, 9 or more, exons from CBL. In certain embodiments, the USP2-CBL fusion comprises a fusion of exon 2 from USP2 and exon 2 from CBL. In another embodiment, the USP2-CBL fusion comprises at least 1, 2 exons from USP2; and at least 1, 2, 3, 4, 5, 6, 7, 8, 9 exons from CBL.

In one embodiment, the nucleic acid molecule includes a nucleotide sequence that has an in-frame fusion of intron 2 of USP2 (e.g., NM_004205) with intron 7 of CBL (e.g., NM_005188). In another embodiment, the nucleic acid molecule includes a nucleotide sequence that includes a breakpoint. For example, the nucleic acid molecule includes a nucleotide sequence that includes the fusion junction between the USP2 gene and the CBL gene, e.g., the breakpoint between intron 2 of USP2 and intron 7 of CBL. In other embodiments, the nucleic acid molecules includes a nucleotide sequence of one or more of nucleotide 119,242,468 of chromosome 11 coupled to (e.g., directly or indirectly juxtaposed to) one or more of nucleotide 119,148,790 of chromosome 11. In one embodiment, the nucleic acid molecule includes the nucleotide sequence of: chromosome 11 at one or more of nucleotide 119,242,468 plus or minus 10, 20, 30, 40 50, 60, 80, 100, 150 nucleotides and chromosome 11 at one or more of nucleotide 119,148,790 plus or minus 10, 20, 30, 40 50, 60, 80, 100, 150 nucleotides (corresponding to the breakpoint of a USP2-CBL fusion), or a fragment thereof, or a sequence substantially identical thereto. In one embodiment, the nucleic acid molecule is complementary to at least a portion of a nucleotide sequence disclosed herein, e.g., is capable of hybridizing under a stringency condition described herein to SEQ ID NO:89 and/or SEQ ID NO:91 or a fragment thereof. In yet other embodiment, the nucleic acid molecule hybridizes to a nucleotide sequence that is complementary to at least a portion of a nucleotide sequence disclosed herein, e.g., is capable of hybridizing under a stringency condition described herein to a nucleotide sequence complementary to SEQ ID NO:89 or 45 or a fragment thereof.

In another embodiment, the USP2-CBL fusion nucleic acid comprises at least 6, 12, 15, 20, 25, 50, 75, 100 or more nucleotides from exon 2 of USP2 (e.g., from the nucleotide sequence of USP2 preceding the fusion junction with CBL, e.g., of the USP2 sequence shown in FIG. 84 (SEQ ID NO:89)), and at least 6, 12, 15, 20, 25, 50, 75, 100 or more nucleotides from exon 2 of CBL (e.g., from the nucleotide sequence of CBL following the fusion junction with USP2, e.g., of the CBL sequence shown in FIG. 86 (SEQ ID NO:91)).

In other embodiments, the nucleic acid molecule includes a nucleotide sequence encoding a USP2-CBL fusion polypeptide that includes a fragment of a USP2 gene and a fragment of a CBL gene. In one embodiment, the nucleotide sequence encodes a USP2-CBL fusion polypeptide that includes e.g., a tyrosine kinase domain or a functional fragment thereof. In yet other embodiments, the nucleic acid molecule includes a nucleotide sequence encoding the amino acid sequence (e.g., a fragment of the amino acid sequence) shown in FIG. 85 (e.g., SEQ ID NO:90) and a nucleotide sequence encoding the amino acid sequence (e.g., a fragment of the amino acid sequence) shown in FIG. 87 (e.g., SEQ ID NO:92), or a fragment of the fusion, or a sequence substantially identical thereto. In one embodiment, the encoded USP2-CBL fusion polypeptide includes a tyrosine kinase domain or a functional fragment thereof.

In a related aspect, the invention features nucleic acid constructs that include the USP2-CBL nucleic acid molecules described herein. In certain embodiments, the nucleic acid molecules are operatively linked to a native or a heterologous regulatory sequence. Also included are vectors and host cells that include the USP2-CBL nucleic acid molecules described herein, e.g., vectors and host cells suitable for producing the nucleic acid molecules and polypeptides described herein.

In a related aspect, methods of producing the nucleic acid molecules and polypeptides described herein are also described.

In another aspect, the invention features nucleic acid molecules that reduce or inhibit the expression of a nucleic acid molecule that encodes a USP2-CBL fusion described herein. Examples of such nucleic acid molecules include, for example, antisense molecules, ribozymes, RNAi, triple helix molecules that hybridize to a nucleic acid encoding USP2-CBL, or a transcription regulatory region of USP2-CBL, and blocks or reduces mRNA expression of USP2-CBL.

Nucleic Acid Detection and Capturing Reagents

The invention also features a nucleic acid molecule, e.g., nucleic acid fragment, suitable as probe, primer, bait or library member that includes, flanks, hybridizes to, which are useful for identifying, or are otherwise based on, the USP2-CBL fusions described herein. In certain embodiments, the probe, primer or bait molecule is an oligonucleotide that allows capture, detection or isolation of a USP2-CBL fusion nucleic acid molecule described herein. The oligonucleotide can comprise a nucleotide sequence substantially complementary to a fragment of the USP2-CBL fusion nucleic acid molecules described herein. The sequence identity between the nucleic acid fragment, e.g., the oligonucleotide, and the target USP2-CBLsequence need not be exact, so long as the sequences are sufficiently complementary to allow the capture, detection or isolation of the target sequence. In one embodiment, the nucleic acid fragment is a probe or primer that includes an oligonucleotide between about 5 and 25, e.g., between 10 and 20, or 10 and 15 nucleotides in length. In other embodiments, the nucleic acid fragment is a bait that includes an oligonucleotide between about 100 to 300 nucleotides, 130 and 230 nucleotides, or 150 and 200 nucleotides, in length.

In one embodiment, the nucleic acid fragment can be used to identify or capture, e.g., by hybridization, a USP2-CBL fusion. For example, the nucleic acid fragment can be a probe, a primer, or a bait, for use in identifying or capturing, e.g., by hybridization, a USP2-CBL fusion described herein. In one embodiment, the nucleic acid fragment can be useful for identifying or capturing a USP2-CBL breakpoint, e.g., the nucleotide sequence of: chromosome 11 at nucleotide 119,242,468 plus or minus 10, 20, 30, 40, 50, 60, 80, 100, 150 nucleotides and chromosome 11 at nucleotide 119,148, 790 plus or minus 10, 20, 30, 40 50, 60, 80, 100, 150 nucleotides.

In one embodiment, the nucleic acid fragment hybridizes to a nucleotide sequence within a chromosomal rearrangement that creates an in-frame fusion of intron 2 of USP2 with intron 7 of CBL. In one embodiment, the nucleic acid fragment hybridizes to a nucleotide sequence in the region In other embodiments, the nucleic acid molecules includes a nucleotide sequence in the region of nucleotides 119,242, 468 of chromosome 11 coupled to (e.g., juxtaposed to) nucleotides in the region of nucleotides 119,148,790 of chromosome 11. In one embodiment, the nucleic acid fragment hybridizes to a nucleotide sequence that includes a breakpoint, e.g., the nucleotide sequence of: chromosome 11 at nucleotide 119,242,468 plus or minus 10, 20, 30, 40 50, 60, 80, 100, 150 or more nucleotides and chromosome 11 at nucleotide 119,148,790 plus or minus 10, 20, 30, 40 50, 60, 80, 100, 150 or more nucleotides. For example, the nucleic acid fragment can hybridize to a nucleotide sequence that includes the fusion junction between the USP2 gene and the CBL gene, e.g., a nucleotide sequence that includes a portion of a nucleotide sequence within intron 2 of a USP2 gene and intron 7 of a CBL gene.

In another embodiment, the nucleic acid fragment hybridizes to a nucleotide sequence that comprises at least 6, 12, 15, 20, 25, 50, 75, 100, 150 or more nucleotides from exon 2 of USP2 (e.g., from the nucleotide sequence of USP2 preceding the fusion junction with CBL, e.g., of the USP2 sequence shown in FIG. 84 (SEQ ID NO:89)), and at least 6, 12, 15, 20, 25, 50, 75, 100, 150 or more nucleotides from exon 2 of CBL (e.g., from the nucleotide sequence of CBL following the fusion junction with USP2, e.g., of the CBL sequence shown in FIG. 86 (SEQ ID NO:91)).

The probes or primers described herein can be used, for example, for FISH detection or PCR amplification. In one exemplary embodiment where detection is based on PCR, amplification of the USP2-CBL fusion junction fusion junction can be performed using a primer or a primer pair, e.g., for amplifying a sequence flanking the fusion junctions described herein, e.g., the mutations or the junction of a chromosomal rearrangement described herein, e.g., USP2-CBL.

In one embodiment, a pair of isolated oligonucleotide primers can amplify a region containing or adjacent to a position in the USP2-CBL fusion. For example, forward primers can be designed to hybridize to a nucleotide sequence within USP2 genomic or mRNA sequence (e.g., a nucleotide sequence within exon 2 of USP2 of SEQ ID NO:89), and the reverse primers can be designed to hybridize to a nucleotide sequence of CBL (e.g., a nucleotide sequence within exon 2 of CBL, of SEQ ID NO:91).

In another embodiment, the nucleic acid fragments can be used to identify, e.g., by hybridization, a USP2-CBL fusion. In one embodiment, the nucleic acid fragment hybridizes to a nucleotide sequence that includes a fusion junction between the USP2 transcript and the CBL transcript.

In other embodiments, the nucleic acid fragment includes a bait that comprises a nucleotide sequence that hybridizes to a USP2-CBL fusion nucleic acid molecule described herein, and thereby allows the capture or isolation said nucleic acid molecule. In one embodiment, a bait is suitable for solution phase hybridization. In other embodiments, a bait includes a binding entity, e.g., an affinity tag, that allows capture and separation, e.g., by binding to a binding entity, of a hybrid formed by a bait and a nucleic acid hybridized to the bait.

In other embodiments, the nucleic acid fragment includes a library member comprising a USP2-CBL nucleic acid molecule described herein. In one embodiment, the library member includes a rearrangement that results in a USP2-CBL fusion described herein.

The nucleic acid fragment can be detectably labeled with, e.g., a radiolabel, a fluorescent label, a bioluminescent label, a chemiluminescent label, an enzyme label, a binding pair label, or can include an affinity tag; a tag, or identifier (e.g., an adaptor, barcode or other sequence identifier).

USP2-CBL Fusion Polypeptides

In another embodiment, the USP2-CBL fusion comprises an amino acid sequence (e.g., a fragment of the amino acid sequence) shown in FIG. 85 (SEQ ID NO:90) and an amino acid sequence (e.g., a fragment of the amino acid sequence) shown in FIG. 87 (SEQ ID NO:92), or a fragment of the fusion. In one embodiment, the USP2-CBL fusion comprises an amino acid sequence substantially identical to the amino acid sequence (e.g., a fragment of the amino acid sequence) shown in FIG. 85 (SEQ ID NO:90) and the amino acid sequence (e.g., a fragment of the amino acid sequence) shown in FIG. 87 (SEQ ID NO:92), or a fragment thereof. In one embodiment, the USP2-CBL fusion comprises an amino acid sequence at least 70%, at least 75%, at least 80%, at least 85%, at least 90%, at least 95%, at least 99%, at least 99.5 or greater, identical to the amino acid sequence (e.g., a fragment of the amino acid sequence) shown in FIG. 85 (SEQ ID NO:90) and the amino acid sequence (e.g., a fragment of the amino acid sequence) shown in FIG. 87 (SEQ ID NO:92). In one embodiment, the USP2-CBL fusion comprises a sequence containing at least 10, 20, 50, 100, 500, 600, 700, 800, 900, 1000, or more amino acids of the amino acid sequence shown in FIG. 85 (SEQ ID NO:90) and FIG. 87 (SEQ ID NO:92). In one embodiment, the USP2-CBL fusion comprises an amino acid sequence containing at least 5, 10, 20, 50, 100, 500, 600, 700, 800, 900, 1000, or more contiguous amino acids of the amino acid sequence shown in FIG. 85 (SEQ ID NO:90) and at least 5, 10, 20, 50, 100, 500, 600, 700, 800, 900, 1000, or more contiguous amino acids of the amino acid sequence shown in FIG. 87 (SEQ ID NO:92). In one embodiment, the 5' USP2-3' CBL fusion polypeptide includes a receptor tyrosine kinase domain or a functional fragment thereof. In an embodiment, the 5'USP2-3'CBL fusion polypeptide comprises sufficient CBL and sufficient USP2 sequence such that it has kinase activity, e.g., has elevated activity.

In another aspect, the invention features a USP2-CBL fusion polypeptide (e.g., a purified USP2-CBL fusion polypeptide), a biologically active or antigenic fragment thereof, as well as reagents (e.g., antibody molecules that bind to a USP2-CBL fusion polypeptide), methods for modulating a USP2-CBL polypeptide activity and detection of a USP2-CBL polypeptide.

In one embodiment, the USP2-CBL fusion polypeptide has at least one biological activity. In one embodiment, at least one biological activity of the USP2-CBL fusion polypeptide is reduced or inhibited by an anti-cancer drug, e.g., a USP2 inhibitor, a CBL inhibitor, a CBL inhibitor. In one embodiment, at least one biological activity of the USP2-CBL fusion polypeptide is reduced or inhibited by a CBL inhibitor. In one embodiment, at least one biological activity of the USP2-CBL fusion polypeptide is reduced or inhibited by an USP2 inhibitor. In one embodiment, at least one biological activity of the USP2-CBL fusion polypeptide is reduced or inhibited by a CBL inhibitor, e.g., XL-184 free base (Cabozantinib); R406; Dovitinib Dilactic acid (TKI258 Dilactic acid); Quizartinib (AC220); Tandutinib (MLN518); Amuvatinib (MP-470); ENMD-2076; KW 2449; TG101209; or Dovitinib (TKI-258).

In yet other embodiments, the USP2-CBL fusion polypeptide is encoded by a nucleic acid molecule described herein. In one embodiment, the USP2-CBL fusion polypeptide is encoded by an in-frame fusion of intron 2 of USP2 with intron 7 of CBL (e.g., a sequence on chromosome 11 and a sequence on chromosome 11). In another embodiment, the USP2-CBL fusion polypeptide includes an amino acid sequence encoded by a nucleotide sequence comprising a fusion junction between the USP2 transcript and the CBL transcript.

In certain embodiments, the USP2-CBL fusion polypeptide comprises one or more of encoded exons 1-2 from USP2 and one or more of encoded exons 8-16 of CBL. In certain embodiments, the USP2-CBL fusion polypeptide comprises at least 1, 2 or more encoded exons from USP2 and at least 1, 2, 3, 4, 5, 6, 7, 8, 9 or more, encoded exons from CBL. In certain embodiments, the USP2-CBL fusion polypeptide comprises a fusion of encoded exon 2 from USP2 and encoded exon 2 from CBL (or a fragment thereof). In other embodiments, the fusion comprises least 1, 2 encoded exons from USP2; and at least 1, 2, 3, 4, 5, 6, 7, 8, 9 encoded exons from CBL. In certain embodiments, the USP2-CBL fusion polypeptide comprises encoded exons 1-2 from USP2 and exons 8-16 of CBL. In certain embodiments, the 5' USP2-3' CBL fusion polypeptide comprises a fusion junction of the sequence of exon 2 from USP2 and the sequence of exon 2 from CBL.

In certain embodiments, the USP2-CBL fusion comprises the amino acid sequence corresponding to exon 2 or a fragment thereof from USP2, and the amino acid sequence corresponding to exon 2 or a fragment thereof from CBL (e.g., as shown in FIG. 85 (SEQ ID NO:90) and FIG. 87 (SEQ ID NO:92)). In one embodiment, the USP2-CBL fusion comprises at least 5, 10, 15, 20 or more amino acids from exon 2 of USP2 (e.g., from the amino acid sequence of USP2 preceding the fusion junction with CBL, e.g., of the USP2 sequence shown in FIG. 85 (SEQ ID NO:90)), and at least 5, 10, 15, 20 or more amino acids from exon 2 of CBL (e.g., from the amino acid sequence of CBL following the fusion junction with USP2, e.g., of the CBL sequence shown in FIG. 87 (SEQ ID NO:92)).

In one embodiment, the USP2-CBL fusion polypeptide includes a tyrosine kinase domain or a functional fragment thereof. In a related aspect, the invention features USP2-CBL fusion polypeptide or fragments operatively linked to heterologous polypeptides to form fusion proteins.

In another embodiment, the USP2-CBL fusion polypeptide or fragment is a peptide, e.g., an immunogenic peptide or protein, that contains a fusion junction described herein. Such immunogenic peptides or proteins can be used to raise antibodies specific to the fusion protein. In other embodiments, such immunogenic peptides or proteins can be used for vaccine preparation. The vaccine preparation can include other components, e.g., an adjuvant.

In another aspect, the invention features antibody molecules that bind to a USP2-CBL fusion polypeptide or fragment described herein. In embodiments, the antibody can distinguish wild type CBL (or USP2) from USP2-CBL.

Detection Reagents and Detection of Mutations

In another aspect, the invention features a detection reagent, e.g., a purified or an isolated preparation thereof. Detection reagents can distinguish a nucleic acid, or protein sequence, having a breakpoint, e.g., a USP2-CBL breakpoint; from a reference sequence. In one embodiment, the detection reagent detects (e.g., specifically detects) a USP2-CBL fusion nucleic acid or a polypeptide (e.g., distinguishes a wild type CBL or another CBL fusion (or USP2) from a USP2-CBL nucleic acid (e.g., as described herein in FIG. 84 (SEQ ID NO:89) and FIG. 86 (SEQ ID NO:91); or a USP2-CBL polypeptide (e.g., as described herein in FIG. 85 (SEQ ID NO:90) and FIG. 87 (SEQ ID NO:92).

Detection reagents, e.g., nucleic acid-based detection reagents, can be used to identify mutations in a target nucleic acid, e.g., DNA, e.g., genomic DNA or cDNA, or RNA, e.g., in a sample, e.g., a sample of nucleic acid derived from a neoplastic or tumor cell, e.g., a melanocytic neoplasm, melanoma or metastatic cell. Detection reagents, e.g., antibody-based detection reagents, can be used to identify mutations in a target protein, e.g., in a sample, e.g., a sample of protein derived from, or produced by, a neoplastic or tumor cell, e.g., a melanocytic neoplasm, melanoma or metastatic cell.

Method of Treatment

CBL encodes an E3 ubiquitin protein ligase that is involved in cell signaling and ubiquitination, targeting proteins, including Egfr, Fgfr1/2, PdgfrA/B, Flt3, and Src, for degradation by the proteasome. CBL mutations are found in 3% of tumor tissues in COSMIC and most widely studies in AML (COSMIC, November 2012; reviewed in Bacher U, Haferlach C, Schnittger S, et al. (2010) Mutations of the TET2 and CBL genes: novel molecular markers in myeloid malignancies. Ann Hematol 89(7):643-52). The rearrangement in this tumor results in an in-frame fusion of the USP2 (ubiquitin-specific protease 2) gene with the CBL gene. The fusion product is likely the 5' end of UPS2, with a breakpoint in exon 2, fused to the 3' end of CBL, with the breakpoint in exon 8. Both of these genes are located within a fragment of chromosome 11q23.3 that is commonly deleted in neuroblastoma (Bown N (2001) Neuroblastoma tumour genetics: clinical and biological aspects. J Clin Pathol 54(12): 897-910). USP2 has been shown to have oncogenic properties by impairing ubiquitination of a variety of molecules, including MDM2 and Aurora A (Kim J, Kim W J, Liu Z, et al. (2012) The ubiquitin-specific protease USP2a enhances tumor progression by targeting cyclin A1 in bladder cancer. Cell Cycle 11(6):1123-30, Shi Y, Solomon L R, Pereda-Lopez A, et al. (2011) Ubiquitin-specific cysteine protease 2a (USP2a) regulates the stability of Aurora-A. J Biol Chem 286(45):38960-8). Cbl has also been described as oncogenic in animal models; these proteins are characterized by loss of the E3 ubiquitin ligase activity and have been reported to function in a dominant-negative manner (Thien C B, Langdon W Y (1997) EGF receptor binding and transformation by v-cbl is ablated by the introduction of a loss-of-function mutation from the *Caenorhabditis elegans* sli-1 gene. Oncogene 14(18):2239-49; Andoniou C E, Thien C B, Langdon W Y (1994) Tumour induction by activated abl involves tyrosine phosphorylation of the product of the cbl oncogene. EMBO J 13(19):4515-23; Thien C B, Langdon W Y (1997) Tyrosine kinase activity of the EGF receptor is enhanced by the expression of oncogenic 70Z-Cbl. Oncogene 15(24):2909-19). This resulting protein product may act in an oncogenic manner; however, this fusion has not been described in the literature and therefore its effect on Cbl function is unknown. There are no reports of CBL mutations in soft tissue tumors (COSMIC, PubMed, November 2012). It has been suggested that CBL is involved in a subset of t(11; 22) translocations in Ewing sarcomas. Cbl has been shown to modify Flt3 expression levels; thus inhibitors of Flt3 may be therapeutic for patients harboring CBL mutations (Reindl C, Quentmeier H, Petropoulos K, et al. (2009) CBL exon 8/9 mutants activate the FLT3 pathway and cluster in core binding factor/11q deletion acute myeloid leukemia/myelodysplastic syndrome subtypes. Clin Cancer Res 15(7):2238-47).

Accordingly, in another aspect, a method of inhibiting, reducing, or treating a hyperproliferative disorder, e.g., a neoplasm (including benign, pre-malignant or malignant (e.g., a cancer), in a subject is provided. The method includes administering to the subject a preselected therapeutic agent, e.g., an anti-cancer agent (e.g., a kinase inhibitor), as a single agent, or in combination, in an amount sufficient to reduce, inhibit or treat the activity or expression of USP2-CBL (e.g., a USP2-CBL fusion described herein), thereby inhibiting, reducing, or treating the hyperproliferative disorder in the subject.

In one embodiment, the subject treated has a USP2-CBL fusion; e.g., the subject has a tumor or cancer harboring a USP2-CBL fusion. In other embodiments, the subject has been previously identified as having a USP2-CBL fusion. In yet other embodiments, the subject has been previously identified as being likely or unlikely to respond to treatment with a protein kinase inhibitor, e.g., a subject that has previously participated in a clinical trial. In other embodiments, the subject has been previously identified as being likely or unlikely to respond to treatment with a protein kinase inhibitor, based on the presence of the USP2-CBL fusion. In one embodiment, the subject is a mammal, e.g., a human. In one embodiment, the subject has, or at risk of having a cancer at any stage of disease. In other embodiments, the subject is a patient, e.g., a cancer patient.

In certain embodiments, the neoplasm or neoplastic cell is a benign, pre-malignant, malignant (cancer) or metastasis. In certain embodiments, the cancer is a solid tumor, a soft tissue tumor, or a metastatic lesion.

In one embodiment, the neoplasm or neoplastic cell is a benign, pre-malignant, malignant (cancer) or metastasis. In certain embodiments, the cancer is a solid tumor, a soft tissue tumor, or a metastatic lesion. In one embodiment, the cancer is a carcinoma. In one embodiment, the cancer is a spleen carcinoma. In one embodiment, the cancer is chosen from a lung cancer, a pancreatic cancer, melanoma, a colorectal cancer, an esophageal-gastric cancer, a thyroid cancer, or an adenocarcinoma. In one embodiment, the cancer is a lung adenocarcinoma. In other embodiment, the lung cancer is chosen from one or more of the following: non-small cell lung cancer (NSCLC), small cell lung cancer (SCLC), squamous cell carcinoma (SCC), adenocarcinoma of the lung, bronchogenic carcinoma, or a combination thereof. In one embodiment, the lung cancer is NSCLC or SCC. In certain embodiments, the cancer is a thyroid cacner, e.g., thyroid anaplastic carcinoma. In certain embodiments, the cancer is a speenic cancer, e.g., a speel sarcoma.

In one embodiment, the anti-cancer agent is a CBL inhibitor. In one embodiment, the anti-cancer agent is a USP2 inhibitor. In one embodiment, the anti-cancer agent is a kinase inhibitor. In one embodiment, the anti-cancer agent is a CBL inhibitor, e.g., XL-184 free base (Cabozantinib); R406; Dovitinib Dilactic acid (TKI258 Dilactic acid); Quizartinib (AC220); Tandutinib (MLN518); Amuvatinib (MP-470); ENMD-2076; KW 2449; TG101209; or Dovitinib (TKI-258). In some embodiments the CLL inhibitor is a CLL inhibitor described herein.

STK32B-ALK Fusions

In one embodiment, a fusion includes an in-frame fusion of an exon of serine/threonine kinase 32B (STK32B), e.g., one more exons of STK32B (e.g., one or more of exon 1-11 of STK32B) or a fragment thereof, and an exon of anaplastic lymphoma receptor tyrosine kinase (ALK), e.g., one or more exons of an ALK (e.g., one or more of exons 20-29 of ALK) or a fragment thereof. In one embodiment, an in-frame fusion includes one or more of exons 1-11 of STK32B and one or more of exons 21-29 of ALK, or a fragment thereof. For example, the STK32B-ALK fusion can include an in-frame fusion within an intron of STK32B (e.g., intron 11) or a fragment thereof, with an intron of ALK (e.g., intron 19) or a fragment thereof. In one embodiment, the fusion of the STK32B-ALK fusion comprises the nucleotide sequence of: chromosome 4 at one or more of nucleotide 29,447,949 (plus or minus 10, 20, 30, 50, 60, 70, 80, 100 or more nucleotides) and chromosome 2 at one or more of nucleotide 29,447,949 (plus or minus 10, 20, 30, 50, 60, 70, 80, 100 or more nucleotides).

In certain embodiments, the STK32B-ALK fusion is in a 5'-STK32B to 3'-ALK configuration (also referred to herein as "5'-STK32B-ALK-3'"). The term "fusion" or "fusion molecule" can refer to a polypeptide or a nucleic acid fusion, depending on the context. It may include a full-length sequence of a fusion or a fragment thereof, e.g., a fusion junction (e.g., a fragment including a portion of STK32B and a portion of ALK, e.g., a portion of the STK32B-ALK fusion described herein). In one embodiment, the STK32B-ALK fusion polypeptide includes a fragment of the amino acid sequence shown in FIG. 90 (SEQ ID NO:96) and a fragment of the amino acid sequence shown in FIG. 62A (SEQ ID NO:62), or an amino acid sequence substantially identical thereto. In another embodiment, the STK32B-ALK fusion nucleic acid includes a fragment of the nucleotide sequence shown in FIG. 89 (SEQ ID NO:95) and a fragment of the nucleotide sequence shown in FIG. 61 (SEQ ID NO:61), or a nucleotide sequence substantially identical thereto. In one embodiment, the STK32B-ALK fusion polypeptide comprises sufficient STK32B and sufficient ALK sequence such that the 5' STK32B-3' ALK fusion has kinase activity, e.g., has elevated activity, e.g., ALK tyrosine kinase activity, as compared with wild type ALK, e.g., in a cell of a cancer referred to herein (e.g., uterus leiomyosarcoma). In certain embodiments, the STK32B sequence has a kinase domain, e.g., a serine/threonine kinase domain, e.g., it may have serine threonine kinase activity.

In certain embodiments, the STK32B-ALK fusion comprises one or more (or all of) exon 11 from STK32B and one or more (or all of) exons 20-29 of ALK (e.g., one or more of the exons shown in FIG. 89 (SEQ ID NO:95) and FIG. 61 (SEQ ID NO:61). In another embodiment, the STK32B-ALK fusion comprises one or more (or all of) exon 1-11 of STK32B and one or more (or all of) exons 20-29 of ALK. In certain embodiments, the STK32B-ALK fusion comprises at least 1, 2, 3, 4, 5, 6, 7, 8, 9, 10, 11 or more exons (or encoded exons) from STK32B and at least 1, 2, 3, 4, 5, 6, 7, 8, 9 or more exons (or encoded exons) from ALK (e.g., from the STK32B and ALK sequences shown in FIG. 89 and FIG. 90 (SEQ ID NO:95 and 90) and FIG. 61 and FIG. 62 (SEQ ID NOs:61 and 62)).

In certain embodiments, the STK32B-ALK fusion comprises exons 1-11 or a fragment thereof from STK32B, and exons 20-29 or a fragment thereof from ALK (e.g., as shown in FIG. 89 (SEQ ID NO:95) and FIG. 61 (SEQ ID NO:61)). In one embodiment, the STK32B-ALK fusion comprises at least 5, 10, 15, 20, 30, 40, 50 or more amino acids from exon 1-11 of STK32B (e.g., from the amino acid sequence of STK32B as shown in FIG. 90 (SEQ ID NO:96) (e.g., from the amino acid sequence of STK32B preceding the fusion junction with ALK, and at least 5, 10, 15, 20, 30, 40, 50 or more amino acids from exon 20-29, or 21-29, of ALK (e.g., from the amino acid sequence of ALK as shown in FIG. 62 (SEQ ID NO:62)). In another embodiment, the STK32B-ALK fusion comprises at least 6, 12, 15, 20, 25, 50, 75, 100 or more nucleotides from exon 1-11 of STK32B (e.g., from the nucleotide sequence of STK32B as shown in FIG. 89 (SEQ ID NO:95) (e.g., from the nucleotide sequence of STK32B preceding the fusion junction with ALK); and at least 6, 12, 15, 20, 25, 50, 75, 100 or more nucleotides from exon 20 of ALK (e.g., from the nucleotide sequence of ALK as shown in FIG. 61 (SEQ ID NO:61).

STK32B-ALK Nucleic Acid Molecules

In one aspect, the invention features a nucleic acid molecule (e.g., an isolated or purified) nucleic acid molecule that includes a fragment of a STK32B gene and a fragment of am ALK gene. In one embodiment, the nucleotide sequence encodes a STK32B-ALK fusion polypeptide that includes an ALK tyrosine kinase domain or a functional fragment thereof. In another embodiment, the nucleotide sequence encodes a fragment of the ALK polypeptide including the amino acid sequence of SEQ ID NO:62 or a fragment thereof, or a sequence substantially identical thereto. In other embodiments, the nucleic acid molecule includes a fragment of the STK32B gene encoding the amino acid sequence of SEQ ID NO:96 or a fragment thereof, or a sequence substantially identical thereto. In yet other embodiments, the nucleic acid molecule includes a nucleotide sequence encoding the amino acid sequence shown in FIG. 90 (SEQ ID NO:96), or a fragment thereof, and the amino acid sequence shown in FIG. 62 (SEQ ID NO:62) or a fragment thereof, or a sequence substantially identical thereto.

In one embodiment, the nucleic acid molecule includes a fusion, e.g., an in-frame fusion, between an intron of STK32B (e.g., intron 11, or a fragment thereof), and an intron of ALK (e.g., intron 19, or a fragment thereof). The STK32B-ALK fusion can comprise a fusion of the nucleotide sequence of: chromosome 4 at one or more of nucleotide 29,447,949 (plus or minus 10, 20, 30, 50, 60, 70, 80, 100 nucleotides) and chromosome 2 at one or more of nucleotide 29,447,949 (plus or minus 10, 20, 30, 50, 60, 70, 80, 100 nucleotides), or a fragment thereof. In one embodiment, the STK32B-ALK fusion comprises a fusion of the nucleotide sequence of: chromosome 4 at one or more of nucleotide 29,447,949 (plus or minus 10, 20, 30, 50, 60, 70, 80, 100 nucleotides) and chromosome 2 at one or more of nucleotide 29,447,949 (plus or minus 10, 20, 30, 50, 60, 70, 80, 100 nucleotides), or a fragment thereof.

In another embodiment, the STK32B-ALK fusion comprises a nucleotide sequence (e.g., a fragment of a nucleotide sequence) shown in FIG. 89 (SEQ ID NO:95) and a nucleotide sequence (e.g., a fragment of a nucleotide sequence) shown in FIG. 61 (SEQ ID NO:61), or a fragment of the fusion. In one embodiment, the STK32B-ALK fusion comprises a nucleotide sequence substantially identical to the nucleotide sequence (e.g., a fragment of a nucleotide sequence) shown in FIG. 89 (SEQ ID NO:95) and the nucleotide sequence (e.g., a fragment of a nucleotide sequence) shown FIG. 61 (SEQ ID NO:61), or a fragment of the fusion. In one embodiment, the STK32B-ALK fusion comprises a nucleotide sequence at least 70%, at least 75%, at least 80%, at least 85%, at least 90%, at least 95%, at least 99%, at least 99.5 or greater, identical to the nucleotide sequence (e.g., a fragment of a nucleotide sequence) shown in FIG. 89 (SEQ ID NO:95) and to the nucleotide sequence (e.g., a fragment of a nucleotide sequence) shown in FIG. 61

(SEQ ID NO:61). In one embodiment, the STK32B-ALK fusion comprises a nucleotide sequence containing at least 25, 50, 100, 150, 200, 500, 1000, 1500, 2000, 2500, 3000, or more nucleotides of the nucleotide sequence shown in FIGS. 89A-89C (SEQ ID NO:95) and a nucleotide sequence containing at least 25, 50, 100, 150, 200, 500, 1000, 1500, 2000, 2500, 3000, or more nucleotides of the nucleotide sequence shown in FIG. 61 (SEQ ID NO:61). In one embodiment, the STK32B-ALK fusion comprises a nucleotide sequence containing at least 25, 50, 100, 150, 200, 500, 1000, 1500, 2000, 2500, 3000, or more contiguous nucleotides of the nucleotide sequence shown in FIG. 89 (SEQ ID NO:95) and a nucleotide sequence containing at least 25, 50, 100, 150, 200, 500, 1000, 1500, 2000, 2500, 3000, or more nucleotides of the nucleotide sequence shown in FIG. 61 (SEQ ID NO:61).

In another embodiment, the nucleic acid molecule includes a fusion, e.g., an in-frame fusion, of at least exon 1-11 of STK32B or a fragment thereof (e.g., one or more of exon 1-11 of STK32B or a fragment thereof), and at least exon 20 or a fragment thereof (e.g., one or more of exons 20-29, or 21-29, of ALK or a fragment thereof). In yet other embodiments, the nucleic acid molecule includes a fragment the nucleotide sequence shown in FIG. 89 (SEQ ID NO:95) and a fragment of the nucleotide sequence shown in FIG. 61 (SEQ ID NO:61) or a fragment of the fusion, or a sequence substantially identical thereto.

In one embodiment, the nucleic acid molecule is complementary to at least a portion of a nucleotide sequence disclosed herein, e.g., is capable of hybridizing under a stringency condition described herein to SEQ ID NO:95 and/or SEQ ID NO:61, or a fragment thereof. In yet another embodiment, the nucleic acid molecule hybridizes to a nucleotide sequence that is complementary to at least a portion of a nucleotide sequence disclosed herein, e.g., is capable of hybridizing under a stringency condition to a nucleotide sequence complementary to SEQ ID NO:95 and/or SEQ ID NO:61, or a fragment thereof. The nucleotide sequence of a cDNA encoding an exemplary 5' STK32B-3' ALK fusion is shown in at least exon 1 (e.g., exons 1-11) of SEQ ID NO:95 and at least exon 20 (e.g., exons 20-29), or at least exon 21 (e.g., exons 21-29) of SEQ ID NO:61, and the predicted amino acid sequence is shown in the corresponding encoded exons of SEQ ID NO:96 and the corresponding encoded exons of SEQ ID NO:62, respectively.

In an embodiment the STK32B-ALK nucleic acid molecule comprises sufficient STK32B and sufficient ALK sequence such that the encoded 5' STK32B-3' ALK fusion has kinase activity, e.g., has elevated activity, e.g., ALK kinase activity, as compared with wild type ALK, e.g., in a cell of a cancer referred to herein. In certain embodiments, the 5' STK32B-3' ALK fusion comprises exon 11 from STK32B and exons 20-29, or 21-29) from ALK. In certain embodiments, the STK32B-ALK fusion comprises at least 1 or more exons from STK32B and at least 1, 2, 3, 4, 5, 6, 7, 8, 9, 10, 11 or more, exons from ALK. In certain embodiments, the STK32B-ALK fusion comprises a fusion of exon 11 from STK32B and exon 20 from ALK. In another embodiment, the STK32B-ALK fusion comprises at least 1, 2, 3, 4, 5, 6, 7, 8, 9, 10, 11 exons from STK32B; and at least 1, 2, 3, 4, 5, 6, 7, 8, 9 exons from ALK.

In one embodiment, the nucleic acid molecule includes a nucleotide sequence that has an in-frame fusion of intron 11 of STK32B (e.g., NM_018401) with intron 19 of ALK (e.g., NM_004304). In another embodiment, the nucleic acid molecule includes a nucleotide sequence that includes a breakpoint. For example, the nucleic acid molecule includes a nucleotide sequence that includes the fusion junction between the STK32B gene and the ALK gene, e.g., the breakpoint between intron 11 of STK32B and intron 19 of ALK. In other embodiments, the nucleic acid molecules includes a nucleotide sequence of one or more of nucleotide 29,447,949 of chromosome 2 coupled to (e.g., directly or indirectly juxtaposed to) one or more of nucleotide 29,447,949 of chromosome 2. In one embodiment, the nucleic acid molecule includes the nucleotide sequence of: chromosome 4 at one or more of nucleotide 29,447,949 plus or minus 10, 20, 30, 40 50, 60, 80, 100, 150 nucleotides and chromosome 2 at one or more of nucleotide 29,447,949 plus or minus 10, 20, 30, 40 50, 60, 80, 100, 150 nucleotides (corresponding to the breakpoint of a STK32B-ALKfusion), or a fragment thereof, or a sequence substantially identical thereto. In one embodiment, the nucleic acid molecule is complementary to at least a portion of a nucleotide sequence disclosed herein, e.g., is capable of hybridizing under a stringency condition described herein to SEQ ID NO:95 and/or SEQ ID NO:61 or a fragment thereof. In yet other embodiment, the nucleic acid molecule hybridizes to a nucleotide sequence that is complementary to at least a portion of a nucleotide sequence disclosed herein, e.g., is capable of hybridizing under a stringency condition described herein to a nucleotide sequence complementary to SEQ ID NO:95 or 61 or a fragment thereof.

In another embodiment, the STK32B-ALK fusion nucleic acid comprises at least 6, 12, 15, 20, 25, 50, 75, 100 or more nucleotides from exon 1-11 of STK32B (e.g., from the nucleotide sequence of STK32B preceding the fusion junction with ALK, e.g., of the STK32B sequence shown in FIG. 89 (SEQ ID NO:95)), and at least 6, 12, 15, 20, 25, 50, 75, 100 or more nucleotides from exon 20 or exon 21 of ALK (e.g., from the nucleotide sequence of ALK following the fusion junction with STK32B, e.g., of the ALK sequence shown in FIG. 61 (SEQ ID NO:61)).

In other embodiments, the nucleic acid molecule includes a nucleotide sequence encoding a STK32B-ALK fusion polypeptide that includes a fragment of a STK32B gene and a fragment of an ALK gene. In one embodiment, the nucleotide sequence encodes a STK32B-ALK fusion polypeptide that includes e.g., an ALK tyrosine kinase domain or a functional fragment thereof. In yet other embodiments, the nucleic acid molecule includes a nucleotide sequence encoding the amino acid sequence (e.g., a fragment of the amino acid sequence) shown in FIG. 90 (e.g., SEQ ID NO:96) and a nucleotide sequence encoding the amino acid sequence (e.g., a fragment of the amino acid sequence) shown in FIG. 62 (e.g., SEQ ID NO:62), or a fragment of the fusion, or a sequence substantially identical thereto. In one embodiment, the encoded STK32B-ALK fusion polypeptide includes an ALK tyrosine kinase domain or a functional fragment thereof.

In a related aspect, the invention features nucleic acid constructs that include the STK32B-ALK nucleic acid molecules described herein. In certain embodiments, the nucleic acid molecules are operatively linked to a native or a heterologous regulatory sequence. Also included are vectors and host cells that include the STK32B-ALK nucleic acid molecules described herein, e.g., vectors and host cells suitable for producing the nucleic acid molecules and polypeptides described herein.

In a related aspect, methods of producing the nucleic acid molecules and polypeptides described herein are also described.

In another aspect, the invention features nucleic acid molecules that reduce or inhibit the expression of a nucleic acid molecule that encodes a STK32B-ALK fusion described herein. Examples of such nucleic acid molecules include, for example, antisense molecules, ribozymes, RNAi, triple helix molecules that hybridize to a nucleic acid encoding STK32B-ALK, or a transcription regulatory region of STK32B-ALK, and blocks or reduces mRNA expression of STK32B-ALK.

Nucleic Acid Detection and Capturing Reagents

The invention also features a nucleic acid molecule, e.g., nucleic acid fragment, suitable as probe, primer, bait or library member that includes, flanks, hybridizes to, which are useful for identifying, or are otherwise based on, the STK32B-ALK fusions described herein. In certain embodiments, the probe, primer or bait molecule is an oligonucleotide that allows capture, detection or isolation of a STK32B-ALK fusion nucleic acid molecule described herein. The oligonucleotide can comprise a nucleotide sequence substantially complementary to a fragment of the STK32B-ALK fusion nucleic acid molecules described herein. The sequence identity between the nucleic acid fragment, e.g., the oligonucleotide, and the target STK32B-ALK sequence need not be exact, so long as the sequences are sufficiently complementary to allow the capture, detection or isolation of the target sequence. In one embodiment, the nucleic acid fragment is a probe or primer that includes an oligonucleotide between about 5 and 25, e.g., between 10 and 20, or 10 and 15 nucleotides in length. In other embodiments, the nucleic acid fragment is a bait that includes an oligonucleotide between about 100 to 300 nucleotides, 130 and 230 nucleotides, or 150 and 200 nucleotides, in length.

In one embodiment, the nucleic acid fragment can be used to identify or capture, e.g., by hybridization, a STK32B-ALK fusion. For example, the nucleic acid fragment can be a probe, a primer, or a bait, for use in identifying or capturing, e.g., by hybridization, a STK32B-ALK fusion described herein. In one embodiment, the nucleic acid fragment can be useful for identifying or capturing a STK32B-ALK breakpoint, e.g., the nucleotide sequence of: chromosome 4 at nucleotide 29,447,949 plus or minus 10, 20, 30, 40 50, 60, 80, 100, 150 nucleotides and chromosome 2 at nucleotide 29,447,949 plus or minus 10, 20, 30, 40 50, 60, 80, 100, 150 nucleotides.

In one embodiment, the nucleic acid fragment hybridizes to a nucleotide sequence within a chromosomal rearrangement that creates an in-frame fusion of intron 11 of STK32B with intron 19 of ALK. In one embodiment, the nucleic acid fragment hybridizes to a nucleotide sequence in the region In other embodiments, the nucleic acid molecules includes a nucleotide sequence in the region of nucleotides 29,447, 949 of chromosome 2 coupled to (e.g., juxtaposed to) nucleotides in the region of nucleotides 29,447,949 of chromosome 2. In one embodiment, the nucleic acid fragment hybridizes to a nucleotide sequence that includes a breakpoint, e.g., the nucleotide sequence of: chromosome 4 at nucleotide 29,447,949 plus or minus 10, 20, 30, 40 50, 60, 80, 100, 150 or more nucleotides and chromosome 2 at nucleotide 29,447,949 plus or minus 10, 20, 30, 40 50, 60, 80, 100, 150 or more nucleotides. For example, the nucleic acid fragment can hybridize to a nucleotide sequence that includes the fusion junction between the STK32B gene and the ALK gene, e.g., a nucleotide sequence that includes a portion of a nucleotide sequence within intron 11 of a STK32B gene and 19 of an ALK gene.

In another embodiment, the nucleic acid fragment hybridizes to a nucleotide sequence that comprises at least 6, 12, 15, 20, 25, 50, 75, 100, 150 or more nucleotides from exon 1-11 of STK32B (e.g., from the nucleotide sequence of STK32B preceding the fusion junction with ALK, e.g., of the STK32B sequence shown in FIG. 89 (SEQ ID NO:95)), and at least 6, 12, 15, 20, 25, 50, 75, 100, 150 or more nucleotides from exon 20 of ALK (e.g., from the nucleotide sequence of ALK following the fusion junction with STK32B, e.g., of the ALK sequence shown in FIG. 61 (SEQ ID NO:61)).

The probes or primers described herein can be used, for example, for FISH detection or PCR amplification. In one exemplary embodiment where detection is based on PCR, amplification of the STK32B-ALK fusion junction fusion junction can be performed using a primer or a primer pair, e.g., for amplifying a sequence flanking the fusion junctions described herein, e.g., the mutations or the junction of a chromosomal rearrangement described herein, e.g., STK32B-ALK.

In one embodiment, a pair of isolated oligonucleotide primers can amplify a region containing or adjacent to a position in the STK32B-ALK fusion. For example, forward primers can be designed to hybridize to a nucleotide sequence within STK32B genomic or mRNA sequence (e.g., a nucleotide sequence within exon 1-11 of STK32B of SEQ ID NO:95), and the reverse primers can be designed to hybridize to a nucleotide sequence of ALK (e.g., a nucleotide sequence within exon 20 of ALK, of SEQ ID NO:61).

In another embodiment, the nucleic acid fragments can be used to identify, e.g., by hybridization, a STK32B-ALK fusion. In one embodiment, the nucleic acid fragment hybridizes to a nucleotide sequence that includes a fusion junction between the STK32B transcript and the ALK transcript.

In other embodiments, the nucleic acid fragment includes a bait that comprises a nucleotide sequence that hybridizes to a STK32B-ALK fusion nucleic acid molecule described herein, and thereby allows the capture or isolation said nucleic acid molecule. In one embodiment, a bait is suitable for solution phase hybridization. In other embodiments, a bait includes a binding entity, e.g., an affinity tag, that allows capture and separation, e.g., by binding to a binding entity, of a hybrid formed by a bait and a nucleic acid hybridized to the bait.

In other embodiments, the nucleic acid fragment includes a library member comprising a STK32B-ALK nucleic acid molecule described herein. In one embodiment, the library member includes a rearrangement that results in a STK32B-ALK fusion described herein.

The nucleic acid fragment can be detectably labeled with, e.g., a radiolabel, a fluorescent label, a bioluminescent label, a chemiluminescent label, an enzyme label, a binding pair label, or can include an affinity tag; a tag, or identifier (e.g., an adaptor, barcode or other sequence identifier).

STK32B-ALK Fusion Polypeptides

In another embodiment, the STK32B-ALK fusion comprises an amino acid sequence (e.g., a fragment of the amino acid sequence) shown in FIG. 90 (SEQ ID NO:96) and an amino acid sequence (e.g., a fragment of the amino acid sequence) shown in FIG. 62 (SEQ ID NO:62), or a fragment of the fusion. In one embodiment, the STK32B-ALK fusion comprises an amino acid sequence substantially identical to the amino acid sequence (e.g., a fragment of the amino acid sequence) shown in FIG. 90 (SEQ ID NO:96) and the amino acid sequence (e.g., a fragment of the amino acid sequence) shown in FIG. 62 (SEQ ID NO:62), or a fragment thereof. In one embodiment, the STK32B-ALK fusion comprises an amino acid sequence at least 70%, at least 75%, at least 80%, at least 85%, at least 90%, at least 95%, at least 99%, at least 99.5 or greater, identical to the amino acid sequence (e.g., a fragment of the amino acid sequence) shown in FIG. 90

(SEQ ID NO:96) and the amino acid sequence (e.g., a fragment of the amino acid sequence) shown in FIG. 62 (SEQ ID NO:62). In one embodiment, the STK32B-ALK fusion comprises a sequence containing at least 10, 20, 50, 100, 500, 600, 700, 800, 900, 1000, or more amino acids of the amino acid sequence shown in FIG. 90 (SEQ ID NO:96) and FIG. 62 (SEQ ID NO:62). In one embodiment, the STK32B-ALK fusion comprises an amino acid sequence containing at least 5, 10, 20, 50, 100, 500, 600, 700, 800, 900, 1000, or more contiguous amino acids of the amino acid sequence shown in FIG. 90 (SEQ ID NO:96) and at least 5, 10, 20, 50, 100, 500, 600, 700, 800, 900, 1000, or more contiguous amino acids of the amino acid sequence shown in FIG. 62 (SEQ ID NO:62). In one embodiment, the 5' STK32B-3' ALK fusion polypeptide includes an ALK receptor tyrosine kinase domain or a functional fragment thereof. In an embodiment, the 5'STK32B-3'ALK fusion polypeptide comprises sufficient ALK and sufficient STK32B sequence such that it has kinase activity, e.g., has elevated activity, e.g., ALK kinase activity, as compared with wild type ALK, e.g., in a cell of a cancer referred to herein.

In another aspect, the invention features a STK32B-ALK fusion polypeptide (e.g., a purified STK32B-ALK fusion polypeptide), a biologically active or antigenic fragment thereof, as well as reagents (e.g., antibody molecules that bind to a STK32B-ALK fusion polypeptide), methods for modulating a STK32B-ALK polypeptide activity and detection of a STK32B-ALK polypeptide.

In one embodiment, the STK32B-ALK fusion polypeptide has at least one biological activity, e.g., an ALK kinase activity. In one embodiment, at least one biological activity of the STK32B-ALK fusion polypeptide is reduced or inhibited by an anti-cancer drug, e.g., a kinase inhibitor (e.g., a multikinase inhibitor or an ALK-specific inhibitor). In one embodiment, at least one biological activity of the STK32B-ALK fusion polypeptide is reduced or inhibited by an ALK kinase inhibitor chosen from e.g., TAE-684 (also referred to herein as "NVP-TAE694"), PF02341066 (also referred to herein as "crizotinib" or "1066"), AF-802, LDK-378, ASP-3026, CEP-37440, CEP-28122, CEP-108050 and AP26113. Additional examples of ALK kinase inhibitors are described in examples 3-39 of WO 2005016894 by Garcia-Echeverria C, et al.

In yet other embodiments, the STK32B-ALK fusion polypeptide is encoded by a nucleic acid molecule described herein. In one embodiment, the STK32B-ALK fusion polypeptide is encoded by an in-frame fusion of intron 11 of STK32B with intron 19 of ALK (e.g., a sequence on chromosome 2). In another embodiment, the STK32B-ALK fusion polypeptide includes an amino acid sequence encoded by a nucleotide sequence comprising a fusion junction between the STK32B transcript and the ALK transcript.

In certain embodiments, the STK32B-ALK fusion polypeptide comprises one or more of encoded exon 11 from STK32B and one or more of encoded exon exons 20-29 of ALK. In certain embodiments, the STK32B-ALK fusion polypeptide comprises at least 1 or more encoded exons from STK32B and at least 1, 2, 3, 4, 5, 6, 7, 8, 9 or more, encoded exons from ALK. In certain embodiments, the STK32B-ALK fusion polypeptide comprises a fusion of encoded exon 11 from STK32B and encoded exon 20 from ALK (or a fragment thereof). In other embodiments, the fusion comprises least 1 encoded exon from STK32B; and at least 1, 2, 3, 4, 5, 6, 7, 8, 9 encoded exons from ALK. In certain embodiments, the STK32B-ALK fusion polypeptide comprises encoded exon 11 from STK32B and exon exons 20-29 of ALK. In certain embodiments, the 5' STK32B-3' ALK fusion polypeptide comprises a fusion junction of the sequence of exon 11 from STK32B and the sequence of exon 20 from ALK.

In certain embodiments, the STK32B-ALK fusion comprises the amino acid sequence corresponding to exon 1 or a fragment thereof from STK32B, and the amino acid sequence corresponding to exon 20 or a fragment thereof from ALK (e.g., as shown in FIG. 90 (SEQ ID NO:96) and FIG. 62 (SEQ ID NO:62)). In one embodiment, the STK32B-ALK fusion comprises at least 5, 10, 15, 20 or more amino acids from exon 1-11 of STK32B (e.g., from the amino acid sequence of STK32B preceding the fusion junction with ALK, e.g., of the STK32B sequence shown in FIG. 90 (SEQ ID NO:96)), and at least 5, 10, 15, 20 or more amino acids from exon 20 of ALK (e.g., from the amino acid sequence of ALK following the fusion junction with STK32B, e.g., of the ALK sequence shown in FIG. 62 (SEQ ID NO:62)).

In one embodiment, the STK32B-ALK fusion polypeptide includes an ALK tyrosine kinase domain or a functional fragment thereof. In a related aspect, the invention features STK32B-ALK fusion polypeptide or fragments operatively linked to heterologous polypeptides to form fusion proteins.

In another embodiment, the STK32B-ALK fusion polypeptide or fragment is a peptide, e.g., an immunogenic peptide or protein, that contains a fusion junction described herein. Such immunogenic peptides or proteins can be used to raise antibodies specific to the fusion protein. In other embodiments, such immunogenic peptides or proteins can be used for vaccine preparation. The vaccine preparation can include other components, e.g., an adjuvant.

In another aspect, the invention features antibody molecules that bind to a STK32B-ALK fusion polypeptide or fragment described herein. In embodiments, the antibody can distinguish wild type ALK (or STK32B) from STK32B-ALK.

Detection Reagents and Detection of Mutations

In another aspect, the invention features a detection reagent, e.g., a purified or an isolated preparation thereof. Detection reagents can distinguish a nucleic acid, or protein sequence, having a breakpoint, e.g., a STK32B-ALK breakpoint; from a reference sequence. In one embodiment, the detection reagent detects (e.g., specifically detects) a STK32B-ALK fusion nucleic acid or a polypeptide (e.g., distinguishes a wild type ALK or another ALK fusion (or STK32B) from a STK32B-ALK nucleic acid (e.g., as described herein in FIG. 89 (SEQ ID NO:95) and FIG. 61 (SEQ ID NO:61); or a STK32B-ALK polypeptide (e.g., as described herein in FIG. 90 (SEQ ID NO:96) and FIG. 62 (SEQ ID NO:62).

Detection reagents, e.g., nucleic acid-based detection reagents, can be used to identify mutations in a target nucleic acid, e.g., DNA, e.g., genomic DNA or cDNA, or RNA, e.g., in a sample, e.g., a sample of nucleic acid derived from a neoplastic or tumor cell, e.g., a melanocytic neoplasm, melanoma or metastatic cell. Detection reagents, e.g., antibody-based detection reagents, can be used to identify mutations in a target protein, e.g., in a sample, e.g., a sample of protein derived from, or produced by, a neoplastic or tumor cell, e.g., a melanocytic neoplasm, melanoma or metastatic cell.

Method of Treatment

ALK encodes a receptor tyrosine kinase, which is part of the insulin receptor superfamily and induces downstream activation of pathways associated with cell survival, angiogenesis and proliferation (Grande E, Bolos M V, Arriola E (2011) Targeting oncogenic ALK: a promising strategy for cancer treatment. Mol Cancer Ther 10(4):569-79). ALK (anaplastic lymphoma kinase) rearrangements have been described. The rearrangement detected in this case is novel, and involves a fusion of the STK32B (serine threonine kinase 32B) gene (intron 11), with the ALK gene (intron 19). This in-frame fusion may produce a functional protein. ALK rearrangements have not been reported in leiomyosarcoma; however, they have been reported in a subset of inflammatory myofibroblastic tumors of the genital tract, another type of spindle cell tumor that is similar to leiomyosarcoma (Sukov W R, Cheville J C, Carlson A W, et al. (2007) Utility of ALK-1 protein expression and ALK rearrangements in distinguishing inflammatory myofibroblastic tumor from malignant spindle cell lesions of the urinary bladder. Mod Pathol 20(5):592-603, Fuehrer N E, Keeney G L, Ketterling R P, et al. (2012) ALK-1 protein expression and ALK gene rearrangements aid in the diagnosis of inflammatory myofibroblastic tumors of the female genital tract. Arch Pathol Lab Med 136(6):623-6). Increased protein ALK expression has been associated with poor prognosis in some cancer types (Takeda M, Okamoto I, Sakai K, et al. (2012) Clinical outcome for EML4-ALK-positive patients with advanced non-small-cell lung cancer treated with first-line platinum-based chemotherapy. Ann Oncol 23(11):2931-6, Sukov W R, Hodge J C, Lohse C M, et al. (2012) ALK alterations in adult renal cell carcinoma: frequency, clinicopathologic features and outcome in a large series of consecutively treated patients. Mod Pathol 25(11):1516-25, Duijkers F A, Gaal J, Meijerink J P, et al. (2012) High anaplastic lymphoma kinase immunohistochemical staining in neuroblastoma and ganglioneuroblastoma is an independent predictor of poor outcome. Am J Pathol 180(3):1223-31). The ALK inhibitor crizotinib has been approved by the FDA for use in lung cancer patients specifically with EML4-ALK fusions (Kwak E L, Bang Y J, Camidge D R, et al. (2010) Anaplastic lymphoma kinase inhibition in non-small-cell lung cancer. N Engl J Med 363(18):1693-703, Curran M P (2012) Crizotinib: in locally advanced or metastatic non-small cell lung cancer. Drugs 72(1):99-107). Crizotinib has been studied systematically in NSCLC patients with the canonical EML4-ALK mutations.

Accordingly, in another aspect, a method of inhibiting, reducing, or treating a hyperproliferative disorder, e.g., a neoplasm (including benign, pre-malignant or malignant (e.g., a cancer), in a subject is provided. The method includes administering to the subject a preselected therapeutic agent, e.g., an anti-cancer agent (e.g., a kinase inhibitor), as a single agent, or in combination, in an amount sufficient to reduce, inhibit or treat the activity or expression of STK32B-ALK (e.g., a STK32B-ALK fusion described herein), thereby inhibiting, reducing, or treating the hyperproliferative disorder in the subject.

In one embodiment, the subject treated has a STK32B-ALK fusion; e.g., the subject has a tumor or cancer harboring a STK32B-ALK fusion. In other embodiments, the subject has been previously identified as having a STK32B-ALK-fusion. In yet other embodiments, the subject has been previously identified as being likely or unlikely to respond to treatment with a protein kinase inhibitor, e.g., a subject that has previously participated in a clinical trial. In other embodiments, the subject has been previously identified as being likely or unlikely to respond to treatment with a protein kinase inhibitor, based on the presence of the STK32B-ALK fusion. In one embodiment, the subject is a mammal, e.g., a human. In one embodiment, the subject has, or at risk of having a cancer at any stage of disease. In other embodiments, the subject is a patient, e.g., a cancer patient.

In certain embodiments, the neoplasm or neoplastic cell is a benign, pre-malignant, malignant (cancer) or metastasis. In certain embodiments, the cancer is a solid tumor, a soft tissue tumor, or a metastatic lesion.

In one embodiment, the neoplasm or neoplastic cell is a benign, pre-malignant, malignant (cancer) or metastasis. In certain embodiments, the cancer is a solid tumor, a soft tissue tumor, or a metastatic lesion. In an embodiment the cancer is a sarcoma. In an embodiment, the cancer is uterus leiomyosarcoma. In an embodiment, the cancer is a lung adenocarcinoma. In one embodiment, the cancer is chosen from a lung cancer, a pancreatic cancer, melanoma, a colorectal cancer, an esophageal-gastric cancer, a thyroid cancer, or an adenocarcinoma. In one embodiment, the cancer is a lung adenocarcinoma. In other embodiment, the lung cancer is chosen from one or more of the following: non-small cell lung cancer (NSCLC), small cell lung cancer (SCLC), squamous cell carcinoma (SCC), adenocarcinoma of the lung, bronchogenic carcinoma, or a combination thereof. In one embodiment, the lung cancer is NSCLC or SCC. In certain embodiments, the cancer is a cancer of the uterus, e.g., a uteral sarcoma, e.g., uterus leiomyosarcoma.

In one embodiment, the anti-cancer agent is a kinase inhibitor. For example, the kinase inhibitor is a multi-kinase inhibitor or an ALK-specific inhibitor. In one embodiment, the kinase inhibitor is an ALK inhibitor including, but not limited to, TAE-684 (also referred to herein as "NVP-TAE694"), PF02341066 (also referred to herein as "crizotinib" or "1066"), AF-802, LDK-378, ASP-3026, CEP-37440, CEP-28122, CEP-108050 and AP26113. Additional examples of ALK kinase inhibitors are described in examples 3-39 of WO 2005016894 by Garcia-Echeverria C, et al. In some embodiments the ALK inhibitor is a ALK inhibitor described herein.

FGFR2-TACC3 Fusions

In one embodiment, a fusion includes an in-frame fusion of an exon of fibroblast growth factor receptor 2 (FGFR2), e.g., one more exons of FGFR2 (e.g., exons 1-16 of FGFR2) or a fragment thereof, and an exon of TACC3 proto-oncogene (TACC3), e.g., one or more exons of a TACC3 (e.g., exons 11-16 of TACC3) or a fragment thereof. For example, the FGFR2-TACC3 fusion can include an in-frame fusion within an intron of FGFR2 (e.g., intron 16) or a fragment thereof, with an intron of TACC3 (e.g., intron 10) or a fragment thereof. In one embodiment, the fusion of the FGFR2-TACC3 fusion comprises the nucleotide sequence of: chromosome 10 at one or more of nucleotide 123,243, 122 (plus or minus 10, 20, 30, 50, 60, 70, 80, 100 or more nucleotides) and chromosome 4 at one or more of nucleotide 1,740,657 (plus or minus 10, 20, 30, 50, 60, 70, 80, 100 or more nucleotides). In one embodiment, the FGFR2-TACC3 fusion is a translocation, e.g., a translocation of a portion of chromosome 10 or a portion of chromosome 4.

In certain embodiments, the FGFR2-TACC3 fusion is in a 5'-FGFR2 to 3'-TACC3 configuration (also referred to herein as "5'-FGFR2-TACC3-3')." The term "fusion" or "fusion molecule" can refer to a polypeptide or a nucleic acid fusion, depending on the context. It may include a full-length sequence of a fusion or a fragment thereof, e.g., a fusion junction (e.g., a fragment including a portion of FGFR2 and a portion of TACC3, e.g., a portion of the FGFR2-TACC3 fusion described herein). In one embodiment, the FGFR2-TACC3 fusion polypeptide includes a fragment of the amino acid sequence shown in FIG. 92 (SEQ ID NO:100) and a fragment of the amino acid sequence shown in FIG. 6 (SEQ ID NO:6), or an amino acid sequence substantially identical thereto. In another embodiment, the FGFR2-TACC3 fusion nucleic acid includes a fragment of the nucleotide sequence shown in FIG. 93 (SEQ ID NO:99) and a fragment of the nucleotide sequence shown in FIG. 5 (SEQ ID NO:5), or a nucleotide sequence substantially identical thereto. In one embodiment, the FGFR2-TACC3 fusion polypeptide comprises sufficient FGFR2 and sufficient TACC3 sequence such that the 5' FGFR2-3' TACC3 fusion has kinase activity, e.g., has elevated activity, e.g., FGFR2 tyrosine kinase activity, as compared with wild type FGFR2, e.g., in a cell of a cancer referred to herein (e.g., cholangiocarcinoma). In one embodiment, the TACC3 sequence has a coiled-coil domain, e.g., it may dimerize with one or more partners.

In certain embodiments, the FGFR2-TACC3 fusion comprises exons 1-16 from FGFR2 and exons 11-16 of TACC3 (e.g., one or more of the exons shown in FIG. 93 (SEQ ID NO:99) and FIG. 5 (SEQ ID NO:5). In another embodiment, the FGFR2-TACC3 fusion comprises exons 1-16 of FGFR2 and exons 11-16 of TACC3. In certain embodiments, the FGFR2-TACC3 fusion comprises at least one or more exons (or encoded exons) from FGFR2 and at least one or more exons (or encoded exons) from TACC3 (e.g., from the FGFR2 and TACC3 sequences shown in FIG. 93 and FIG. 92 (SEQ ID NO:99 and 100) and FIG. 5 and FIG. 6 (SEQ ID NOs:5 and 6).

In certain embodiments, the FGFR2-TACC3 fusion comprises exons 1-16 or a fragment thereof from FGFR2, and exons 1-16 or a fragment thereof from TACC3 (e.g., as shown in FIG. 93 (SEQ ID NO:99) and FIG. 5 (SEQ ID NO:5)). In one embodiment, the FGFR2-TACC3 fusion comprises at least 5, 10, 15, 20, 30, 40, 50 or more amino acids encoded by exons 1-16 of FGFR2 (e.g., from the amino acid sequence of FGFR2 as shown in FIG. 92 (SEQ ID NO:100) (e.g., from the amino acid sequence of FGFR2 preceding the fusion junction with TACC3, and at least 5, 10, 15, 20, 30, 40, 50 or more amino acids encoded by exons 11-16 of TACC3 (e.g., from the amino acid sequence of TACC3 as shown in FIG. 6 (SEQ ID NO:6)). In another embodiment, the FGFR2-TACC3 fusion comprises at least 6, 12, 15, 20, 25, 50, 75, 100 or more nucleotides from exons 1-16 of FGFR2 (e.g., from the nucleotide sequence of FGFR2 as shown in FIG. 93 (SEQ ID NO:99) (e.g., from the nucleotide sequence of FGFR2 preceding the fusion junction with TACC3); and at least 6, 12, 15, 20, 25, 50, 75, 100 or more nucleotides from exons 11-16 of TACC3 (e.g., from the nucleotide sequence of TACC3 as shown in FIG. 5 (SEQ ID NO:5)).

FGFR2-TACC3 Nucleic Acid Molecules

In one aspect, the invention features a nucleic acid molecule (e.g., an isolated or purified) nucleic acid molecule that includes a fragment of a FGFR2 gene and a fragment of a TACC3 gene. In one embodiment, the nucleotide sequence encodes a FGFR2-TACC3 fusion polypeptide that includes a FGFR2 tyrosine kinase domain or a functional fragment thereof. In another embodiment, the nucleotide sequence encodes a fragment of the TACC3 polypeptide including the amino acid sequence of SEQ ID NO:6 or a fragment thereof, or a sequence substantially identical thereto. In other embodiments, the nucleic acid molecule includes a fragment of the FGFR2 gene encoding the amino acid sequence of SEQ ID NO:100 or a fragment thereof, or a sequence substantially identical thereto. In yet other embodiments, the nucleic acid molecule includes a nucleotide sequence encoding the amino acid sequence shown in FIG. 92 (SEQ ID NO:100), or a fragment thereof, and the amino acid sequence shown in FIG. 6 (SEQ ID NO:6) or a fragment thereof, or a sequence substantially identical thereto.

In one embodiment, the nucleic acid molecule includes a fusion, e.g., an in-frame fusion, between an intron of FGFR2 (e.g., intron 1, or a fragment thereof), and an intron of TACC3 (e.g., intron 1, or a fragment thereof). The FGFR2-TACC3 fusion can comprise a fusion of the nucleotide sequence of: chromosome 10 at one or more of nucleotide 123,243,122 (plus or minus 10, 20, 30, 50, 60, 70, 80, 100 nucleotides) and chromosome 4 at one or more of nucleotide 1,740,657 (plus or minus 10, 20, 30, 50, 60, 70, 80, 100 nucleotides), or a fragment thereof. In one embodiment, the FGFR2-TACC3 fusion comprises a fusion of the nucleotide sequence of: chromosome 10 at one or more of nucleotide 123,243,122 (plus or minus 10, 20, 30, 50, 60, 70, 80, 100 nucleotides) and chromosome 4 at one or more of nucleotide 1,740,657 (plus or minus 10, 20, 30, 50, 60, 70, 80, 100 nucleotides), or a fragment thereof.

In another embodiment, the FGFR2-TACC3 fusion comprises a nucleotide sequence (e.g., a fragment of a nucleotide sequence) shown in FIG. 93 (SEQ ID NO:99) and a nucleotide sequence (e.g., a fragment of a nucleotide sequence) shown in FIG. 5 (SEQ ID NO:5), or a fragment of the fusion. In one embodiment, the FGFR2-TACC3 fusion comprises a nucleotide sequence substantially identical to the nucleotide sequence (e.g., a fragment of a nucleotide sequence) shown in FIG. 93 (SEQ ID NO:99) and the nucleotide sequence (e.g., a fragment of a nucleotide sequence) shown FIG. 5 (SEQ ID NO:5), or a fragment of the fusion. In one embodiment, the FGFR2-TACC3 fusion comprises a nucleotide sequence at least 70%, at least 75%, at least 80%, at least 85%, at least 90%, at least 95%, at least 99%, at least 99.5 or greater, identical to the nucleotide sequence (e.g., a fragment of a nucleotide sequence) shown in FIG. 93 (SEQ ID NO:99) and to the nucleotide sequence (e.g., a fragment of a nucleotide sequence) shown in FIG. 5 (SEQ ID NO:5). In one embodiment, the FGFR2-TACC3 fusion comprises a nucleotide sequence containing at least 25, 50, 100, 150, 200, 500, 1000, 1500, 2000, 2500, 3000, or more nucleotides of the nucleotide sequence shown in FIG. 93 (SEQ ID NO:99) and a nucleotide sequence containing at least 25, 50, 100, 150, 200, 500, 1000, 1500, 2000, 2500, 3000, or more nucleotides of the nucleotide sequence shown in FIG. 5 (SEQ ID NO:5). In one embodiment, the FGFR2-TACC3 fusion comprises a nucleotide sequence containing at least 25, 50, 100, 150, 200, 500, 1000, 1500, 2000, 2500, 3000, or more contiguous nucleotides of the nucleotide sequence shown in FIG. 93 (SEQ ID NO:99) and a nucleotide sequence containing at least 25, 50, 100, 150, 200, 500, 1000, 1500, 2000, 2500, 3000, or more nucleotides of the nucleotide sequence shown in FIG. 5 (SEQ ID NO:5).

In another embodiment, the nucleic acid molecule includes a fusion, e.g., an in-frame fusion, of at least exons 1-16 of FGFR2 or a fragment thereof (e.g., exons 1-16 of FGFR2 or a fragment thereof), and at least exons 11-16 or a fragment thereof (e.g., exons 11-16 of TACC3 or a fragment thereof). In yet other embodiments, the nucleic acid molecule includes a fragment the nucleotide sequence shown in FIG. 93 (SEQ ID NO:99) and a fragment of the nucleotide sequence shown in FIG. 5 (SEQ ID NO:5) or a fragment of the fusion, or a sequence substantially identical thereto.

In one embodiment, the nucleic acid molecule is complementary to at least a portion of a nucleotide sequence disclosed herein, e.g., is capable of hybridizing under a stringency condition described herein to SEQ ID NO:99 and/or SEQ ID NO:5, or a fragment thereof. In yet another embodiment, the nucleic acid molecule hybridizes to a nucleotide sequence that is complementary to at least a portion of a nucleotide sequence disclosed herein, e.g., is capable of hybridizing under a stringency condition to a nucleotide sequence complementary to SEQ ID NO:99 and/or SEQ ID NO:5, or a fragment thereof. The nucleotide sequence of a cDNA encoding an exemplary 5' FGFR2-3' TACC3 fusion is shown in at least exons 1-16 (e.g., exons 1-16) of SEQ ID NO:99 and at least exons 11-16 (e.g., exons 11-16) of SEQ ID NO:5, and the predicted amino acid sequence is shown in the corresponding encoded exons of SEQ ID NO:100 and the corresponding encoded exons of SEQ ID NO:6, respectively.

In an embodiment the FGFR2-TACC3 nucleic acid molecule comprises sufficient FGFR2 and sufficient TACC3 sequence such that the encoded 5' FGFR2-3' TACC3 fusion has kinase activity, e.g., has elevated activity, e.g., FGFR2 kinase activity, as compared with wild type FGFR2, e.g., in a cell of a cancer referred to herein. In certain embodiments, the 5' FGFR2-3' TACC3 fusion comprises exons 1-16 from FGFR2 and exons 1-16 from TACC3. In certain embodiments, the FGFR2-TACC3 fusion comprises at least 1 or more exons from FGFR2 and at least 1 or more, exons from TACC3. In certain embodiments, the FGFR2-TACC3 fusion comprises a fusion of exons 1-16 from FGFR2 and exons 1-16 from TACC3. In another embodiment, the FGFR2-TACC3 fusion comprises at least 1 exon from FGFR2; and at least 1 exon from TACC3.

In one embodiment, the nucleic acid molecule includes a nucleotide sequence that has an in-frame fusion of intron 1 of FGFR2 (e.g., NM_001144915) with intron 1 of TACC3 (e.g., NM_006342). In another embodiment, the nucleic acid molecule includes a nucleotide sequence that includes a breakpoint. For example, the nucleic acid molecule includes a nucleotide sequence that includes the fusion junction between the FGFR2 gene and the TACC3 gene, e.g., the breakpoint between intron 1 of FGFR2 and intron 1 of TACC3. In other embodiments, the nucleic acid molecules includes a nucleotide sequence of one or more of nucleotide 123,243,122 of chromosome 10 coupled to (e.g., directly or indirectly juxtaposed to) one or more of nucleotide 1,740,657 of chromosome 4. In one embodiment, the nucleic acid molecule includes the nucleotide sequence of: chromosome 10 at one or more of nucleotide 123,243,122 plus or minus 10, 20, 30, 40 50, 60, 80, 100, 150 nucleotides and chromosome 4 at one or more of nucleotide 1,740,657 plus or minus 10, 20, 30, 40 50, 60, 80, 100, 150 nucleotides (corresponding to the breakpoint of a FGFR2-TACC3 fusion), or a fragment thereof, or a sequence substantially identical thereto. In one embodiment, the nucleic acid molecule is complementary to at least a portion of a nucleotide sequence disclosed herein, e.g., is capable of hybridizing under a stringency condition described herein to SEQ ID NO:99 and/or SEQ ID NO:5 or a fragment thereof. In yet other embodiment, the nucleic acid molecule hybridizes to a nucleotide sequence that is complementary to at least a portion of a nucleotide sequence disclosed herein, e.g., is capable of hybridizing under a stringency condition described herein to a nucleotide sequence complementary to SEQ ID NO:99 or 5 or a fragment thereof.

In another embodiment, the FGFR2-TACC3 fusion nucleic acid comprises at least 6, 12, 15, 20, 25, 50, 75, 100 or more nucleotides from exons 1-16 of FGFR2 (e.g., from the nucleotide sequence of FGFR2 preceding the fusion junction with TACC3, e.g., of the FGFR2 sequence shown in FIG. 93 (SEQ ID NO:99)), and at least 6, 12, 15, 20, 25, 50, 75, 100 or more nucleotides from exons 11-16 of TACC3 (e.g., from the nucleotide sequence of TACC3 following the fusion junction with FGFR2, e.g., of the TACC3 sequence shown in FIG. 5 (SEQ ID NO:5)).

In other embodiments, the nucleic acid molecule includes a nucleotide sequence encoding a FGFR2-TACC3 fusion polypeptide that includes a fragment of a FGFR2 gene and a fragment of an TACC3 gene. In one embodiment, the nucleotide sequence encodes a FGFR2-TACC3 fusion polypeptide that includes e.g., an FGFR2 tyrosine kinase domain or a functional fragment thereof. In yet other embodiments, the nucleic acid molecule includes a nucleotide sequence encoding the amino acid sequence (e.g., a fragment of the amino acid sequence) shown in FIG. 92 (e.g., SEQ ID NO:100) and a nucleotide sequence encoding the amino acid sequence (e.g., a fragment of the amino acid sequence) shown in FIG. 6 (e.g., SEQ ID NO:6), or a fragment of the fusion, or a sequence substantially identical thereto. In one embodiment, the encoded FGFR2-TACC3 fusion polypeptide includes an FGFR2 tyrosine kinase domain or a functional fragment thereof.

In a related aspect, the invention features nucleic acid constructs that include the FGFR2-TACC3 nucleic acid molecules described herein. In certain embodiments, the nucleic acid molecules are operatively linked to a native or a heterologous regulatory sequence. Also included are vectors and host cells that include the FGFR2-TACC3 nucleic acid molecules described herein, e.g., vectors and host cells suitable for producing the nucleic acid molecules and polypeptides described herein.

In a related aspect, methods of producing the nucleic acid molecules and polypeptides described herein are also described.

In another aspect, the invention features nucleic acid molecules that reduce or inhibit the expression of a nucleic acid molecule that encodes a FGFR2-TACC3 fusion described herein. Examples of such nucleic acid molecules include, for example, antisense molecules, ribozymes, RNAi, triple helix molecules that hybridize to a nucleic acid encoding FGFR2-TACC3, or a transcription regulatory region of FGFR2-TACC3, and blocks or reduces mRNA expression of FGFR2-TACC3.

Nucleic Acid Detection and Capturing Reagents

The invention also features a nucleic acid molecule, e.g., nucleic acid fragment, suitable as probe, primer, bait or library member that includes, flanks, hybridizes to, which are useful for identifying, or are otherwise based on, the FGFR2-TACC3 fusions described herein. In certain embodiments, the probe, primer or bait molecule is an oligonucleotide that allows capture, detection or isolation of a FGFR2-TACC3 fusion nucleic acid molecule described herein. The oligonucleotide can comprise a nucleotide sequence substantially complementary to a fragment of the FGFR2-TACC3 fusion nucleic acid molecules described herein. The sequence identity between the nucleic acid fragment, e.g., the oligonucleotide, and the target FGFR2-TACC3 sequence need not be exact, so long as the sequences are sufficiently complementary to allow the capture, detection or isolation of the target sequence. In one embodiment, the nucleic acid fragment is a probe or primer that includes an oligonucleotide between about 5 and 25, e.g., between 10 and 20, or 10 and 15 nucleotides in length. In other embodiments, the nucleic acid fragment is a bait that includes an oligonucleotide between about 100 to 300 nucleotides, 130 and 230 nucleotides, or 150 and 200 nucleotides, in length.

In one embodiment, the nucleic acid fragment can be used to identify or capture, e.g., by hybridization, a FGFR2-TACC3 fusion. For example, the nucleic acid fragment can be a probe, a primer, or a bait, for use in identifying or capturing, e.g., by hybridization, a FGFR2-TACC3 fusion described herein. In one embodiment, the nucleic acid fragment can be useful for identifying or capturing a FGFR2-TACC3 breakpoint, e.g., the nucleotide sequence of: chromosome 10 at nucleotide 123,243,122 plus or minus 10, 20, 30, 40 50, 60, 80, 100, 150 nucleotides and chromosome 4 at nucleotide 1,740,657 plus or minus 10, 20, 30, 40 50, 60, 80, 100, 150 nucleotides.

In one embodiment, the nucleic acid fragment hybridizes to a nucleotide sequence within a chromosomal rearrangement that creates an in-frame fusion of intron 1 of FGFR2 with intron 1 of TACC3. In one embodiment, the nucleic acid fragment hybridizes to a nucleotide sequence in the region In other embodiments, the nucleic acid molecules includes a nucleotide sequence in the region of nucleotides 123,243,122 of chromosome 10 coupled to (e.g., juxtaposed to) nucleotides in the region of nucleotides 1,740,657 of chromosome 4. In one embodiment, the nucleic acid fragment hybridizes to a nucleotide sequence that includes a breakpoint, e.g., the nucleotide sequence of: chromosome 10 at nucleotide 123,243,122 plus or minus 10, 20, 30, 40 50, 60, 80, 100, 150 or more nucleotides and chromosome 4 at nucleotide 1,740,657 plus or minus 10, 20, 30, 40 50, 60, 80, 100, 150 or more nucleotides. For example, the nucleic acid fragment can hybridize to a nucleotide sequence that includes the fusion junction between the FGFR2 gene and the TACC3 gene, e.g., a nucleotide sequence that includes a portion of a nucleotide sequence within introns 14 of a FGFR2 gene and 11 of a TACC3 gene.

In another embodiment, the nucleic acid fragment hybridizes to a nucleotide sequence that comprises at least 6, 12, 15, 20, 25, 50, 75, 100, 150 or more nucleotides from exons 1-16 of FGFR2 (e.g., from the nucleotide sequence of FGFR2 preceding the fusion junction with TACC3, e.g., of the FGFR2 sequence shown in FIG. 93 (SEQ ID NO:99)), and at least 6, 12, 15, 20, 25, 50, 75, 100, 150 or more nucleotides from exons 1-16 of TACC3 (e.g., from the nucleotide sequence of TACC3 following the fusion junction with FGFR2, e.g., of the TACC3 sequence shown in FIG. 5 (SEQ ID NO:5)).

The probes or primers described herein can be used, for example, for FISH detection or PCR amplification. In one exemplary embodiment where detection is based on PCR, amplification of the FGFR2-TACC3 fusion junction fusion junction can be performed using a primer or a primer pair, e.g., for amplifying a sequence flanking the fusion junctions described herein, e.g., the mutations or the junction of a chromosomal rearrangement described herein, e.g., FGFR2-TACC3.

In one embodiment, a pair of isolated oligonucleotide primers can amplify a region containing or adjacent to a position in the FGFR2-TACC3 fusion. For example, forward primers can be designed to hybridize to a nucleotide sequence within FGFR2 genomic or mRNA sequence (e.g., a nucleotide sequence within exons 1-16 of FGFR2 of SEQ ID NO:99), and the reverse primers can be designed to hybridize to a nucleotide sequence of TACC3 (e.g., a nucleotide sequence within exons 11-16 of TACC3, of SEQ ID NO:5).

In another embodiment, the nucleic acid fragments can be used to identify, e.g., by hybridization, a FGFR2-TACC3 fusion. In one embodiment, the nucleic acid fragment hybridizes to a nucleotide sequence that includes a fusion junction between the FGFR2 transcript and the TACC3 transcript.

In other embodiments, the nucleic acid fragment includes a bait that comprises a nucleotide sequence that hybridizes to a FGFR2-TACC3 fusion nucleic acid molecule described herein, and thereby allows the capture or isolation said nucleic acid molecule. In one embodiment, a bait is suitable for solution phase hybridization. In other embodiments, a bait includes a binding entity, e.g., an affinity tag, that allows capture and separation, e.g., by binding to a binding entity, of a hybrid formed by a bait and a nucleic acid hybridized to the bait.

In other embodiments, the nucleic acid fragment includes a library member comprising a FGFR2-TACC3 nucleic acid molecule described herein. In one embodiment, the library member includes a rearrangement that results in a FGFR2-TACC3 fusion described herein.

The nucleic acid fragment can be detectably labeled with, e.g., a radiolabel, a fluorescent label, a bioluminescent label, a chemiluminescent label, an enzyme label, a binding pair label, or can include an affinity tag; a tag, or identifier (e.g., an adaptor, barcode or other sequence identifier).

FGFR2-TACC3 Fusion Polypeptides

In another embodiment, the FGFR2-TACC3 fusion comprises an amino acid sequence (e.g., a fragment of the amino acid sequence) shown in FIG. 92 (SEQ ID NO:100) and an amino acid sequence (e.g., a fragment of the amino acid sequence) shown in FIG. 6 (SEQ ID NO:6), or a fragment of the fusion. In one embodiment, the FGFR2-TACC3 fusion comprises an amino acid sequence substantially identical to the amino acid sequence (e.g., a fragment of the amino acid sequence) shown in FIG. 92 (SEQ ID NO:100) and the amino acid sequence (e.g., a fragment of the amino acid sequence) shown in FIG. 6 (SEQ ID NO:6), or a fragment thereof. In one embodiment, the FGFR2-TACC3 fusion comprises an amino acid sequence at least 70%, at least 75%, at least 80%, at least 85%, at least 90%, at least 95%, at least 99%, at least 99.5 or greater, identical to the amino acid sequence (e.g., a fragment of the amino acid sequence) shown in FIG. 92 (SEQ ID NO:100) and the amino acid sequence (e.g., a fragment of the amino acid sequence) shown in FIG. 6 (SEQ ID NO:6). In one embodiment, the FGFR2-TACC3 fusion comprises a sequence containing at least 10, 20, 50, 100, 500, 600, 700, 800, 900, 1000, or more amino acids of the amino acid sequence shown in FIG. 92 (SEQ ID NO:100) and FIG. 6 (SEQ ID NO:6). In one embodiment, the FGFR2-TACC3 fusion comprises an amino acid sequence containing at least 5, 10, 20, 50, 100, 500, 600, 700, 800, 900, 1000, or more contiguous amino acids of the amino acid sequence shown in FIG. 92 (SEQ ID NO:100) and at least 5, 10, 20, 50, 100, 500, 600, 700, 800, 900, 1000, or more contiguous amino acids of the amino acid sequence shown in FIG. 6 (SEQ ID NO:6). In one embodiment, the FGFR2-TACC3 fusion polypeptide includes a FGFR2 receptor tyrosine kinase domain or a functional fragment thereof. In an embodiment, the FGFR2-TACC3 fusion polypeptide comprises sufficient TACC3 and sufficient FGFR2 sequence such that it has kinase activity, e.g., has elevated activity, e.g., FGFR2 kinase activity, as compared with wild type FGFR2, e.g., in a cell of a cancer referred to herein.

In another aspect, the invention features a FGFR2-TACC3 fusion polypeptide (e.g., a purified FGFR2-TACC3 fusion polypeptide), a biologically active or antigenic fragment thereof, as well as reagents (e.g., antibody molecules that bind to a FGFR2-TACC3 fusion polypeptide), methods for modulating a FGFR2-TACC3 polypeptide activity and detection of a FGFR2-TACC3 polypeptide.

In one embodiment, the FGFR2-TACC3 fusion polypeptide has at least one biological activity, e.g., an FGFR2 kinase activity. In one embodiment, at least one biological activity of the FGFR2-TACC3 fusion polypeptide is reduced or inhibited by an anti-cancer drug, e.g., a kinase inhibitor (e.g., a multikinase inhibitor or an FGFR2-specific inhibitor). In one embodiment, at least one biological activity of the FGFR2-TACC3 fusion polypeptide is reduced or inhibited by an FGFR2 kinase inhibitor chosen from e.g., BIBF1120 (Vargatef); Panatinib (AP24534); AZD4547; BGJ398 (NVP-BGJ398); or Brivanib alaninate (BMS-582664).

In yet other embodiments, the FGFR2-TACC3 fusion polypeptide is encoded by a nucleic acid molecule described herein. In one embodiment, the FGFR2-TACC3 fusion polypeptide is encoded by an in-frame fusion of intron 1 of FGFR2 with intron 1 of TACC3. In another embodiment, the FGFR2-TACC3 fusion polypeptide includes an amino acid sequence encoded by a nucleotide sequence comprising a fusion junction between the FGFR2 transcript and the TACC3 transcript.

In certain embodiments, the FGFR2-TACC3 fusion polypeptide comprises one or more of encoded exons 1-16 from FGFR2 and one or more of encoded exons 11-16 of TACC3. In certain embodiments, the FGFR2-TACC3 fusion polypeptide comprises at least 1 or more encoded exons from FGFR2 and at least 1, 2, 3, 4, 5, 6, 7, 8, 9, 10, 11, 12, 13, 14, 15, 16 or more, encoded exons from TACC3. In certain embodiments, the FGFR2-TACC3 fusion polypeptide comprises a fusion of encoded exons 1-16 from FGFR2 and encoded exons 11-16 from TACC3 (or a fragment thereof). In other embodiments, the fusion comprises least 1 encoded exon from FGFR2; and at least 1, 2, 3, 4, 5, 6 encoded exons from TACC3. In certain embodiments, the FGFR2-TACC3 fusion polypeptide comprises encoded exons 1-16 from FGFR2 and exons 11-16 of TACC3. In certain embodiments, the 5' FGFR2-3' TACC3 fusion polypeptide comprises a fusion junction of the sequence of exons 1-16 from FGFR2 and the sequence of exons 11-16 from TACC3.

In certain embodiments, the FGFR2-TACC3 fusion comprises the amino acid sequence corresponding to exons 1-16 or a fragment thereof from FGFR2, and the amino acid sequence corresponding to exons 11-16 or a fragment thereof from TACC3 (e.g., as shown in FIG. 92 (SEQ ID NO:100) and FIG. 6 (SEQ ID NO:6)). In one embodiment, the FGFR2-TACC3 fusion comprises at least 5, 10, 15, 20 or more amino acids from exons 1-16 of FGFR2 (e.g., from the amino acid sequence of FGFR2 preceding the fusion junction with TACC3, e.g., of the FGFR2 sequence shown in FIG. 92 (SEQ ID NO:100)), and at least 5, 10, 15, 20 or more amino acids from exons 11-16 of TACC3 (e.g., from the amino acid sequence of TACC3 following the fusion junction with FGFR2, e.g., of the TACC3 sequence shown in FIG. 6 (SEQ ID NO:6)).

In one embodiment, the FGFR2-TACC3 fusion polypeptide includes a FGFR2 tyrosine kinase domain or a functional fragment thereof. In a related aspect, the invention features FGFR2-TACC3 fusion polypeptide or fragments operatively linked to heterologous polypeptides to form fusion proteins.

In another embodiment, the FGFR2-TACC3 fusion polypeptide or fragment is a peptide, e.g., an immunogenic peptide or protein, that contains a fusion junction described herein. Such immunogenic peptides or proteins can be used to raise antibodies specific to the fusion protein. In other embodiments, such immunogenic peptides or proteins can be used for vaccine preparation. The vaccine preparation can include other components, e.g., an adjuvant.

In another aspect, the invention features antibody molecules that bind to a FGFR2-TACC3 fusion polypeptide or fragment described herein. In embodiments, the antibody can distinguish wild type TACC3 (or FGFR2) from FGFR2-TACC3.

Detection Reagents and Detection of Mutations

In another aspect, the invention features a detection reagent, e.g., a purified or an isolated preparation thereof. Detection reagents can distinguish a nucleic acid, or protein sequence, having a breakpoint, e.g., a FGFR2-TACC3 breakpoint; from a reference sequence. In one embodiment, the detection reagent detects (e.g., specifically detects) a FGFR2-TACC3 fusion nucleic acid or a polypeptide (e.g., distinguishes a wild type TACC3 or another TACC3 fusion (or FGFR2) from a FGFR2-TACC3 nucleic acid (e.g., as described herein in FIG. 93 (SEQ ID NO:99) and FIG. 5 (SEQ ID NO:5); or a FGFR2-TACC3 polypeptide (e.g., as described herein in FIG. 92 (SEQ ID NO:100) and FIG. 6 (SEQ ID NO:6).

Detection reagents, e.g., nucleic acid-based detection reagents, can be used to identify mutations in a target nucleic acid, e.g., DNA, e.g., genomic DNA or cDNA, or RNA, e.g., in a sample, e.g., a sample of nucleic acid derived from a neoplastic or tumor cell, e.g., a melanocytic neoplasm, melanoma or metastatic cell. Detection reagents, e.g., antibody-based detection reagents, can be used to identify mutations in a target protein, e.g., in a sample, e.g., a sample of protein derived from, or produced by, a neoplastic or tumor cell, e.g., a melanocytic neoplasm, melanoma or metastatic cell.

Method of Treatment

The FGFR family plays an important role in cell differentiation, growth and angiogenesis, and gain of function mutations in FGFRs have been reported in several cancer types (Powers C J, McLeskey S W, Wellstein A (2000) Fibroblast growth factors, their receptors and signaling. Endocr Relat Cancer 7(3):165-97, Eswarakumar V P, Lax I, Schlessinger J (2005) Cellular signaling by fibroblast growth factor receptors. Cytokine Growth Factor Rev 16(2):139-49). The FGFR2-TACC3 fusion has not been reported. However, similar FGFR3-TACC3 fusions have been previously reported in glioblastoma and in a bladder cancer cell line; these fusions were found to be activating and to have transformative potential (Williams S V, Hurst C D, Knowles M A (2012) Oncogenic FGFR3 gene fusions in bladder cancer. Hum Mol Genet ePub December 2012, Singh et al., 2012; 22837387). The FGFR2-TACC3 fusion may therefore be oncogenic. FGFR2 amplification has also been reported in several cancer types, most frequently in gastric cancer (3-4%) and breast cancer (1-11%) (Matsumoto K, Arao T, Hamaguchi T, et al. (2012) FGFR2 gene amplification and clinicopathological features in gastric cancer. Br J Cancer 106(4):727-32, Hara T, Ooi A, Kobayashi M, et al. (1998) Amplification of c-myc, K-sam, and c-met in gastric cancers: detection by fluorescence in situ hybridization. Lab Invest 78(9):1143-53, Heiskanen M, Kononen J, Bärlund M, et al. (2001) CGH, cDNA and tissue microarray analyses implicate FGFR2 amplification in a small subset of breast tumors. Anal Cell Pathol 22(4):229-34, Adnane J, Gaudray P, Dionne C A, et al. (1991) BEK and FLG, two receptors to members of the FGF family, are amplified in subsets of human breast cancers. Oncogene 6(4):659-63, Turner N, Lambros M B, Horlings H M, et al. (2010) Integrative molecular profiling of triple negative breast cancers identifies amplicon drivers and potential therapeutic targets.

Oncogene 29(14):2013-23). Fgfr2 has been shown to be expressed in cholangiocarcinoma, leading to activation of the MEK1/2 pathway (Narong S, Leelawat K (2011) Basic fibroblast growth factor induces cholangiocarcinoma cell migration via activation of the MEK1/2 pathway. Oncol Lett 2(5):821-825). Regorafenib, which inhibits cellular kinases including Fgfr2, has been approved for treatment of some metastatic colorectal cancer (mCRC) patients. The multi-kinase inhibitor ponatinib (AP24534), recently approved by the FDA for use in chronic myelogenous leukemia based on the results of a Phase 2 trial, has also been shown in preclinical studies to have substantial activity against all four Fgfr kinases (Cortes J E, Kim, D-W, Pinilla-Ibarz J et al. (2012) A Pivotal Phase 2 Trial of Ponatinib in Patients with Chronic Myeloid Leukemia (CML) and Philadelphia Chromosome-Positive Acute Lymphoblastic Leukemia (Ph+ ALL) Resistant or Intolerant to Dasatinib or Nilotinib, or with the T315I BCR-ABL Mutation: 12-Month Follow-up of the PACE Trial American Society of Hematology ASH 2012, Abstract 163, Gozgit J M, Wong M J, Moran L, et al. (2012) Ponatinib (AP24534), a multitargeted pan-FGFR inhibitor with activity in multiple FGFR-amplified or mutated cancer models. Mol Cancer Ther 11(3):690-9). Clinical trials of multiple Fgfr inhibitors are currently underway (Turner N, Grose R (2010) Fibroblast growth factor signalling: from development to cancer. Nat Rev Cancer 10(2):116-29).

Ponatinib is a multi-kinase inhibitor targeting BCR-ABL, as well as VEGFRs and FGFRs. Ponatinib has been approved by the FDA for use in chronic myeloid leukemia (CML) and Philadelphia chromosome-positive acute lymphoblastic leukemia (ALL). Activating mutations or amplification of FGFR2 may predict sensitivity to ponatinib (Gozgit J M, Wong M J, Moran L, et al. (2012) Ponatinib (AP24534), a multitargeted pan-FGFR inhibitor with activity in multiple FGFR-amplified or mutated cancer models. Mol Cancer Ther 11(3):690-9).

Regorafenib is a multi-kinase inhibitor that inhibits multiple membrane-bound and intracellular kinases, including those in the RET, VEGFR1/2/3, KIT, PDGFR, FGFR1/2, and RAF pathways. Regorafenib has been approved to treat patients with metastatic colorectal cancer who have been previously treated with fluoropyrimidine-, oxaliplatin-, and irinotecan-based chemotherapy, an anti-VEGF therapy, and, if KRAS wild type, an anti-EGFR therapy. Tumors with Fgfr2 activation may be sensitive to regorafenib. Regorafenib is being studied in clinical trials for multiple solid tumor types.

Accordingly, in another aspect, a method of inhibiting, reducing, or treating a hyperproliferative disorder, e.g., a neoplasm (including benign, pre-malignant or malignant (e.g., a cancer), in a subject is provided. The method includes administering to the subject a preselected therapeutic agent, e.g., an anti-cancer agent (e.g., an inhibitor), as a single agent, or in combination, in an amount sufficient to reduce, inhibit or treat the activity or expression of FGFR2-TACC3 (e.g., a FGFR2-TACC3 fusion described herein), thereby inhibiting, reducing, or treating the hyperproliferative disorder in the subject.

In one embodiment, the subject treated has a FGFR2-TACC3 fusion; e.g., the subject has a tumor or cancer harboring a FGFR2-TACC3 fusion. In other embodiments, the subject has been previously identified as having a FGFR2-TACC3 fusion. In yet other embodiments, the subject has been previously identified as being likely or unlikely to respond to treatment with a protein kinase inhibitor, e.g., a subject that has previously participated in a clinical trial. In other embodiments, the subject has been previously identified as being likely or unlikely to respond to treatment with a protein kinase inhibitor, based on the presence of the FGFR2-TACC3 fusion. In one embodiment, the subject is a mammal, e.g., a human. In one embodiment, the subject has, or at risk of having a cancer at any stage of disease. In other embodiments, the subject is a patient, e.g., a cancer patient.

In certain embodiments, the neoplasm or neoplastic cell is a benign, pre-malignant, malignant (cancer) or metastasis. In certain embodiments, the cancer is a solid tumor, a soft tissue tumor, or a metastatic lesion.

In one embodiment, the neoplasm or neoplastic cell is a benign, pre-malignant, malignant (cancer) or metastasis. In certain embodiments, the cancer is a solid tumor, a soft tissue tumor, or a metastatic lesion. In certain embodiments, the cancer is ac carcinoma, e.g., cholangiocarcinoma. In one embodiment, the cancer is an urothelial (transitional cell) carcinoma. In one embodiment, the cancer is chosen from a lung cancer, a pancreatic cancer, melanoma, a colorectal cancer, an esophageal-gastric cancer, a thyroid cancer, or an adenocarcinoma. In other embodiment, the lung cancer is chosen from one or more of the following: non-small cell lung cancer (NSCLC), small cell lung cancer (SCLC), squamous cell carcinoma (SCC), adenocarcinoma of the lung, bronchogenic carcinoma, or a combination thereof. In one embodiment, the lung cancer is NSCLC or SCC. In certain embodiments, the cancer is a sarcoma, e.g., a cholangiosarcoma, e.g., a liver cholangiosarcoma.

In certain embodiments, the cancer is a cholangiocarcinoma. In some embodiments, such cancers of the bile ducts can arise within the liver as an intrahepatic cholangiocarcinoma (ICC) or originate from extrahepatic bile ducts as a bile duct carcinoma also referred to as an extrahepatic cholangiocarcinoma. ICC is the second most common primary hepatic malignancy after hepatocellular carcinoma (HCC) and accounts for 3% of the malignant tumors of the gastrointestinal system and 15% of primary hepatic malignancies. In that ICC has a routine histologic appearance of an adenocarcinoma, the diagnosis of ICC on a liver biopsy requires an immunohistochemical (IHC) study of the tumor and a thorough clinical workup including imaging studies to rule out a metastatic adenocarcinoma to the liver. ICC is associated with primary sclerosing cholangitis, parasitic biliary infection, polycystic disease of the liver, congenital intrahepatic bile duct dilatation (Caroli's Disease), congenital hepatic fibrosis, and choledochal cysts. Chronic Hepatitis C infection is an established cause of ICC with some studies describing a more than 300 fold increase in ICC incidence in patients with long-standing Hepatitis C infections. ICC has also been associated with cigarette smoking, alcohol consumption and exposure to a variety of toxins and chemical carcinogens. In one embodiment, the anti-cancer agent is a kinase inhibitor. For example, the kinase inhibitor is a multi-kinase inhibitor, an FGF receptor inhibitor (e.g., a pan FGFR2 inhibitor), or a FGFR2-specific inhibitor. In one embodiment, the kinase inhibitor is chosen from one or more of: BIBF1120 (Vargatef); Panatinib (AP24534); AZD4547; BGJ398 (NVP-BGJ398); Brivanib alaninate (BMS-582664), AZD-4547; Regorafenib; Masitinib; Lenvatinib; Dovitinib; Brivanib; Ponatinib; ENMD-2076; AZD-2171 (Cediranib); BIBF1120; LY2874455; and/or JNJ42756493.

In one embodiment, the therapeutic agent is an agent that binds and inhibits FGFR2 or TACC3. For example, the therapeutic agent is an antibody molecule (e.g., a monoclonal antibody) against FGFR2; and/or a small molecule (e.g., kinase) inhibitor that is selective for FGFR2 or TACC3.

In another embodiment, the therapeutic agent is selected from antisense molecules, ribozymes, RNAi, triple helix molecules that hybridize to a nucleic acid encoding the fusion, or a transcription regulatory region that blocks or reduces mRNA expression of the fusion. In some embodiments the FGFR2 inhibitor is a FGFR2 inhibitor described herein.

FGFR2-KIAA1598 Fusions

In one embodiment, a fusion includes an in-frame fusion of an exon of fibroblast growth factor receptor 2 (FGFR2), e.g., one more exons of FGFR2 (e.g., exons 1-16 of FGFR2) or a fragment thereof, and an exon of melanoma antigen family E, 1 (KIAA1598), e.g., one or more exons of a KIAA1598 (e.g., exons 7-17 of KIAA1598) or a fragment thereof. For example, the FGFR2-KIAA1598 fusion can include an in-frame fusion within an intron of FGFR2 (e.g., intron 16) or a fragment thereof, with an intron of KIAA1598 (e.g., intron 6) or a fragment thereof. In one embodiment, the fusion of the FGFR2-KIAA1598 fusion comprises the nucleotide sequence of: chromosome 10 at one or more of nucleotide 123,242,122 (plus or minus 10, 20, 30, 50, 60, 70, 80, 100 or more nucleotides) and chromosome 10 at one or more of nucleotide 1,740,657 (plus or minus 10, 20, 30, 50, 60, 70, 80, 100 or more nucleotides). In one embodiment, the FGFR2-KIAA1598 fusion is a translocation, e.g., a deletion of a portion of chromosome 10.

In certain embodiments, the FGFR2-KIAA1598 fusion is in a 5'-FGFR2 to 3'-KIAA1598 configuration (also referred to herein as "5'-FGFR2-KIAA1598-3')." The term "fusion" or "fusion molecule" can refer to a polypeptide or a nucleic acid fusion, depending on the context. It may include a full-length sequence of a fusion or a fragment thereof, e.g., a fusion junction (e.g., a fragment including a portion of FGFR2 and a portion of KIAA1598, e.g., a portion of the FGFR2-KIAA1598 fusion described herein). In one embodiment, the FGFR2-KIAA1598 fusion polypeptide includes a fragment of the amino acid sequence shown in FIG. 92 (SEQ ID NO:100) and a fragment of the amino acid sequence shown in FIG. 96 (SEQ ID NO:104), or an amino acid sequence substantially identical thereto. In another embodiment, the FGFR2-KIAA1598 fusion nucleic acid includes a fragment of the nucleotide sequence shown in FIG. 93 (SEQ ID NO:99) and a fragment of the nucleotide sequence shown in FIG. 95 (SEQ ID NO:103), or a nucleotide sequence substantially identical thereto. In one embodiment, the FGFR2-KIAA1598 fusion polypeptide comprises sufficient FGFR2 and sufficient KIAA1598 sequence such that the 5' FGFR2-3' KIAA1598 fusion has kinase activity, e.g., has elevated activity, e.g., FGFR2 tyrosine kinase activity, as compared with wild type FGFR2, e.g., in a cell of a cancer referred to herein (e.g., carcinoma, e.g., a cholangiocarcinoma, e.g., a liver cholangiocarcinoma; a sarcoma, e.g., a liver cholangiosarcoma).

In certain embodiments, the FGFR2-KIAA1598 fusion comprises exons 1-16 from FGFR2 and exons 7-17 of KIAA1598 (e.g., one or more of the exons shown in FIG. 93 (SEQ ID NO:99) and FIG. 95 (SEQ ID NO:103). In another embodiment, the FGFR2-KIAA1598 fusion comprises exons 1-16 of FGFR2 and exons 7-17 of KIAA1598. In certain embodiments, the FGFR2-KIAA1598 fusion comprises at least one or more exons (or encoded exons) from FGFR2 and at least one or more exons (or encoded exons) from KIAA1598 (e.g., from the FGFR2 and KIAA1598 sequences shown in FIG. 93 and FIG. 92 (SEQ ID NO:99 and 100) and FIG. 95 and FIG. 96 (SEQ ID NOs:103 and 104).

In certain embodiments, the FGFR2-KIAA1598 fusion comprises exon 1 or a fragment thereof from FGFR2, and exon 1 or a fragment thereof from KIAA1598 (e.g., as shown in FIG. 93 (SEQ ID NO:99) and FIG. 95 (SEQ ID NO:103)). In one embodiment, the FGFR2-KIAA1598 fusion comprises at least 5, 10, 15, 20, 30, 40, 50 or more amino acids encoded by exons 1-16 of FGFR2 (e.g., from the amino acid sequence of FGFR2 as shown in FIG. 92 (SEQ ID NO:100) (e.g., from the amino acid sequence of FGFR2 preceding the fusion junction with KIAA1598, and at least 5, 10, 15, 20, 30, 40, 50 or more amino acids encoded by exons 7-17 of KIAA1598 (e.g., from the amino acid sequence of KIAA1598 as shown in FIG. 96 (SEQ ID NO:104)). In another embodiment, the FGFR2-KIAA1598 fusion comprises at least 6, 12, 15, 20, 25, 50, 75, 100 or more nucleotides from exons 1-16 of FGFR2 (e.g., from the nucleotide sequence of FGFR2 as shown in FIG. 93 (SEQ ID NO:99) (e.g., from the nucleotide sequence of FGFR2 preceding the fusion junction with KIAA1598); and at least 6, 12, 15, 20, 25, 50, 75, 100 or more nucleotides from exons 7-17 of KIAA1598 (e.g., from the nucleotide sequence of KIAA1598 as shown in FIG. 95 (SEQ ID NO:103)).

FGFR2-KIAA1598 Nucleic Acid Molecules

In one aspect, the invention features a nucleic acid molecule (e.g., an isolated or purified) nucleic acid molecule that includes a fragment of a FGFR2 gene and a fragment of a KIAA1598 gene. In one embodiment, the nucleotide sequence encodes a FGFR2-KIAA1598 fusion polypeptide that includes a FGFR2 tyrosine kinase domain or a functional fragment thereof. In another embodiment, the nucleotide sequence encodes a fragment of the KIAA1598 polypeptide including the amino acid sequence of SEQ ID NO:104 or a fragment thereof, or a sequence substantially identical thereto. In other embodiments, the nucleic acid molecule includes a fragment of the FGFR2 gene encoding the amino acid sequence of SEQ ID NO:100 or a fragment thereof, or a sequence substantially identical thereto. In yet other embodiments, the nucleic acid molecule includes a nucleotide sequence encoding the amino acid sequence shown in FIG. 92 (SEQ ID NO:100), or a fragment thereof, and the amino acid sequence shown in FIG. 96 (SEQ ID NO:104) or a fragment thereof, or a sequence substantially identical thereto.

In one embodiment, the nucleic acid molecule includes a fusion, e.g., an in-frame fusion, between an intron of FGFR2 (e.g., intron 1, or a fragment thereof), and an intron of KIAA1598 (e.g., intron 1, or a fragment thereof). The FGFR2-KIAA1598 fusion can comprise a fusion of the nucleotide sequence of: chromosome 10 at one or more of nucleotide 123,243,122 (plus or minus 10, 20, 30, 50, 60, 70, 80, 100 nucleotides) and chromosome 10 at one or more of nucleotide 1,740,657 (plus or minus 10, 20, 30, 50, 60, 70, 80, 100 nucleotides), or a fragment thereof. In one embodiment, the FGFR2-KIAA1598 fusion comprises a fusion of the nucleotide sequence of: chromosome 10 at one or more of nucleotide 123,243,122 (plus or minus 10, 20, 30, 50, 60, 70, 80, 100 nucleotides) and chromosome 10 at one or more of nucleotide 1,740,657 (plus or minus 10, 20, 30, 50, 60, 70, 80, 100 nucleotides), or a fragment thereof.

In another embodiment, the FGFR2-KIAA1598 fusion comprises a nucleotide sequence (e.g., a fragment of a nucleotide sequence) shown in FIG. 93 (SEQ ID NO:99) and a nucleotide sequence (e.g., a fragment of a nucleotide sequence) shown in FIG. 95 (SEQ ID NO:103), or a fragment of the fusion. In one embodiment, the FGFR2-KIAA1598 fusion comprises a nucleotide sequence substantially identical to the nucleotide sequence (e.g., a fragment of a nucleotide sequence) shown in FIG. 93 (SEQ ID NO:99) and the nucleotide sequence (e.g., a fragment of a nucleotide sequence) shown FIG. 95 (SEQ ID NO:103), or a fragment of the fusion. In one embodiment, the FGFR2-KIAA1598 fusion comprises a nucleotide sequence at least 70%, at least 75%, at least 80%, at least 85%, at least 90%, at least 95%, at least 99%, at least 99.5 or greater, identical to the nucleotide sequence (e.g., a fragment of a nucleotide sequence) shown in FIG. 93 (SEQ ID NO:99) and to the nucleotide sequence (e.g., a fragment of a nucleotide sequence) shown in FIG. 95 (SEQ ID NO:103). In one embodiment, the FGFR2-KIAA1598 fusion comprises a nucleotide sequence containing at least 25, 50, 100, 150, 200, 500, 1000, 1500, 2000, 2500, 3000, or more nucleotides of the nucleotide sequence shown in FIG. 93 (SEQ ID NO:99) and a nucleotide sequence containing at least 25, 50, 100, 150, 200, 500, 1000, 1500, 2000, 2500, 3000, or more nucleotides of the nucleotide sequence shown in FIG. 95 (SEQ ID NO:103). In one embodiment, the FGFR2-KIAA1598 fusion comprises a nucleotide sequence containing at least 25, 50, 100, 150, 200, 500, 1000, 1500, 2000, 2500, 3000, or more contiguous nucleotides of the nucleotide sequence shown in FIG. 93 (SEQ ID NO:99) and a nucleotide sequence containing at least 25, 50, 100, 150, 200, 500, 1000, 1500, 2000, 2500, 3000, or more nucleotides of the nucleotide sequence shown in FIG. 95 (SEQ ID NO:103).

In another embodiment, the nucleic acid molecule includes a fusion, e.g., an in-frame fusion, of at least exons 1-16 of FGFR2 or a fragment thereof (e.g., exons 1-16 of FGFR2 or a fragment thereof), and at least exon 1 or a fragment thereof (e.g., exons 7-17 of KIAA1598 or a fragment thereof). In yet other embodiments, the nucleic acid molecule includes a fragment the nucleotide sequence shown in FIG. 93 (SEQ ID NO:99) and a fragment of the nucleotide sequence shown in FIG. 95 (SEQ ID NO:103) or a fragment of the fusion, or a sequence substantially identical thereto.

In one embodiment, the nucleic acid molecule is complementary to at least a portion of a nucleotide sequence disclosed herein, e.g., is capable of hybridizing under a stringency condition described herein to SEQ ID NO:99 and/or SEQ ID NO:103, or a fragment thereof. In yet another embodiment, the nucleic acid molecule hybridizes to a nucleotide sequence that is complementary to at least a portion of a nucleotide sequence disclosed herein, e.g., is capable of hybridizing under a stringency condition to a nucleotide sequence complementary to SEQ ID NO:99 and/or SEQ ID NO:103, or a fragment thereof. The nucleotide sequence of a cDNA encoding an exemplary 5' FGFR2-3' KIAA1598 fusion is shown in at least exon 1 (e.g., exon 1) of SEQ ID NO:99 and at least exon 1 (e.g., exon 1) of SEQ ID NO:103, and the predicted amino acid sequence is shown in the corresponding encoded exons of SEQ ID NO:100 and the corresponding encoded exons of SEQ ID NO:104, respectively.

In an embodiment the FGFR2-KIAA1598 nucleic acid molecule comprises sufficient FGFR2 and sufficient KIAA1598 sequence such that the encoded 5' FGFR2-3' KIAA1598 fusion has kinase activity, e.g., has elevated activity, e.g., FGFR2 kinase activity, as compared with wild type FGFR2, e.g., in a cell of a cancer referred to herein. In certain embodiments, the 5' FGFR2-3' KIAA1598 fusion comprises exons 1-16 from FGFR2 and exons 7-17 from KIAA1598. In certain embodiments, the FGFR2-KIAA1598 fusion comprises at least 1 or more exons from FGFR2 and at least 1 or more, exons from KIAA1598. In certain embodiments, the FGFR2-KIAA1598 fusion comprises a fusion of exons 1-16 from FGFR2 and exons 7-17 from KIAA1598. In another embodiment, the FGFR2-KIAA1598 fusion comprises at least 1 exon from FGFR2; and at least 1 exon from KIAA1598.

In one embodiment, the nucleic acid molecule includes a nucleotide sequence that has an in-frame fusion of intron 16 of FGFR2 (e.g., NM_001144915) with intron 6 of KIAA1598 (e.g., NM_016522). In another embodiment, the nucleic acid molecule includes a nucleotide sequence that includes a breakpoint. For example, the nucleic acid molecule includes a nucleotide sequence that includes the fusion junction between the FGFR2 gene and the KIAA1598 gene, e.g., the breakpoint between intron 16 of FGFR2 and intron 6 of KIAA1598. In other embodiments, the nucleic acid molecules includes a nucleotide sequence of one or more of nucleotide 123,243,122 of chromosome 10 coupled to (e.g., directly or indirectly juxtaposed to) one or more of nucleotide 1,740,657 of chromosome 10. In one embodiment, the nucleic acid molecule includes the nucleotide sequence of: chromosome 10 at one or more of nucleotide 123,243,122 plus or minus 10, 20, 30, 40 50, 60, 80, 100, 150 nucleotides and chromosome 10 at one or more of nucleotide 1,740,657 plus or minus 10, 20, 30, 40 50, 60, 80, 100, 150 nucleotides (corresponding to the breakpoint of a FGFR2-KIAA1598 fusion), or a fragment thereof, or a sequence substantially identical thereto. In one embodiment, the nucleic acid molecule is complementary to at least a portion of a nucleotide sequence disclosed herein, e.g., is capable of hybridizing under a stringency condition described herein to SEQ ID NO:99 and/or SEQ ID NO:103 or a fragment thereof. In yet other embodiment, the nucleic acid molecule hybridizes to a nucleotide sequence that is complementary to at least a portion of a nucleotide sequence disclosed herein, e.g., is capable of hybridizing under a stringency condition described herein to a nucleotide sequence complementary to SEQ ID NO:99 or 5 or a fragment thereof.

In another embodiment, the FGFR2-KIAA1598 fusion nucleic acid comprises at least 6, 12, 15, 20, 25, 50, 75, 100 or more nucleotides from exons 1-16 of FGFR2 (e.g., from the nucleotide sequence of FGFR2 preceding the fusion junction with KIAA1598, e.g., of the FGFR2 sequence shown in FIG. 93 (SEQ ID NO:99)), and at least 6, 12, 15, 20, 25, 50, 75, 100 or more nucleotides from exons 7-17 of KIAA1598 (e.g., from the nucleotide sequence of KIAA1598 following the fusion junction with FGFR2, e.g., of the KIAA1598 sequence shown in FIG. 95 (SEQ ID NO:103)).

In other embodiments, the nucleic acid molecule includes a nucleotide sequence encoding a FGFR2-KIAA1598 fusion polypeptide that includes a fragment of a FGFR2 gene and a fragment of an KIAA1598 gene. In one embodiment, the nucleotide sequence encodes a FGFR2-KIAA1598 fusion polypeptide that includes e.g., an FGFR2 tyrosine kinase domain or a functional fragment thereof. In yet other embodiments, the nucleic acid molecule includes a nucleotide sequence encoding the amino acid sequence (e.g., a fragment of the amino acid sequence) shown in FIG. 92 (e.g., SEQ ID NO:100) and a nucleotide sequence encoding the amino acid sequence (e.g., a fragment of the amino acid sequence) shown in FIG. 96 (e.g., SEQ ID NO:104), or a fragment of the fusion, or a sequence substantially identical thereto. In one embodiment, the encoded FGFR2-KIAA1598 fusion polypeptide includes an FGFR2 tyrosine kinase domain or a functional fragment thereof.

In a related aspect, the invention features nucleic acid constructs that include the FGFR2-KIAA1598 nucleic acid molecules described herein. In certain embodiments, the nucleic acid molecules are operatively linked to a native or a heterologous regulatory sequence. Also included are vectors and host cells that include the FGFR2-KIAA1598 nucleic acid molecules described herein, e.g., vectors and host cells suitable for producing the nucleic acid molecules and polypeptides described herein.

In a related aspect, methods of producing the nucleic acid molecules and polypeptides described herein are also described.

In another aspect, the invention features nucleic acid molecules that reduce or inhibit the expression of a nucleic acid molecule that encodes a FGFR2-KIAA1598 fusion described herein. Examples of such nucleic acid molecules include, for example, antisense molecules, ribozymes, RNAi, triple helix molecules that hybridize to a nucleic acid encoding FGFR2-KIAA1598, or a transcription regulatory region of FGFR2-KIAA1598, and blocks or reduces mRNA expression of FGFR2-KIAA1598.

Nucleic Acid Detection and Capturing Reagents

The invention also features a nucleic acid molecule, e.g., nucleic acid fragment, suitable as probe, primer, bait or library member that includes, flanks, hybridizes to, which are useful for identifying, or are otherwise based on, the FGFR2-KIAA1598 fusions described herein. In certain embodiments, the probe, primer or bait molecule is an oligonucleotide that allows capture, detection or isolation of a FGFR2-KIAA1598 fusion nucleic acid molecule described herein. The oligonucleotide can comprise a nucleotide sequence substantially complementary to a fragment of the FGFR2-KIAA1598 fusion nucleic acid molecules described herein. The sequence identity between the nucleic acid fragment, e.g., the oligonucleotide, and the target FGFR2-KIAA1598 sequence need not be exact, so long as the sequences are sufficiently complementary to allow the capture, detection or isolation of the target sequence. In one embodiment, the nucleic acid fragment is a probe or primer that includes an oligonucleotide between about 5 and 25, e.g., between 10 and 20, or 10 and 15 nucleotides in length. In other embodiments, the nucleic acid fragment is a bait that includes an oligonucleotide between about 100 to 300 nucleotides, 130 and 230 nucleotides, or 150 and 200 nucleotides, in length.

In one embodiment, the nucleic acid fragment can be used to identify or capture, e.g., by hybridization, a FGFR2-KIAA1598 fusion. For example, the nucleic acid fragment can be a probe, a primer, or a bait, for use in identifying or capturing, e.g., by hybridization, a FGFR2-KIAA1598 fusion described herein. In one embodiment, the nucleic acid fragment can be useful for identifying or capturing a FGFR2-KIAA1598 breakpoint, e.g., the nucleotide sequence of: chromosome 10 at nucleotide 123,243,122 plus or minus 10, 20, 30, 40 50, 60, 80, 100, 150 nucleotides and chromosome 10 at nucleotide 1,740,657 plus or minus 10, 20, 30, 40 50, 60, 80, 100, 150 nucleotides.

In one embodiment, the nucleic acid fragment hybridizes to a nucleotide sequence within a chromosomal rearrangement that creates an in-frame fusion of intron 16 of FGFR2 with intron 6 of KIAA1598. In one embodiment, the nucleic acid fragment hybridizes to a nucleotide sequence in the region In other embodiments, the nucleic acid molecules includes a nucleotide sequence in the region of nucleotides 123,242,122 of chromosome 10 coupled to (e.g., juxtaposed to) nucleotides in the region of nucleotides 1,740,657 of chromosome 10. In one embodiment, the nucleic acid fragment hybridizes to a nucleotide sequence that includes a breakpoint, e.g., the nucleotide sequence of: chromosome 10 at nucleotide 123,243,122 plus or minus 10, 20, 30, 40 50, 60, 80, 100, 150 or more nucleotides and chromosome 10 at nucleotide 1,740,657 plus or minus 10, 20, 30, 40 50, 60, 80, 100, 150 or more nucleotides. For example, the nucleic acid fragment can hybridize to a nucleotide sequence that includes the fusion junction between the FGFR2 gene and the KIAA1598 gene, e.g., a nucleotide sequence that includes a portion of a nucleotide sequence within introns 14 of a FGFR2 gene and 11 of a KIAA1598 gene.

In another embodiment, the nucleic acid fragment hybridizes to a nucleotide sequence that comprises at least 6, 12, 15, 20, 25, 50, 75, 100, 150 or more nucleotides from exons 1-16 of FGFR2 (e.g., from the nucleotide sequence of FGFR2 preceding the fusion junction with KIAA1598, e.g., of the FGFR2 sequence shown in FIG. 93 (SEQ ID NO:99)), and at least 6, 12, 15, 20, 25, 50, 75, 100, 150 or more nucleotides from exon 1 of KIAA1598 (e.g., from the nucleotide sequence of KIAA1598 following the fusion junction with FGFR2, e.g., of the KIAA1598 sequence shown in FIG. 95 (SEQ ID NO:103)).

The probes or primers described herein can be used, for example, for FISH detection or PCR amplification. In one exemplary embodiment where detection is based on PCR, amplification of the FGFR2-KIAA1598 fusion junction fusion junction can be performed using a primer or a primer pair, e.g., for amplifying a sequence flanking the fusion junctions described herein, e.g., the mutations or the junction of a chromosomal rearrangement described herein, e.g., FGFR2-KIAA1598.

In one embodiment, a pair of isolated oligonucleotide primers can amplify a region containing or adjacent to a position in the FGFR2-KIAA1598 fusion. For example, forward primers can be designed to hybridize to a nucleotide sequence within FGFR2 genomic or mRNA sequence (e.g., a nucleotide sequence within exons 1-16 of FGFR2 of SEQ ID NO:99), and the reverse primers can be designed to hybridize to a nucleotide sequence of KIAA1598 (e.g., a nucleotide sequence within exons 7-17 of KIAA1598, of SEQ ID NO:103).

In another embodiment, the nucleic acid fragments can be used to identify, e.g., by hybridization, a FGFR2-KIAA1598 fusion. In one embodiment, the nucleic acid fragment hybridizes to a nucleotide sequence that includes a fusion junction between the FGFR2 transcript and the KIAA1598 transcript.

In other embodiments, the nucleic acid fragment includes a bait that comprises a nucleotide sequence that hybridizes to a FGFR2-KIAA1598 fusion nucleic acid molecule described herein, and thereby allows the capture or isolation said nucleic acid molecule. In one embodiment, a bait is suitable for solution phase hybridization. In other embodiments, a bait includes a binding entity, e.g., an affinity tag, that allows capture and separation, e.g., by binding to a binding entity, of a hybrid formed by a bait and a nucleic acid hybridized to the bait.

In other embodiments, the nucleic acid fragment includes a library member comprising a FGFR2-KIAA1598 nucleic acid molecule described herein. In one embodiment, the library member includes a rearrangement that results in a FGFR2-KIAA1598 fusion described herein.

The nucleic acid fragment can be detectably labeled with, e.g., a radiolabel, a fluorescent label, a bioluminescent label, a chemiluminescent label, an enzyme label, a binding pair label, or can include an affinity tag; a tag, or identifier (e.g., an adaptor, barcode or other sequence identifier).

FGFR2-KIAA1598 Fusion Polypeptides

In another embodiment, the FGFR2-KIAA1598 fusion comprises an amino acid sequence (e.g., a fragment of the amino acid sequence) shown in FIG. 92 (SEQ ID NO:100) and an amino acid sequence (e.g., a fragment of the amino acid sequence) shown in FIG. 96 (SEQ ID NO:104), or a fragment of the fusion. In one embodiment, the FGFR2-KIAA1598 fusion comprises an amino acid sequence substantially identical to the amino acid sequence (e.g., a fragment of the amino acid sequence) shown in FIG. 92 (SEQ ID NO:100) and the amino acid sequence (e.g., a fragment of the amino acid sequence) shown in FIG. 96 (SEQ ID NO:104), or a fragment thereof. In one embodiment, the FGFR2-KIAA1598 fusion comprises an amino acid sequence at least 70%, at least 75%, at least 80%, at least 85%, at least 90%, at least 95%, at least 99%, at least 99.5 or greater, identical to the amino acid sequence (e.g., a fragment of the amino acid sequence) shown in FIG. 92 (SEQ ID NO:100) and the amino acid sequence (e.g., a fragment of the amino acid sequence) shown in FIG. 96 (SEQ ID NO:104). In one embodiment, the FGFR2-KIAA1598 fusion comprises a sequence containing at least 10, 20, 50, 100, 500, 600, 700, 800, 900, 1000, or more amino acids of the amino acid sequence shown in FIG. 92 (SEQ ID NO:100) and FIG. 96 (SEQ ID NO:104). In one embodiment, the FGFR2-KIAA1598 fusion comprises an amino acid sequence containing at least 5, 10, 20, 50, 100, 500, 600, 700, 800, 900, 1000, or more contiguous amino acids of the amino acid sequence shown in FIG. 92 (SEQ ID NO:100) and at least 5, 10, 20, 50, 100, 500, 600, 700, 800, 900, 1000, or more contiguous amino acids of the amino acid sequence shown in FIG. 96 (SEQ ID NO:104). In one embodiment, the FGFR2-KIAA1598 fusion polypeptide includes a FGFR2 receptor tyrosine kinase domain or a functional fragment thereof. In an embodiment, the FGFR2-KIAA1598 fusion polypeptide comprises sufficient KIAA1598 and sufficient FGFR2 sequence such that it has kinase activity, e.g., has elevated activity, e.g., FGFR2 kinase activity, as compared with wild type FGFR2, e.g., in a cell of a cancer referred to herein.

In another aspect, the invention features a FGFR2-KIAA1598 fusion polypeptide (e.g., a purified FGFR2-KIAA1598 fusion polypeptide), a biologically active or antigenic fragment thereof, as well as reagents (e.g., antibody molecules that bind to a FGFR2-KIAA1598 fusion polypeptide), methods for modulating a FGFR2-KIAA1598 polypeptide activity and detection of a FGFR2-KIAA1598 polypeptide.

In one embodiment, the FGFR2-KIAA1598 fusion polypeptide has at least one biological activity, e.g., an FGFR2 kinase activity. In one embodiment, at least one biological activity of the FGFR2-KIAA1598 fusion polypeptide is reduced or inhibited by an anti-cancer drug, e.g., a kinase inhibitor (e.g., a multikinase inhibitor or an FGFR2-specific inhibitor). In one embodiment, at least one biological activity of the FGFR2-KIAA1598 fusion polypeptide is reduced or inhibited by an FGFR2 kinase inhibitor chosen from e.g., BIBF1120 (Vargatef); Panatinib (AP24534); AZD4547; BGJ398 (NVP-BGJ398); or Brivanib alaninate (BMS-582664).

In yet other embodiments, the FGFR2-KIAA1598 fusion polypeptide is encoded by a nucleic acid molecule described herein. In one embodiment, the FGFR2-KIAA1598 fusion polypeptide is encoded by an in-frame fusion of intron 16 of FGFR2 with intron 6 of KIAA1598. In another embodiment, the FGFR2-KIAA1598 fusion polypeptide includes an amino acid sequence encoded by a nucleotide sequence comprising a fusion junction between the FGFR2 transcript and the KIAA1598 transcript.

In certain embodiments, the FGFR2-KIAA1598 fusion polypeptide comprises one or more of encoded exons 1-16 from FGFR2 and one or more of encoded exons 7-17 of KIAA1598. In certain embodiments, the FGFR2-KIAA1598 fusion polypeptide comprises at least 1, 2, 3, 4, 5, 6, 7, 8, 9, 10, 11, 12, 13, 14, 15, 16 or more encoded exons from FGFR2 and at least 1, 2, 3, 4, 5, 6, 7, 8, 9, 10, 11 or more, encoded exons from KIAA1598. In certain embodiments, the FGFR2-KIAA1598 fusion polypeptide comprises a fusion of encoded exons 1-16 from FGFR2 and encoded exons 7-17 from KIAA1598 (or a fragment thereof). In other embodiments, the fusion comprises least 1, 2, 3, 4, 5, 6, 7, 8, 9, 10, 11, 12, 13, 14, 15, 16 encoded exon from FGFR2; and at least 1, 2, 3, 4, 5, 6, 7, 8, 9, 10, 11 encoded exons from KIAA1598. In certain embodiments, the FGFR2-KIAA1598 fusion polypeptide comprises encoded exons 1-16 from FGFR2 and exons 7-17 of KIAA1598. In certain embodiments, the 5' FGFR2-3' KIAA1598 fusion polypeptide comprises a fusion junction of the sequence of exons 1-16 from FGFR2 and the sequence of exons 7-17 from KIAA1598.

In certain embodiments, the FGFR2-KIAA1598 fusion comprises the amino acid sequence corresponding to exons 1-16 or a fragment thereof from FGFR2, and the amino acid sequence corresponding to exons 7-17 or a fragment thereof from KIAA1598 (e.g., as shown in FIG. 92 (SEQ ID NO:100) and FIG. 96 (SEQ ID NO:104)). In one embodiment, the FGFR2-KIAA1598 fusion comprises at least 5, 10, 15, 20 or more amino acids from exons 1-16 of FGFR2 (e.g., from the amino acid sequence of FGFR2 preceding the fusion junction with KIAA1598, e.g., of the FGFR2 sequence shown in FIG. 92 (SEQ ID NO:100)), and at least 5, 10, 15, 20 or more amino acids from exons 7-17 of KIAA1598 (e.g., from the amino acid sequence of KIAA1598 following the fusion junction with FGFR2, e.g., of the KIAA1598 sequence shown in FIG. 96 (SEQ ID NO:104)).

In one embodiment, the FGFR2-KIAA1598 fusion polypeptide includes a FGFR2 tyrosine kinase domain or a functional fragment thereof. In a related aspect, the invention features FGFR2-KIAA1598 fusion polypeptide or fragments operatively linked to heterologous polypeptides to form fusion proteins.

In another embodiment, the FGFR2-KIAA1598 fusion polypeptide or fragment is a peptide, e.g., an immunogenic peptide or protein, that contains a fusion junction described herein. Such immunogenic peptides or proteins can be used to raise antibodies specific to the fusion protein. In other embodiments, such immunogenic peptides or proteins can be used for vaccine preparation. The vaccine preparation can include other components, e.g., an adjuvant.

In another aspect, the invention features antibody molecules that bind to a FGFR2-KIAA1598 fusion polypeptide or fragment described herein. In embodiments, the antibody can distinguish wild type KIAA1598 (or FGFR2) from FGFR2-KIAA1598.

Detection Reagents and Detection of Mutations

In another aspect, the invention features a detection reagent, e.g., a purified or an isolated preparation thereof. Detection reagents can distinguish a nucleic acid, or protein sequence, having a breakpoint, e.g., a FGFR2-KIAA1598 breakpoint; from a reference sequence. In one embodiment, the detection reagent detects (e.g., specifically detects) a FGFR2-KIAA1598 fusion nucleic acid or a polypeptide (e.g., distinguishes a wild type KIAA1598 or another KIAA1598 fusion (or FGFR2) from a FGFR2-KIAA1598 nucleic acid (e.g., as described herein in FIG. 93 (SEQ ID NO:99) and FIG. 95 (SEQ ID NO:103); or a FGFR2-KIAA1598 polypeptide (e.g., as described herein in FIG. 92 (SEQ ID NO:100) and FIG. 96 (SEQ ID NO:104).

Detection reagents, e.g., nucleic acid-based detection reagents, can be used to identify mutations in a target nucleic acid, e.g., DNA, e.g., genomic DNA or cDNA, or RNA, e.g., in a sample, e.g., a sample of nucleic acid derived from a neoplastic or tumor cell, e.g., a melanocytic neoplasm, melanoma or metastatic cell. Detection reagents, e.g., antibody-based detection reagents, can be used to identify mutations in a target protein, e.g., in a sample, e.g., a sample of protein derived from, or produced by, a neoplastic or tumor cell, e.g., a melanocytic neoplasm, melanoma or metastatic cell.

Method of Treatment

In a related aspect, a method of inhibiting, reducing, or treating a hyperproliferative disorder, e.g., a neoplasm (including benign, pre-malignant or malignant (e.g., a cancer), in a subject is provided. The method includes administering to the subject a preselected therapeutic agent, e.g., an anti-cancer agent (e.g., an inhibitor), as a single agent, or in combination, in an amount sufficient to reduce, inhibit or treat the activity or expression of FGFR2-KIAA1598 (e.g., a FGFR2-KIAA1598 fusion described herein), thereby inhibiting, reducing, or treating the hyperproliferative disorder in the subject.

In one embodiment, the subject treated has a FGFR2-KIAA1598 fusion; e.g., the subject has a tumor or cancer harboring a FGFR2-KIAA1598 fusion. In other embodiments, the subject has been previously identified as having a FGFR2-KIAA1598 fusion. In yet other embodiments, the subject has been previously identified as being likely or unlikely to respond to treatment with a protein kinase inhibitor, e.g., a subject that has previously participated in a clinical trial. In other embodiments, the subject has been previously identified as being likely or unlikely to respond to treatment with a protein kinase inhibitor, based on the presence of the FGFR2-KIAA1598 fusion. In one embodiment, the subject is a mammal, e.g., a human. In one embodiment, the subject has, or at risk of having a cancer at any stage of disease. In other embodiments, the subject is a patient, e.g., a cancer patient.

In certain embodiments, the neoplasm or neoplastic cell is a benign, pre-malignant, malignant (cancer) or metastasis. In certain embodiments, the cancer is a solid tumor, a soft tissue tumor, or a metastatic lesion.

In one embodiment, the neoplasm or neoplastic cell is a benign, pre-malignant, malignant (cancer) or metastasis. In certain embodiments, the cancer is a solid tumor, a soft tissue tumor, or a metastatic lesion. In certain embodiments the cancer is a carcinoma. In certain embodiments the cancer is cholangiocarcinoma. In certain embodiments the cancer is a liver cholangiocarcinoma. In some embodiments, the cancer is a sarcoma. In one embodiment, the cancer is a cholangiosarcoma. In one embodiments, the cancer is a liver cholangiosarcoma. In one embodiment, the cancer is an urothelial (transitional cell) carcinoma. In one embodiment, the cancer is chosen from a lung cancer, a pancreatic cancer, melanoma, a colorectal cancer, an esophageal-gastric cancer, a thyroid cancer, or an adenocarcinoma. In other embodiment, the lung cancer is chosen from one or more of the following: non-small cell lung cancer (NSCLC), small cell lung cancer (SCLC), squamous cell carcinoma (SCC), adenocarcinoma of the lung, bronchogenic carcinoma, or a combination thereof. In one embodiment, the lung cancer is NSCLC or SCC.

In certain embodiments, the cancer is a cholangiocarcinoma. In some embodiments, such cancers of the bile ducts can arise within the liver as an intrahepatic cholangiocarcinoma (ICC) or originate from extrahepatic bile ducts as a bile duct carcinoma also referred to as an extrahepatic cholangiocarcinoma. ICC is the second most common primary hepatic malignancy after hepatocellular carcinoma (HCC) and accounts for 3% of the malignant tumors of the gastrointestinal system and 15% of primary hepatic malignancies. In that ICC has a routine histologic appearance of an adenocarcinoma, the diagnosis of ICC on a liver biopsy requires an immunohistochemical (IHC) study of the tumor and a thorough clinical workup including imaging studies to rule out a metastatic adenocarcinoma to the liver. ICC is associated with primary sclerosing cholangitis, parasitic biliary infection, polycystic disease of the liver, congenital intrahepatic bile duct dilatation (*Caroli*'s Disease), congenital hepatic fibrosis, and choledochal cysts. Chronic Hepatitis C infection is an established cause of ICC with some studies describing a more than 300 fold increase in ICC incidence in patients with long-standing Hepatitis C infections. ICC has also been associated with cigarette smoking, alcohol consumption and exposure to a variety of toxins and chemical carcinogens.

In one embodiment, the anti-cancer agent is a kinase inhibitor. For example, the kinase inhibitor is a multi-kinase inhibitor, an FGF receptor inhibitor (e.g., a pan FGFR2 inhibitor), or a FGFR2-specific inhibitor. In one embodiment, the kinase inhibitor is chosen from one or more of: BIBF1120 (Vargatef); Panatinib (AP24534); AZD4547; BGJ398 (NVP-BGJ398); Brivanib alaninate (BMS-582664), AZD-4547; Regorafenib; Masitinib; Lenvatinib; Dovitinib; Brivanib; Ponatinib; ENMD-2076; AZD-2171 (Cediranib); BIBF1120; LY2874455; and/or JNJ42756493. In some embodiments the FGFR2 inhibitor is a FGFR2 inhibitor described herein.

In one embodiment, the therapeutic agent is an agent that binds and inhibits FGFR2 or KIAA1598. For example, the therapeutic agent is an antibody molecule (e.g., a monoclonal antibody) against FGFR2; and/or a small molecule (e.g., kinase) inhibitor that is selective for FGFR2 or KIAA1598.

In another embodiment, the therapeutic agent is selected from antisense molecules, ribozymes, RNAi, triple helix molecules that hybridize to a nucleic acid encoding the fusion, or a transcription regulatory region that blocks or reduces mRNA expression of the fusion.

BICC1-FGFR2 Fusions

In one embodiment, a fusion includes an in-frame fusion of an exon of bicaudal C homolog 1 (BICC1), e.g., one more exons of BICC1 (e.g., one or more of exons 1-2 of BICC1) or a fragment thereof, and an exon of fibroblast growth factor receptor 2 (FGFR2), e.g., one or more exons of an FGFR2 (e.g., one or more of exon 17 of FGFR2) or a fragment thereof. For example, the BICC1-FGFR2 fusion can include an in-frame fusion within an intron of BICC1 (e.g., intron 2) or a fragment thereof, with an intron of FGFR2 (e.g., intron 16) or a fragment thereof. In one embodiment, the fusion of the BICC1-FGFR2 fusion comprises the nucleotide sequence of: chromosome 10 at one or more of nucleotide 60,446,461 (plus or minus 10, 20, 30, 50, 60, 70, 80, 100 or more nucleotides) and chromosome 10 at one or more of nucleotide 123,241,845 (plus or minus 10, 20, 30, 50, 60, 70, 80, 100 or more nucleotides).

In certain embodiments, the BICC1-FGFR2 fusion is in a 5'-BICC1 to 3'-FGFR2 configuration (also referred to herein as "5'-BICC1-FGFR2-3')." The term "fusion" or "fusion molecule" can refer to a polypeptide or a nucleic acid fusion, depending on the context. It may include a full-length sequence of a fusion or a fragment thereof, e.g., a fusion junction (e.g., a fragment including a portion of BICC1 and a portion of FGFR2, e.g., a portion of the BICC1-FGFR2 fusion described herein). In one embodiment, the BICC1-FGFR2 fusion polypeptide includes a fragment of the amino acid sequence shown in FIG. 99 (SEQ ID NO:108) and a fragment of the amino acid sequence shown in FIG. 93 (SEQ ID NO:100), or an amino acid sequence substantially identical thereto. In another embodiment, the BICC1-FGFR2 fusion nucleic acid includes a fragment of the nucleotide sequence shown in FIG. 98 (SEQ ID NO:107) and a fragment of the nucleotide sequence shown in FIG. 92 (SEQ ID NO:99), or a nucleotide sequence substantially identical thereto. In one embodiment, the BICC1-FGFR2 fusion polypeptide comprises sufficient BICC1 and sufficient FGFR2 sequence such that the 5' BICC1-3' FGFR2 fusion has kinase activity, e.g., has elevated activity, e.g., FGFR2 tyrosine kinase activity, as compared with wild type FGFR2, e.g., in a cell of a cancer referred to herein (e.g., lung adenocarcinoma, a sarcoma, e.g., a cholangiosarcoma, e.g., a liver cholangiosarcoma). In certain embodiments, the BICC1 sequence has an RNA binding domain.

In certain embodiments, the BICC1-FGFR2 fusion comprises one or more (or all of) exons 1-2 from BICC1 and one or more (or all of) exon 17 of FGFR2 (e.g., one or more of the exons shown in FIG. 98 (SEQ ID NO:107) and FIG. 92 (SEQ ID NO:99). In another embodiment, the BICC1-FGFR2 fusion comprises one or more (or all of) exons 1-2 of BICC1 and one or more (or all of) exon 17 of FGFR2. In certain embodiments, the BICC1-FGFR2 fusion comprises at least 1, 2 or more exons (or encoded exons) from BICC1 and at least 1 or more exons (or encoded exons) from FGFR2 (e.g., from the BICC1 and FGFR2 sequences shown in FIG. 98 and FIG. 99 (SEQ ID NO:107 and 108) and FIG. 92 and FIG. 93 (SEQ ID NOs:99 and 100)).

In certain embodiments, the BICC1-FGFR2 fusion comprises exons 1-2 or a fragment thereof from BICC1, and exon 17 or a fragment thereof from FGFR2 (e.g., as shown in FIG. 98 (SEQ ID NO:107) and FIG. 92 (SEQ ID NO:99)). In one embodiment, the BICC1-FGFR2 fusion comprises at least 5, 10, 15, 20, 30, 40, 50 or more amino acids from exons 1-2 of BICC1 (e.g., from the amino acid sequence of BICC1 as shown in FIG. 99 (SEQ ID NO:108) (e.g., from the amino acid sequence of BICC1 preceding the fusion junction with FGFR2, and at least 5, 10, 15, 20, 30, 40, 50 or more amino acids from exon 17 of FGFR2 (e.g., from the amino acid sequence of FGFR2 as shown in FIG. 93 (SEQ ID NO:100)). In another embodiment, the BICC1-FGFR2 fusion comprises at least 6, 12, 15, 20, 25, 50, 75, 100 or more nucleotides from exons 1-2 of BICC1 (e.g., from the nucleotide sequence of BICC1 as shown in FIG. 98 (SEQ ID NO:107) (e.g., from the nucleotide sequence of BICC1 preceding the fusion junction with FGFR2); and at least 6, 12, 15, 20, 25, 50, 75, 100 or more nucleotides from exon 17 of FGFR2 (e.g., from the nucleotide sequence of FGFR2 as shown in FIG. 92 (SEQ ID NO:99).

BICC1-FGFR2 Nucleic Acid Molecules

In one aspect, the invention features a nucleic acid molecule (e.g., an isolated or purified) nucleic acid molecule that includes a fragment of a BICC1 gene and a fragment of am FGFR2 gene. In one embodiment, the nucleotide sequence encodes a BICC1-FGFR2 fusion polypeptide that includes an FGFR2 tyrosine kinase domain or a functional fragment thereof. In another embodiment, the nucleotide sequence encodes a fragment of the FGFR2 polypeptide including the amino acid sequence of SEQ ID NO:100 or a fragment thereof, or a sequence substantially identical thereto. In other embodiments, the nucleic acid molecule includes a fragment of the BICC1 gene encoding the amino acid sequence of SEQ ID NO:108 or a fragment thereof, or a sequence substantially identical thereto. In yet other embodiments, the nucleic acid molecule includes a nucleotide sequence encoding the amino acid sequence shown in FIG. 99 (SEQ ID NO:108), or a fragment thereof, and the amino acid sequence shown in FIG. 93 (SEQ ID NO:100) or a fragment thereof, or a sequence substantially identical thereto.

In one embodiment, the nucleic acid molecule includes a fusion, e.g., an in-frame fusion, between an intron of BICC1 (e.g., intron 1, or a fragment thereof), and an intron of FGFR2 (e.g., intron 19, or a fragment thereof). The BICC1-FGFR2 fusion can comprise a fusion of the nucleotide sequence of: chromosome 10 at one or more of nucleotide 60,446,461 (plus or minus 10, 20, 30, 50, 60, 70, 80, 100 nucleotides) and chromosome 10 at one or more of nucleotide 123,241,845 (plus or minus 10, 20, 30, 50, 60, 70, 80, 100 nucleotides), or a fragment thereof. In one embodiment, the BICC1-FGFR2 fusion comprises a fusion of the nucleotide sequence of: chromosome 10 at one or more of nucleotide 60,446,461 (plus or minus 10, 20, 30, 50, 60, 70, 80, 100 nucleotides) and chromosome 10 at one or more of nucleotide 123,241,845 (plus or minus 10, 20, 30, 50, 60, 70, 80, 100 nucleotides), or a fragment thereof.

In another embodiment, the BICC1-FGFR2 fusion comprises a nucleotide sequence (e.g., a fragment of a nucleotide sequence) shown in FIG. 98 (SEQ ID NO:107) and a nucleotide sequence (e.g., a fragment of a nucleotide sequence) shown in FIG. 92 (SEQ ID NO:99), or a fragment of the fusion. In one embodiment, the BICC1-FGFR2 fusion comprises a nucleotide sequence substantially identical to the nucleotide sequence (e.g., a fragment of a nucleotide sequence) shown in FIG. 98 (SEQ ID NO:107) and the nucleotide sequence (e.g., a fragment of a nucleotide sequence) shown FIG. 92 (SEQ ID NO:99), or a fragment of the fusion. In one embodiment, the BICC1-FGFR2 fusion comprises a nucleotide sequence at least 70%, at least 75%, at least 80%, at least 85%, at least 90%, at least 95%, at least 99%, at least 99.5 or greater, identical to the nucleotide sequence (e.g., a fragment of a nucleotide sequence) shown in FIG. 98 (SEQ ID NO:107) and to the nucleotide sequence (e.g., a fragment of a nucleotide sequence) shown in FIG. 92 (SEQ ID NO:99). In one embodiment, the BICC1-FGFR2 fusion comprises a nucleotide sequence containing at least 25, 50, 100, 150, 200, 500, 1000, 1500, 2000, 2500, 3000, or more nucleotides of the nucleotide sequence shown in FIG. 98 (SEQ ID NO:107) and a nucleotide sequence containing at least 25, 50, 100, 150, 200, 500, 1000, 1500, 2000, 2500, 3000, or more nucleotides of the nucleotide sequence shown in FIG. 92 (SEQ ID NO:99). In one embodiment, the BICC1-FGFR2 fusion comprises a nucleotide sequence containing at least 25, 50, 100, 150, 200, 500, 1000, 1500, 2000, 2500, 3000, or more contiguous nucleotides of the nucleotide sequence shown in FIG. 98 (SEQ ID NO:107) and a nucleotide sequence containing at least 25, 50, 100, 150, 200, 500, 1000, 1500, 2000, 2500, 3000, or more nucleotides of the nucleotide sequence shown in FIG. 92 (SEQ ID NO:99).

In another embodiment, the nucleic acid molecule includes a fusion, e.g., an in-frame fusion, of at least exons 1-2 of BICC1 or a fragment thereof (e.g., one or more of exons 1-2 of BICC1 or a fragment thereof), and at least exon 17 or a fragment thereof (e.g., one or more of exons exon 17 of FGFR2 or a fragment thereof). In yet other embodiments, the nucleic acid molecule includes a fragment the nucleotide sequence shown in FIG. 98 (SEQ ID NO:107) and a fragment of the nucleotide sequence shown in FIG. 92 (SEQ ID NO:99) or a fragment of the fusion, or a sequence substantially identical thereto.

In one embodiment, the nucleic acid molecule is complementary to at least a portion of a nucleotide sequence disclosed herein, e.g., is capable of hybridizing under a stringency condition described herein to SEQ ID NO:107 and/or SEQ ID NO:99, or a fragment thereof. In yet another embodiment, the nucleic acid molecule hybridizes to a nucleotide sequence that is complementary to at least a portion of a nucleotide sequence disclosed herein, e.g., is capable of hybridizing under a stringency condition to a nucleotide sequence complementary to SEQ ID NO:107 and/or SEQ ID NO:99, or a fragment thereof. The nucleotide sequence of a cDNA encoding an exemplary 5' BICC1-3' FGFR2 fusion is shown in at least exon 1 (e.g., exon 1) of SEQ ID NO:107 and at least exon 20 (e.g., exons 20-29) of SEQ ID NO:99, and the predicted amino acid sequence is shown in the corresponding encoded exons of SEQ ID NO:108 and the corresponding encoded exons of SEQ ID NO:100, respectively.

In an embodiment the BICC1-FGFR2 nucleic acid molecule comprises sufficient BICC1 and sufficient FGFR2 sequence such that the encoded 5' BICC1-3' FGFR2 fusion has kinase activity, e.g., has elevated activity, e.g., FGFR2 kinase activity, as compared with wild type FGFR2, e.g., in a cell of a cancer referred to herein. In certain embodiments, the 5' BICC1-3' FGFR2 fusion comprises exons 1-2 from BICC1 and exon exons 20-29 from FGFR2. In certain embodiments, the BICC1-FGFR2 fusion comprises at least 1, 2 or more exons from BICC1 and at least 1 or more, exons from FGFR2. In certain embodiments, the BICC1-FGFR2 fusion comprises a fusion of exons 1-2 from BICC1 and exon 17 from FGFR2. In another embodiment, the BICC1-FGFR2 fusion comprises at least 1, 2 exons from BICC1; and at least 1 exons from FGFR2.

In one embodiment, the nucleic acid molecule includes a nucleotide sequence that has an in-frame fusion of intron 2 of BICC1 (e.g., NM_0080512) with intron 16 of FGFR2 (e.g., NM_001144915). In another embodiment, the nucleic acid molecule includes a nucleotide sequence that includes a breakpoint. For example, the nucleic acid molecule includes a nucleotide sequence that includes the fusion junction between the BICC1 gene and the FGFR2 gene, e.g., the breakpoint between intron 2 of BICC1 and intron 16 of FGFR2. In other embodiments, the nucleic acid molecules includes a nucleotide sequence of one or more of nucleotide 60,446,461 of chromosome 10 coupled to (e.g., directly or indirectly juxtaposed to) one or more of nucleotide 123,241, 845 of chromosome 10. In one embodiment, the nucleic acid molecule includes the nucleotide sequence of: chromosome 10 at one or more of nucleotide 60,446,461 plus or minus 10, 20, 30, 40 50, 60, 80, 100, 150 nucleotides and chromosome 10 at one or more of nucleotide 123,241,845 plus or minus 10, 20, 30, 40 50, 60, 80, 100, 150 nucleotides (corresponding to the breakpoint of a BICC1-FGFR2 fusion), or a fragment thereof, or a sequence substantially identical thereto. In one embodiment, the nucleic acid molecule is complementary to at least a portion of a nucleotide sequence disclosed herein, e.g., is capable of hybridizing under a stringency condition described herein to SEQ ID NO:107 and/or SEQ ID NO:99 or a fragment thereof. In yet other embodiment, the nucleic acid molecule hybridizes to a nucleotide sequence that is complementary to at least a portion of a nucleotide sequence disclosed herein, e.g., is capable of hybridizing under a stringency condition described herein to a nucleotide sequence complementary to SEQ ID NO:107 or SEQ ID NO:99 or a fragment thereof.

In another embodiment, the BICC1-FGFR2 fusion nucleic acid comprises at least 6, 12, 15, 20, 25, 50, 75, 100 or more nucleotides from exons 1-2 of BICC1 (e.g., from the nucleotide sequence of BICC1 preceding the fusion junction with FGFR2, e.g., of the BICC1 sequence shown in FIG. 98 (SEQ ID NO:107)), and at least 6, 12, 15, 20, 25, 50, 75, 100 or more nucleotides from exon 17 of FGFR2 (e.g., from the nucleotide sequence of FGFR2 following the fusion junction with BICC1, e.g., of the FGFR2 sequence shown in FIG. 92 (SEQ ID NO:99)).

In other embodiments, the nucleic acid molecule includes a nucleotide sequence encoding a BICC1-FGFR2 fusion polypeptide that includes a fragment of a BICC1 gene and a fragment of an FGFR2 gene. In one embodiment, the nucleotide sequence encodes a BICC1-FGFR2 fusion polypeptide that includes e.g., an FGFR2 tyrosine kinase domain or a functional fragment thereof. In yet other embodiments, the nucleic acid molecule includes a nucleotide sequence encoding the amino acid sequence (e.g., a fragment of the amino acid sequence) shown in FIG. 99 (e.g., SEQ ID NO:108) and a nucleotide sequence encoding the amino acid sequence (e.g., a fragment of the amino acid sequence) shown in FIG. 62 (e.g., SEQ ID NO:100), or a fragment of the fusion, or a sequence substantially identical thereto. In one embodiment, the encoded BICC1-FGFR2 fusion polypeptide includes an FGFR2 tyrosine kinase domain or a functional fragment thereof.

In a related aspect, the invention features nucleic acid constructs that include the BICC1-FGFR2 nucleic acid molecules described herein. In certain embodiments, the nucleic acid molecules are operatively linked to a native or a heterologous regulatory sequence. Also included are vectors and host cells that include the BICC1-FGFR2 nucleic acid molecules described herein, e.g., vectors and host cells suitable for producing the nucleic acid molecules and polypeptides described herein.

In a related aspect, methods of producing the nucleic acid molecules and polypeptides described herein are also described.

In another aspect, the invention features nucleic acid molecules that reduce or inhibit the expression of a nucleic acid molecule that encodes a BICC1-FGFR2 fusion described herein. Examples of such nucleic acid molecules include, for example, antisense molecules, ribozymes, RNAi, triple helix molecules that hybridize to a nucleic acid encoding BICC1-FGFR2, or a transcription regulatory region of BICC1-FGFR2, and blocks or reduces mRNA expression of BICC1-FGFR2.

Nucleic Acid Detection and Capturing Reagents

The invention also features a nucleic acid molecule, e.g., nucleic acid fragment, suitable as probe, primer, bait or library member that includes, flanks, hybridizes to, which are useful for identifying, or are otherwise based on, the BICC1-FGFR2 fusions described herein. In certain embodiments, the probe, primer or bait molecule is an oligonucleotide that allows capture, detection or isolation of a BICC1-FGFR2 fusion nucleic acid molecule described herein. The oligonucleotide can comprise a nucleotide sequence substantially complementary to a fragment of the BICC1-FGFR2 fusion nucleic acid molecules described herein. The sequence identity between the nucleic acid fragment, e.g., the oligonucleotide, and the target BICC1-FGFR2 sequence need not be exact, so long as the sequences are sufficiently complementary to allow the capture, detection or isolation of the target sequence. In one embodiment, the nucleic acid fragment is a probe or primer that includes an oligonucleotide between about 5 and 25, e.g., between 10 and 20, or 10 and 15 nucleotides in length. In other embodiments, the nucleic acid fragment is a bait that includes an oligonucleotide between about 100 to 300 nucleotides, 130 and 230 nucleotides, or 150 and 200 nucleotides, in length.

In one embodiment, the nucleic acid fragment can be used to identify or capture, e.g., by hybridization, a BICC1-FGFR2 fusion. For example, the nucleic acid fragment can be a probe, a primer, or a bait, for use in identifying or capturing, e.g., by hybridization, a BICC1-FGFR2 fusion described herein. In one embodiment, the nucleic acid fragment can be useful for identifying or capturing a BICC1-FGFR2 breakpoint, e.g., the nucleotide sequence of: chromosome 10 at nucleotide 60,446,461 plus or minus 10, 20, 30, 40 50, 60, 80, 100, 150 nucleotides and chromosome 10 at nucleotide 123,241,845 plus or minus 10, 20, 30, 40 50, 60, 80, 100, 150 nucleotides.

In one embodiment, the nucleic acid fragment hybridizes to a nucleotide sequence within a chromosomal rearrangement that creates an in-frame fusion of intron 2 of BICC1 with intron 16 of FGFR2. In one embodiment, the nucleic acid fragment hybridizes to a nucleotide sequence in the region In other embodiments, the nucleic acid molecules includes a nucleotide sequence in the region of nucleotides 60,446,461 of chromosome 10 coupled to (e.g., juxtaposed to) nucleotides in the region of nucleotides 123,241,845 of chromosome 10. In one embodiment, the nucleic acid fragment hybridizes to a nucleotide sequence that includes a breakpoint, e.g., the nucleotide sequence of: chromosome 10 at nucleotide 60,446,461 plus or minus 10, 20, 30, 40 50, 60, 80, 100, 150 or more nucleotides and chromosome 10 at nucleotide 123,241,845 plus or minus 10, 20, 30, 40 50, 60, 80, 100, 150 or more nucleotides. For example, the nucleic acid fragment can hybridize to a nucleotide sequence that includes the fusion junction between the BICC1 gene and the FGFR2 gene, e.g., a nucleotide sequence that includes a portion of a nucleotide sequence within intron 1 of a BICC1 gene and 19 of an FGFR2 gene.

In another embodiment, the nucleic acid fragment hybridizes to a nucleotide sequence that comprises at least 6, 12, 15, 20, 25, 50, 75, 100, 150 or more nucleotides from exons 1-2 of BICC1 (e.g., from the nucleotide sequence of BICC1 preceding the fusion junction with FGFR2, e.g., of the BICC1 sequence shown in FIG. 98 (SEQ ID NO:107)), and at least 6, 12, 15, 20, 25, 50, 75, 100, 150 or more nucleotides from exon 17 of FGFR2 (e.g., from the nucleotide sequence of FGFR2 following the fusion junction with BICC1, e.g., of the FGFR2 sequence shown in FIG. 92 (SEQ ID NO:99)).

The probes or primers described herein can be used, for example, for FISH detection or PCR amplification. In one exemplary embodiment where detection is based on PCR, amplification of the BICC1-FGFR2 fusion junction fusion junction can be performed using a primer or a primer pair, e.g., for amplifying a sequence flanking the fusion junctions described herein, e.g., the mutations or the junction of a chromosomal rearrangement described herein, e.g., BICC1-FGFR2.

In one embodiment, a pair of isolated oligonucleotide primers can amplify a region containing or adjacent to a position in the BICC1-FGFR2 fusion. For example, forward primers can be designed to hybridize to a nucleotide sequence within BICC1 genomic or mRNA sequence (e.g., a nucleotide sequence within exons 1-2 of BICC1 of SEQ ID NO:107), and the reverse primers can be designed to hybridize to a nucleotide sequence of FGFR2 (e.g., a nucleotide sequence within exon 17 of FGFR2, of SEQ ID NO:99).

In another embodiment, the nucleic acid fragments can be used to identify, e.g., by hybridization, a BICC1-FGFR2 fusion. In one embodiment, the nucleic acid fragment hybridizes to a nucleotide sequence that includes a fusion junction between the BICC1 transcript and the FGFR2 transcript.

In other embodiments, the nucleic acid fragment includes a bait that comprises a nucleotide sequence that hybridizes to a BICC1-FGFR2 fusion nucleic acid molecule described herein, and thereby allows the capture or isolation said nucleic acid molecule. In one embodiment, a bait is suitable for solution phase hybridization. In other embodiments, a bait includes a binding entity, e.g., an affinity tag, that allows capture and separation, e.g., by binding to a binding entity, of a hybrid formed by a bait and a nucleic acid hybridized to the bait.

In other embodiments, the nucleic acid fragment includes a library member comprising a BICC1-FGFR2 nucleic acid molecule described herein. In one embodiment, the library member includes a rearrangement that results in a BICC1-FGFR2 fusion described herein.

The nucleic acid fragment can be detectably labeled with, e.g., a radiolabel, a fluorescent label, a bioluminescent label, a chemiluminescent label, an enzyme label, a binding pair label, or can include an affinity tag; a tag, or identifier (e.g., an adaptor, barcode or other sequence identifier).

BICC1-FGFR2 Fusion Polypeptides

In another embodiment, the BICC1-FGFR2 fusion comprises an amino acid sequence (e.g., a fragment of the amino acid sequence) shown in FIG. 99 (SEQ ID NO:108) and an amino acid sequence (e.g., a fragment of the amino acid sequence) shown in FIG. 93 (SEQ ID NO:100), or a fragment of the fusion. In one embodiment, the BICC1-FGFR2 fusion comprises an amino acid sequence substantially identical to the amino acid sequence (e.g., a fragment of the amino acid sequence) shown in FIG. 99 (SEQ ID NO:108) and the amino acid sequence (e.g., a fragment of the amino acid sequence) shown in FIG. 93 (SEQ ID NO:100), or a fragment thereof. In one embodiment, the BICC1-FGFR2 fusion comprises an amino acid sequence at least 70%, at least 75%, at least 80%, at least 85%, at least 90%, at least 95%, at least 99%, at least 99.5 or greater, identical to the amino acid sequence (e.g., a fragment of the amino acid sequence) shown in FIG. 99 (SEQ ID NO:108) and the amino acid sequence (e.g., a fragment of the amino acid sequence) shown in FIG. 93 (SEQ ID NO:100). In one embodiment, the BICC1-FGFR2 fusion comprises a sequence containing at least 10, 20, 50, 100, 500, 600, 700, 800, 900, 1000, or more amino acids of the amino acid sequence shown in FIG. 99 (SEQ ID NO:108) and FIG. 93 (SEQ ID NO:100). In one embodiment, the BICC1-FGFR2 fusion comprises an amino acid sequence containing at least 5, 10, 20, 50, 100, 500, 600, 700, 800, 900, 1000, or more contiguous amino acids of the amino acid sequence shown in FIG. 99 (SEQ ID NO:108) and at least 5, 10, 20, 50, 100, 500, 600, 700, 800, 900, 1000, or more contiguous amino acids of the amino acid sequence shown in FIG. 93 (SEQ ID NO:100). In one embodiment, the 5' BICC1-3' FGFR2 fusion polypeptide includes an FGFR2 receptor tyrosine kinase domain or a functional fragment thereof. In an embodiment, the 5'BICC1-3'FGFR2 fusion polypeptide comprises sufficient FGFR2 and sufficient BICC1 sequence such that it has kinase activity, e.g., has elevated activity, e.g., FGFR2 kinase activity, as compared with wild type FGFR2, e.g., in a cell of a cancer referred to herein.

In another aspect, the invention features a BICC1-FGFR2 fusion polypeptide (e.g., a purified BICC1-FGFR2 fusion polypeptide), a biologically active or antigenic fragment thereof, as well as reagents (e.g., antibody molecules that bind to a BICC1-FGFR2 fusion polypeptide), methods for modulating a BICC1-FGFR2 polypeptide activity and detection of a BICC1-FGFR2 polypeptide.

In one embodiment, the BICC1-FGFR2 fusion polypeptide has at least one biological activity, e.g., an FGFR2 kinase activity. In one embodiment, at least one biological activity of the BICC1-FGFR2 fusion polypeptide is reduced or inhibited by an anti-cancer drug, e.g., a kinase inhibitor (e.g., a multikinase inhibitor or an FGFR2-specific inhibitor). In one embodiment, at least one biological activity of the BICC1-FGFR2 fusion polypeptide is reduced or inhibited by an FGFR2 kinase inhibitor chosen from e.g., BIBF1120 (Vargatef); Panatinib (AP24534); AZD4547; BGJ398 (NVP-BGJ398); or Brivanib alaninate (BMS-582664).

In yet other embodiments, the BICC1-FGFR2 fusion polypeptide is encoded by a nucleic acid molecule described herein. In one embodiment, the BICC1-FGFR2 fusion polypeptide is encoded by an in-frame fusion of intron 2 of BICC1 with intron 16 of FGFR2 (e.g., a sequence on chromosome 10). In another embodiment, the BICC1-FGFR2 fusion polypeptide includes an amino acid sequence encoded by a nucleotide sequence comprising a fusion junction between the BICC1 transcript and the FGFR2 transcript.

In certain embodiments, the BICC1-FGFR2 fusion polypeptide comprises one or more of encoded exons 1-2 from BICC1 and one or more of encoded exon exon 17 of FGFR2. In certain embodiments, the BICC1-FGFR2 fusion polypeptide comprises at least 1, 2 or more encoded exons from BICC1 and at least 1 or more, encoded exons from FGFR2. In certain embodiments, the BICC1-FGFR2 fusion polypeptide comprises a fusion of encoded exons 1-2 from BICC1 and encoded exon 17 from FGFR2 (or a fragment thereof). In other embodiments, the fusion comprises least 1, 2 encoded exon from BICC1; and at least 1 encoded exons from FGFR2. In certain embodiments, the BICC1-FGFR2 fusion polypeptide comprises encoded exons 1-2 from BICC1 and exon 17 of FGFR2. In certain embodiments, the 5' BICC1-3' FGFR2 fusion polypeptide comprises a fusion junction of the sequence of exons 1-2 from BICC1 and the sequence of exon 17 from FGFR2.

In certain embodiments, the BICC1-FGFR2 fusion comprises the amino acid sequence corresponding to exons 1-2 or a fragment thereof from BICC1, and the amino acid sequence corresponding to exon 17 or a fragment thereof from FGFR2 (e.g., as shown in FIG. 99 (SEQ ID NO:108) and FIG. 93 (SEQ ID NO:100)). In one embodiment, the BICC1-FGFR2 fusion comprises at least 5, 10, 15, 20 or more amino acids from exons 1-2 of BICC1 (e.g., from the amino acid sequence of BICC1 preceding the fusion junction with FGFR2, e.g., of the BICC1 sequence shown in FIG. 99 (SEQ ID NO:108)), and at least 5, 10, 15, 20 or more amino acids from exon 17 of FGFR2 (e.g., from the amino acid sequence of FGFR2 following the fusion junction with BICC1, e.g., of the FGFR2 sequence shown in FIG. 93 (SEQ ID NO:100)).

In one embodiment, the BICC1-FGFR2 fusion polypeptide includes an FGFR2 tyrosine kinase domain or a functional fragment thereof. In a related aspect, the invention features BICC1-FGFR2 fusion polypeptide or fragments operatively linked to heterologous polypeptides to form fusion proteins.

In another embodiment, the BICC1-FGFR2 fusion polypeptide or fragment is a peptide, e.g., an immunogenic peptide or protein, that contains a fusion junction described herein. Such immunogenic peptides or proteins can be used to raise antibodies specific to the fusion protein. In other embodiments, such immunogenic peptides or proteins can be used for vaccine preparation. The vaccine preparation can include other components, e.g., an adjuvant.

In another aspect, the invention features antibody molecules that bind to a BICC1-FGFR2 fusion polypeptide or fragment described herein. In embodiments, the antibody can distinguish wild type FGFR2 (or BICC1) from BICC1-FGFR2.

Detection Reagents and Detection of Mutations

In another aspect, the invention features a detection reagent, e.g., a purified or an isolated preparation thereof. Detection reagents can distinguish a nucleic acid, or protein sequence, having a breakpoint, e.g., a BICC1-FGFR2 breakpoint; from a reference sequence. In one embodiment, the detection reagent detects (e.g., specifically detects) a BICC1-FGFR2 fusion nucleic acid or a polypeptide (e.g., distinguishes a wild type FGFR2 or another FGFR2 fusion (or BICC1) from a BICC1-FGFR2 nucleic acid (e.g., as described herein in FIG. 98 (SEQ ID NO:107) and FIG. 92 (SEQ ID NO:99); or a BICC1-FGFR2 polypeptide (e.g., as described herein in FIG. 99 (SEQ ID NO:108) and FIG. 93 (SEQ ID NO:100).

Detection reagents, e.g., nucleic acid-based detection reagents, can be used to identify mutations in a target nucleic acid, e.g., DNA, e.g., genomic DNA or cDNA, or RNA, e.g., in a sample, e.g., a sample of nucleic acid derived from a neoplastic or tumor cell, e.g., a melanocytic neoplasm, melanoma or metastatic cell. Detection reagents, e.g., antibody-based detection reagents, can be used to identify mutations in a target protein, e.g., in a sample, e.g., a sample of protein derived from, or produced by, a neoplastic or tumor cell, e.g., a melanocytic neoplasm, melanoma or metastatic cell.

Method of Treatment

The FGFR family plays an important role in cell differentiation, growth and angiogenesis (reviewed in Powers C J, McLeskey S W, Wellstein A (2000) Fibroblast growth factors, their receptors and signaling. Endocr Relat Cancer 7(3):165-97), and gain of function mutations in FGFRs have been reported in several cancer types (reviewed in Eswarakumar V P, Lax I, Schlessinger J (2005) Cellular signaling by fibroblast growth factor receptors. Cytokine Growth Factor Rev 16(2):139-49). The BICC1-FGFR2 fusion has not been reported in cholangiocarcinoma, or other cancers. FGFR2 amplification has been reported in several cancer types, most frequently in gastric cancer (3-4%) (Matsumoto K, Arao T, Hamaguchi T, et al. (2012) FGFR2 gene amplification and clinicopathological features in gastric cancer. Br J Cancer 106(4):727-32, Hara T, Ooi A, Kobayashi M, et al. (1998) Amplification of c-myc, K-sam, and c-met in gastric cancers: detection by fluorescence in situ hybridization. Lab Invest 78(9):1143-53) and breast cancer (1-11%) (Heiskanen M, Kononen J, Bärlund M, et al. (2001) CGH, cDNA and tissue microarray analyses implicate FGFR2 amplification in a small subset of breast tumors. Anal Cell Pathol 22(4): 229-34, Adnane J, Gaudray P, Dionne C A, et al. (1991) BEK and FLG, two receptors to members of the FGF family, are amplified in subsets of human breast cancers. Oncogene 6(4):659-63, Turner N, Lambros M B, Horlings H M, et al. (2010) Integrative molecular profiling of triple negative breast cancers identifies amplicon drivers and potential therapeutic targets. Oncogene 29(14):2013-23). Fgfr2 has been shown to be expressed in cholangiocarcinoma, leading to activation of the MEK1/2 pathway (Narong S, Leelawat K (2011) Basic fibroblast growth factor induces cholangiocarcinoma cell migration via activation of the MEK1/2 pathway. Oncol Lett 2(5):821-825). Regorafenib, which inhibits cellular kinases including Fgfr2, has been approved for treatment of some metastatic colorectal cancer (mCRC) patients (FDA.gov, November 2012). Additionally, clinical trials of multiple Fgfr inhibitors are currently underway (Turner N, Grose R (2010) Fibroblast growth factor signalling: from development to cancer. Nat Rev Cancer 10(2): 116-29).

Regorafenib is a multi-kinase inhibitor that inhibits multiple membrane-bound and intracellular kinases, including those in the RET, VEGFR1/2/3, KIT, PDGFR, FGFR1/2, and RAF pathways. Regorafenib has been approved to treat patients with metastatic colorectal cancer who have been previously treated with fluoropyrimidine-, oxaliplatin-, and irinotecan-based chemotherapy, an anti-VEGF therapy, and, if KRAS wild type, an anti-EGFR therapy. Tumors with Fgfr2 activation may be sensitive to regorafenib. Regorafenib is being studied in clinical trials for multiple solid tumor types.

Accordingly, in another aspect, a method of inhibiting, reducing, or treating a hyperproliferative disorder, e.g., a neoplasm (including benign, pre-malignant or malignant (e.g., a cancer), in a subject is provided. The method includes administering to the subject a preselected therapeutic agent, e.g., an anti-cancer agent (e.g., a kinase inhibitor), as a single agent, or in combination, in an amount sufficient to reduce, inhibit or treat the activity or expression of BICC1-FGFR2 (e.g., a BICC1-FGFR2 fusion described herein), thereby inhibiting, reducing, or treating the hyperproliferative disorder in the subject.

In one embodiment, the subject treated has a BICC1-FGFR2 fusion; e.g., the subject has a tumor or cancer harboring a BICC1-FGFR2 fusion. In other embodiments, the subject has been previously identified as having a BICC1-FGFR2 fusion. In yet other embodiments, the subject has been previously identified as being likely or unlikely to respond to treatment with a protein kinase inhibitor, e.g., a subject that has previously participated in a clinical trial. In other embodiments, the subject has been previously identified as being likely or unlikely to respond to treatment with a protein kinase inhibitor, based on the presence of the BICC1-FGFR2 fusion. In one embodiment, the subject is a mammal, e.g., a human. In one embodiment, the subject has, or at risk of having a cancer at any stage of disease. In other embodiments, the subject is a patient, e.g., a cancer patient.

In certain embodiments, the neoplasm or neoplastic cell is a benign, pre-malignant, malignant (cancer) or metastasis. In certain embodiments, the cancer is a solid tumor, a soft tissue tumor, or a metastatic lesion.

In one embodiment, the neoplasm or neoplastic cell is a benign, pre-malignant, malignant (cancer) or metastasis. In certain embodiments, the cancer is a solid tumor, a soft tissue tumor, or a metastatic lesion. In certain embodiments, the cancer is a carcinoma. In certain embodiments, the cancer is a cholangiocarcinoma. In one embodiment, the cancer is a sarcoma. In one embodiment, the cancer is a cholangiosarcoma. In one embodiment, the cancer is a liver cholangiosarcoma. In an embodiment, the cancer is a lung adenocarcinoma. In one embodiment, the cancer is chosen from a lung cancer, a pancreatic cancer, melanoma, a colorectal cancer, an esophageal-gastric cancer, a thyroid cancer, or an adenocarcinoma. In one embodiment, the cancer is a lung adenocarcinoma. In other embodiment, the lung cancer is chosen from one or more of the following: non-small cell lung cancer (NSCLC), small cell lung cancer (SCLC), squamous cell carcinoma (SCC), adenocarcinoma of the lung, bronchogenic carcinoma, or a combination thereof. In one embodiment, the lung cancer is NSCLC or SCC.

In certain embodiments, the cancer is a cholangiocarcinoma. In some embodiments, such cancers of the bile ducts can arise within the liver as an intrahepatic cholangiocarcinoma (ICC) or originate from extrahepatic bile ducts as a bile duct carcinoma also referred to as an extrahepatic cholangiocarcinoma. ICC is the second most common primary hepatic malignancy after hepatocellular carcinoma (HCC) and accounts for 3% of the malignant tumors of the gastrointestinal system and 15% of primary hepatic malignancies. In that ICC has a routine histologic appearance of an adenocarcinoma, the diagnosis of ICC on a liver biopsy requires an immunohistochemical (IHC) study of the tumor and a thorough clinical workup including imaging studies to rule out a metastatic adenocarcinoma to the liver. ICC is associated with primary sclerosing cholangitis, parasitic biliary infection, polycystic disease of the liver, congenital intrahepatic bile duct dilatation (Caroli's Disease), congenital hepatic fibrosis, and choledochal cysts. Chronic Hepatitis C infection is an established cause of ICC with some studies describing a more than 300 fold increase in ICC incidence in patients with long-standing Hepatitis C infections. ICC has also been associated with cigarette smoking, alcohol consumption and exposure to a variety of toxins and chemical carcinogens.

In one embodiment, the anti-cancer agent is a kinase inhibitor. For example, the kinase inhibitor is a multi-kinase inhibitor, an FGF receptor inhibitor (e.g., a pan FGFR2 inhibitor), or a FGFR2-specific inhibitor. In one embodiment, the kinase inhibitor is chosen from one or more of: BIBF1120 (Vargatef); Panatinib (AP24534); AZD4547; BGJ398 (NVP-BGJ398); Brivanib alaninate (BMS-582664), AZD-4547; Regorafenib; Masitinib; Lenvatinib; Dovitinib; Brivanib; Ponatinib; ENMD-2076; AZD-2171 (Cediranib); BIBF1120; LY2874455; and/or JNJ42756493. In some embodiments the FGFR2 inhibitor is a FGFR2 inhibitor described herein.

In one embodiment, the therapeutic agent is an agent that binds and inhibits FGFR2 or BICC1. For example, the therapeutic agent is an antibody molecule (e.g., a monoclonal antibody) against FGFR2; and/or a small molecule (e.g., kinase) inhibitor that is selective for FGFR2 or BICC1.

In another embodiment, the therapeutic agent is selected from antisense molecules, ribozymes, RNAi, triple helix molecules that hybridize to a nucleic acid encoding the fusion, or a transcription regulatory region that blocks or reduces mRNA expression of the fusion.

FGFR3-JAKMIP1 Fusions

In one embodiment, a fusion includes an in-frame fusion of an exon of fibroblast growth factor receptor 3 (FGFR3), e.g., one more exons of FGFR3 (e.g., exons 1-17 of FGFR3) or a fragment thereof, and an exon of janus kinase and microtubule interacting protein 1 (JAKMIP1), e.g., one or more exons of a JAKMIP1 (e.g., exons 4-21 of JAKMIP1) or a fragment thereof. For example, the FGFR3-JAKMIP1 fusion can include an in-frame fusion within an intron of FGFR3 (e.g., intron 18) or a fragment thereof, with an intron of JAKMIP1 (e.g., intron 3) or a fragment thereof. In one embodiment, the fusion of the FGFR3-JAKMIP1 fusion comprises the nucleotide sequence of: chromosome 4 at one or more of nucleotide 1,808,873 (plus or minus 10, 20, 30, 50, 60, 70, 80, 100 or more nucleotides) and chromosome 4 at one or more of nucleotide 6,098,434 (plus or minus 10, 20, 30, 50, 60, 70, 80, 100 or more nucleotides). In one embodiment, the FGFR3-JAKMIP1 fusion is an inversion, e.g., an inversion of a portion of chromosome 4.

In certain embodiments, the FGFR3-JAKMIP1 fusion is in a 5'-FGFR3 to 3'-JAKMIP1 configuration (also referred to herein as "5'-FGFR3-JAKMIP1-3')." The term "fusion" or "fusion molecule" can refer to a polypeptide or a nucleic acid fusion, depending on the context. It may include a full-length sequence of a fusion or a fragment thereof, e.g., a fusion junction (e.g., a fragment including a portion of FGFR3 and a portion of JAKMIP1, e.g., a portion of the FGFR3-JAKMIP1 fusion described herein). In one embodiment, the FGFR3-JAKMIP1 fusion polypeptide includes a fragment of the amino acid sequence shown in FIG. 4 (SEQ ID NO:4) and a fragment of the amino acid sequence shown in FIG. 102 (SEQ ID NO:112), or an amino acid sequence substantially identical thereto. In another embodiment, the FGFR3-JAKMIP1 fusion nucleic acid includes a fragment of the nucleotide sequence shown in FIG. 3 (SEQ ID NO:3) and a fragment of the nucleotide sequence shown in FIG. 101 (SEQ ID NO:111), or a nucleotide sequence substantially identical thereto. In one embodiment, the FGFR3-JAKMIP1 fusion polypeptide comprises sufficient FGFR3 and sufficient JAKMIP1 sequence such that the 5' FGFR3-3' JAKMIP1 fusion has kinase activity, e.g., has elevated activity, e.g., FGFR3 tyrosine kinase activity, as compared with wild type FGFR3, e.g., in a cell of a cancer referred to herein (e.g., carcinoma, e.g., a urothelial (transitional cell) carcinoma, a bladder urothelial carcinoma).

In certain embodiments, the FGFR3-JAKMIP1 fusion comprises exons 1-17 from FGFR3 and exons 4-21 of JAKMIP1 (e.g., one or more of the exons shown in FIG. 3 (SEQ ID NO:3) and FIG. 101 (SEQ ID NO:111). In another embodiment, the FGFR3-JAKMIP1 fusion comprises exons 1-17 of FGFR3 and exons 4-21 of JAKMIP1. In one embodiment, a partial exon 18 is skipped, the FGFR3-JAKMIP1 fusion comprises includes "FGFR3 (exon 1-17)-JAKMIP1 (exon 4-21)." The in-frame sequence reads: FGFR3 end with "TSTD" and JAKMIP1 start with "MDEI". In certain embodiments, the FGFR3-JAKMIP1 fusion comprises at least one or more exons (or encoded exons) from FGFR3 and at least one or more exons (or encoded exons) from JAKMIP1 (e.g., from the FGFR3 and JAKM1P1 sequences shown in FIG. 3 and FIG. 4 (SEQ ID NO:3 and 100) and FIG. 101 and FIG. 102 (SEQ ID NOs:103 and 104).

In certain embodiments, the FGFR3-JAKMIP1 fusion comprises exons 1-17 or a fragment thereof from FGFR3, and exons 4-21 or a fragment thereof from JAKMIP1 (e.g., as shown in FIG. 3 (SEQ ID NO:3) and FIG. 101 (SEQ ID NO:111)). In one embodiment, the FGFR3-JAKMIP1 fusion comprises at least 5, 10, 15, 20, 30, 40, 50 or more amino acids encoded by exons 1-17 of FGFR3 (e.g., from the amino acid sequence of FGFR3 as shown in FIG. 4 (SEQ ID NO:4) (e.g., from the amino acid sequence of FGFR3 preceding the fusion junction with JAKMIP1, and at least 5, 10, 15, 20, 30, 40, 50 or more amino acids encoded by exons 4-21 of JAKMIP1 (e.g., from the amino acid sequence of JAKMIP1 as shown in FIG. 102 (SEQ ID NO:112)). In another embodiment, the FGFR3-JAKMIP1 fusion comprises at least 6, 12, 15, 20, 25, 50, 75, 100 or more nucleotides from exons 1-17 of FGFR3 (e.g., from the nucleotide sequence of FGFR3 as shown in FIG. 3 (SEQ ID NO:3) (e.g., from the nucleotide sequence of FGFR3 preceding the fusion junction with JAKMIP1); and at least 6, 12, 15, 20, 25, 50, 75, 100 or more nucleotides from exons 4-21 of JAKMIP1 (e.g., from the nucleotide sequence of JAKMIP1 as shown in FIG. 101 (SEQ ID NO:111)).

FGFR3-JAKMIP1 Nucleic Acid Molecules

In one aspect, the invention features a nucleic acid molecule (e.g., an isolated or purified) nucleic acid molecule that includes a fragment of a FGFR3 gene and a fragment of a JAKMIP1 gene. In one embodiment, the nucleotide sequence encodes a FGFR3-JAKMIP1 fusion polypeptide that includes a FGFR3 tyrosine kinase domain or a functional fragment thereof. In another embodiment, the nucleotide sequence encodes a fragment of the JAKMIP1 polypeptide including the amino acid sequence of SEQ ID NO:112 or a fragment thereof, or a sequence substantially identical thereto. In other embodiments, the nucleic acid molecule includes a fragment of the FGFR3 gene encoding the amino acid sequence of SEQ ID NO:4 or a fragment thereof, or a sequence substantially identical thereto. In yet other embodiments, the nucleic acid molecule includes a nucleotide sequence encoding the amino acid sequence shown in FIG. 4 (SEQ ID NO:4), or a fragment thereof, and the amino acid sequence shown in FIG. 102 (SEQ ID NO:112) or a fragment thereof, or a sequence substantially identical thereto.

In one embodiment, the nucleic acid molecule includes a fusion, e.g., an in-frame fusion, between an intron of FGFR3 (e.g., intron 18, or a fragment thereof), and an intron of JAKMIP1 (e.g., intron 1, or a fragment thereof). The FGFR3-JAKMIP1 fusion can comprise a fusion of the nucleotide sequence of: chromosome 4 at one or more of nucleotide 1,808,873 (plus or minus 10, 20, 30, 50, 60, 70, 80, 100 nucleotides) and chromosome 4 at one or more of nucleotide 6,098,434 (plus or minus 10, 20, 30, 50, 60, 70, 80, 100 nucleotides), or a fragment thereof. In one embodiment, the FGFR3-JAKMIP1 fusion comprises a fusion of the nucleotide sequence of: chromosome 4 at one or more of nucleotide 1,808,873 (plus or minus 10, 20, 30, 50, 60, 70, 80, 100 nucleotides) and chromosome 4 at one or more of nucleotide 6,098,434 (plus or minus 10, 20, 30, 50, 60, 70, 80, 100 nucleotides), or a fragment thereof.

In another embodiment, the FGFR3-JAKMIP1 fusion comprises a nucleotide sequence (e.g., a fragment of a nucleotide sequence) shown in FIG. 3 (SEQ ID NO:3) and a nucleotide sequence (e.g., a fragment of a nucleotide sequence) shown in FIG. 101 (SEQ ID NO:111), or a fragment of the fusion. In one embodiment, the FGFR3-JAKMIP1 fusion comprises a nucleotide sequence substantially identical to the nucleotide sequence (e.g., a fragment of a nucleotide sequence) shown in FIG. 3 (SEQ ID NO:3) and the nucleotide sequence (e.g., a fragment of a nucleotide sequence) shown FIG. 101 (SEQ ID NO:111), or a fragment of the fusion. In one embodiment, the FGFR3-JAKMIP1 fusion comprises a nucleotide sequence at least 70%, at least 75%, at least 80%, at least 85%, at least 90%, at least 95%, at least 99%, at least 99.5 or greater, identical to the nucleotide sequence (e.g., a fragment of a nucleotide sequence) shown in FIG. 3 (SEQ ID NO:3) and to the nucleotide sequence (e.g., a fragment of a nucleotide sequence) shown in FIG. 101 (SEQ ID NO:111). In one embodiment, the FGFR3-JAKMIP1 fusion comprises a nucleotide sequence containing at least 25, 50, 100, 150, 200, 500, 1000, 1500, 2000, 2500, 3000, or more nucleotides of the nucleotide sequence shown in FIG. 3 (SEQ ID NO:3) and a nucleotide sequence containing at least 25, 50, 100, 150, 200, 500, 1000, 1500, 2000, 2500, 3000, or more nucleotides of the nucleotide sequence shown in FIG. 101 (SEQ ID NO:111). In one embodiment, the FGFR3-JAKMIP1 fusion comprises a nucleotide sequence containing at least 25, 50, 100, 150, 200, 500, 1000, 1500, 2000, 2500, 3000, or more contiguous nucleotides of the nucleotide sequence shown in FIG. 3 (SEQ ID NO:3) and a nucleotide sequence containing at least 25, 50, 100, 150, 200, 500, 1000, 1500, 2000, 2500, 3000, or more nucleotides of the nucleotide sequence shown in FIG. 101 (SEQ ID NO:111).

In another embodiment, the nucleic acid molecule includes a fusion, e.g., an in-frame fusion, of at least exons 1-17 of FGFR3 or a fragment thereof (e.g., exons 1-17 of FGFR3 or a fragment thereof), and at least exons 4-21 or a fragment thereof (e.g., exons 4-21 of JAKMIP1 or a fragment thereof). In yet other embodiments, the nucleic acid molecule includes a fragment the nucleotide sequence shown in FIG. 3 (SEQ ID NO:3) and a fragment of the nucleotide sequence shown in FIG. 101 (SEQ ID NO:111) or a fragment of the fusion, or a sequence substantially identical thereto.

In one embodiment, the nucleic acid molecule is complementary to at least a portion of a nucleotide sequence disclosed herein, e.g., is capable of hybridizing under a stringency condition described herein to SEQ ID NO:3 and/or SEQ ID NO:111, or a fragment thereof. In yet another embodiment, the nucleic acid molecule hybridizes to a nucleotide sequence that is complementary to at least a portion of a nucleotide sequence disclosed herein, e.g., is capable of hybridizing under a stringency condition to a nucleotide sequence complementary to SEQ ID NO:3 and/or SEQ ID NO:111, or a fragment thereof. The nucleotide sequence of a cDNA encoding an exemplary 5' FGFR3-3' JAKMIP1 fusion is shown in at least exons 1-17 (e.g., exons 1-17) of SEQ ID NO:3 and at least exons 4-21 (e.g., exons 4-21) of SEQ ID NO:111, and the predicted amino acid sequence is shown in the corresponding encoded exons of SEQ ID NO:4 and the corresponding encoded exons of SEQ ID NO:112, respectively.

In an embodiment the FGFR3-JAKMIP1 nucleic acid molecule comprises sufficient FGFR3 and sufficient JAKMIP1 sequence such that the encoded 5' FGFR3-3' JAKMIP1 fusion has kinase activity, e.g., has elevated activity, e.g., FGFR3 kinase activity, as compared with wild type FGFR3, e.g., in a cell of a cancer referred to herein. In certain embodiments, the 5' FGFR3-3' JAKMIP1 fusion comprises exons 1-17 from FGFR3 and exons 4-21 from JAKMIP1. In certain embodiments, the FGFR3-JAKMIP1 fusion comprises at least 1, 2, 3, 4, 5, 6, 7, 8, 9, 10, 11, 12, 13, 14, 15, 16 or more exons from FGFR3 and at least 1, 2, 3, 4, 5, 6, 7, 8, 9, 10, 11, 12, 13, 14, 15, 16, 17 or more, exons from JAKMIP1. In certain embodiments, the FGFR3-JAKMIP1 fusion comprises a fusion of exons 1-17 from FGFR3 and exons 4-21 from JAKMIP1. In another embodiment, the FGFR3-JAKMIP1 fusion comprises at least 1, 2, 3, 4, 5, 6, 7, 8, 9, 10, 11, 12, 13, 14, 15, 16 exon from FGFR3; and at least 1, 2, 3, 4, 5, 6, 7, 8, 9, 10, 11, 12, 13, 14, 15, 16, 17 exon from JAKMIP1.

In one embodiment, the nucleic acid molecule includes a nucleotide sequence that has an in-frame fusion of intron 18 of FGFR3 (e.g., NM_000142) with intron 3 of JAKMIP1 (e.g., NM_001099433). In another embodiment, the nucleic acid molecule includes a nucleotide sequence that includes a breakpoint. For example, the nucleic acid molecule includes a nucleotide sequence that includes the fusion junction between the FGFR3 gene and the JAKMIP1 gene, e.g., the breakpoint between intron 18 of FGFR3 and intron 3 of JAKMIP1. In other embodiments, the nucleic acid molecules includes a nucleotide sequence of one or more of nucleotide 1,808,873 of chromosome 4 coupled to (e.g., directly or indirectly juxtaposed to) one or more of nucleotide 6,098,434 of chromosome 4. In one embodiment, the nucleic acid molecule includes the nucleotide sequence of: chromosome 4 at one or more of nucleotide 1,808,873 plus or minus 10, 20, 30, 40 50, 60, 80, 100, 150 nucleotides and chromosome 4 at one or more of nucleotide 6,098,434 plus or minus 10, 20, 30, 40 50, 60, 80, 100, 150 nucleotides (corresponding to the breakpoint of a FGFR3-JAKMIP1 fusion), or a fragment thereof, or a sequence substantially identical thereto. In one embodiment, the nucleic acid molecule is complementary to at least a portion of a nucleotide sequence disclosed herein, e.g., is capable of hybridizing under a stringency condition described herein to SEQ ID NO:3 and/or SEQ ID NO:111 or a fragment thereof. In yet other embodiment, the nucleic acid molecule hybridizes to a nucleotide sequence that is complementary to at least a portion of a nucleotide sequence disclosed herein, e.g., is capable of hybridizing under a stringency condition described herein to a nucleotide sequence complementary to SEQ ID NO:3 or 111 or a fragment thereof.

In another embodiment, the FGFR3-JAKMIP1 fusion nucleic acid comprises at least 6, 12, 15, 20, 25, 50, 75, 100 or more nucleotides from exons 1-17 of FGFR3 (e.g., from the nucleotide sequence of FGFR3 preceding the fusion junction with JAKMIP1, e.g., of the FGFR3 sequence shown in FIG. 3 (SEQ ID NO:3)), and at least 6, 12, 15, 20, 25, 50, 75, 100 or more nucleotides from exons 4-21 of JAKMIP1 (e.g., from the nucleotide sequence of JAKMIP1 following the fusion junction with FGFR3, e.g., of the JAKMIP1 sequence shown in FIG. 101 (SEQ ID NO:111)).

In other embodiments, the nucleic acid molecule includes a nucleotide sequence encoding a FGFR3-JAKMIP1 fusion polypeptide that includes a fragment of a FGFR3 gene and a fragment of an JAKMIP1 gene. In one embodiment, the nucleotide sequence encodes a FGFR3-JAKMIP1 fusion polypeptide that includes e.g., an FGFR3 tyrosine kinase domain or a functional fragment thereof. In yet other embodiments, the nucleic acid molecule includes a nucleotide sequence encoding the amino acid sequence (e.g., a fragment of the amino acid sequence) shown in FIG. 4 (e.g., SEQ ID NO:4) and a nucleotide sequence encoding the amino acid sequence (e.g., a fragment of the amino acid sequence) shown in FIG. 102 (e.g., SEQ ID NO:112), or a fragment of the fusion, or a sequence substantially identical thereto. In one embodiment, the encoded FGFR3-JAKMIP1 fusion polypeptide includes an FGFR3 tyrosine kinase domain or a functional fragment thereof.

In a related aspect, the invention features nucleic acid constructs that include the FGFR3-JAKMIP1 nucleic acid molecules described herein. In certain embodiments, the nucleic acid molecules are operatively linked to a native or a heterologous regulatory sequence. Also included are vectors and host cells that include the FGFR3-JAKMIP1 nucleic acid molecules described herein, e.g., vectors and host cells suitable for producing the nucleic acid molecules and polypeptides described herein.

In a related aspect, methods of producing the nucleic acid molecules and polypeptides described herein are also described.

In another aspect, the invention features nucleic acid molecules that reduce or inhibit the expression of a nucleic acid molecule that encodes a FGFR3-JAKMIP1 fusion described herein. Examples of such nucleic acid molecules include, for example, antisense molecules, ribozymes, RNAi, triple helix molecules that hybridize to a nucleic acid encoding FGFR3-JAKMIP1, or a transcription regulatory region of FGFR3-JAKMIP1, and blocks or reduces mRNA expression of FGFR3-JAKMIP1.

Nucleic Acid Detection and Capturing Reagents

The invention also features a nucleic acid molecule, e.g., nucleic acid fragment, suitable as probe, primer, bait or library member that includes, flanks, hybridizes to, which are useful for identifying, or are otherwise based on, the FGFR3-JAKMIP1 fusions described herein. In certain embodiments, the probe, primer or bait molecule is an oligonucleotide that allows capture, detection or isolation of a FGFR3-JAKMIP1 fusion nucleic acid molecule described herein. The oligonucleotide can comprise a nucleotide sequence substantially complementary to a fragment of the FGFR3-JAKMIP1 fusion nucleic acid molecules described herein. The sequence identity between the nucleic acid fragment, e.g., the oligonucleotide, and the target FGFR3-JAKMIP1 sequence need not be exact, so long as the sequences are sufficiently complementary to allow the capture, detection or isolation of the target sequence. In one embodiment, the nucleic acid fragment is a probe or primer that includes an oligonucleotide between about 5 and 25, e.g., between 10 and 20, or 10 and 15 nucleotides in length. In other embodiments, the nucleic acid fragment is a bait that includes an oligonucleotide between about 100 to 300 nucleotides, 130 and 230 nucleotides, or 150 and 200 nucleotides, in length.

In one embodiment, the nucleic acid fragment can be used to identify or capture, e.g., by hybridization, a FGFR3-JAKMIP1 fusion. For example, the nucleic acid fragment can be a probe, a primer, or a bait, for use in identifying or capturing, e.g., by hybridization, a FGFR3-JAKMIP1 fusion described herein. In one embodiment, the nucleic acid fragment can be useful for identifying or capturing a FGFR3-JAKMIP1 breakpoint, e.g., the nucleotide sequence of: chromosome 4 at nucleotide 1,808,873 plus or minus 10, 20, 30, 40 50, 60, 80, 100, 150 nucleotides and chromosome 4 at nucleotide 6,098,434 plus or minus 10, 20, 30, 40 50, 60, 80, 100, 150 nucleotides.

In one embodiment, the nucleic acid fragment hybridizes to a nucleotide sequence within a chromosomal rearrangement that creates an in-frame fusion of intron 18 of FGFR3 with intron 3 of JAKMIP1. In one embodiment, the nucleic acid fragment hybridizes to a nucleotide sequence in the region In other embodiments, the nucleic acid molecules includes a nucleotide sequence in the region of nucleotides 1,808,873 of chromosome 4 coupled to (e.g., juxtaposed to) nucleotides in the region of nucleotides 6,098,434 of chromosome 4. In one embodiment, the nucleic acid fragment hybridizes to a nucleotide sequence that includes a breakpoint, e.g., the nucleotide sequence of: chromosome 4 at nucleotide 1,808,873 plus or minus 10, 20, 30, 40 50, 60, 80, 100, 150 or more nucleotides and chromosome 4 at nucleotide 6,098,434 plus or minus 10, 20, 30, 40 50, 60, 80, 100, 150 or more nucleotides. For example, the nucleic acid fragment can hybridize to a nucleotide sequence that includes the fusion junction between the FGFR3 gene and the JAKMIP1 gene, e.g., a nucleotide sequence that includes a portion of a nucleotide sequence within introns 14 of a FGFR3 gene and 11 of a JAKMIP1 gene.

In another embodiment, the nucleic acid fragment hybridizes to a nucleotide sequence that comprises at least 6, 12, 15, 20, 25, 50, 75, 100, 150 or more nucleotides from exons 1-17 of FGFR3 (e.g., from the nucleotide sequence of FGFR3 preceding the fusion junction with JAKMIP1, e.g., of the FGFR3 sequence shown in FIG. 3 (SEQ ID NO:3)), and at least 6, 12, 15, 20, 25, 50, 75, 100, 150 or more nucleotides from exons 4-21 of JAKMIP1 (e.g., from the nucleotide sequence of JAKMIP1 following the fusion junction with FGFR3, e.g., of the JAKMIP1 sequence shown in FIG. 101 (SEQ ID NO:111)).

The probes or primers described herein can be used, for example, for FISH detection or PCR amplification. In one exemplary embodiment where detection is based on PCR, amplification of the FGFR3-JAKMIP1 fusion junction fusion junction can be performed using a primer or a primer pair, e.g., for amplifying a sequence flanking the fusion junctions described herein, e.g., the mutations or the junction of a chromosomal rearrangement described herein, e.g., FGFR3-JAKMIP1.

In one embodiment, a pair of isolated oligonucleotide primers can amplify a region containing or adjacent to a position in the FGFR3-JAKMIP1 fusion. For example, forward primers can be designed to hybridize to a nucleotide sequence within FGFR3 genomic or mRNA sequence (e.g., a nucleotide sequence within exons 1-17 of FGFR3 of SEQ ID NO:3), and the reverse primers can be designed to hybridize to a nucleotide sequence of JAKMIP1 (e.g., a nucleotide sequence within exons 4-21 of JAKMIP1, of SEQ ID NO:111).

In another embodiment, the nucleic acid fragments can be used to identify, e.g., by hybridization, a FGFR3-JAKMIP1 fusion. In one embodiment, the nucleic acid fragment hybridizes to a nucleotide sequence that includes a fusion junction between the FGFR3 transcript and the JAKMIP1 transcript.

In other embodiments, the nucleic acid fragment includes a bait that comprises a nucleotide sequence that hybridizes to a FGFR3-JAKMIP1 fusion nucleic acid molecule described herein, and thereby allows the capture or isolation said nucleic acid molecule. In one embodiment, a bait is suitable for solution phase hybridization. In other embodiments, a bait includes a binding entity, e.g., an affinity tag, that allows capture and separation, e.g., by binding to a binding entity, of a hybrid formed by a bait and a nucleic acid hybridized to the bait.

In other embodiments, the nucleic acid fragment includes a library member comprising a FGFR3-JAKMIP1nucleic acid molecule described herein. In one embodiment, the library member includes a rearrangement that results in a FGFR3-JAKMIP1 fusion described herein.

The nucleic acid fragment can be detectably labeled with, e.g., a radiolabel, a fluorescent label, a bioluminescent label, a chemiluminescent label, an enzyme label, a binding pair label, or can include an affinity tag; a tag, or identifier (e.g., an adaptor, barcode or other sequence identifier).

FGFR3-JAKMIP1 Fusion Polypeptides

In another embodiment, the FGFR3-JAKMIP1 fusion comprises an amino acid sequence (e.g., a fragment of the amino acid sequence) shown in FIG. 4 (SEQ ID NO:4) and an amino acid sequence (e.g., a fragment of the amino acid sequence) shown in FIG. 102 (SEQ ID NO:112), or a fragment of the fusion. In one embodiment, the FGFR3-JAKMIP1 fusion comprises an amino acid sequence substantially identical to the amino acid sequence (e.g., a fragment of the amino acid sequence) shown in FIG. 4 (SEQ ID NO:4) and the amino acid sequence (e.g., a fragment of the amino acid sequence) shown in FIG. 102 (SEQ ID NO:112), or a fragment thereof. In one embodiment, the FGFR3-JAKMIP1 fusion comprises an amino acid sequence at least 70%, at least 75%, at least 80%, at least 85%, at least 90%, at least 95%, at least 99%, at least 99.5 or greater, identical to the amino acid sequence (e.g., a fragment of the amino acid sequence) shown in FIG. 4 (SEQ ID NO:4) and the amino acid sequence (e.g., a fragment of the amino acid sequence) shown in FIG. 102 (SEQ ID NO:112). In one embodiment, the FGFR3-JAKMIP1 fusion comprises a sequence containing at least 10, 20, 50, 100, 500, 600, 700, 800, 900, 1000, or more amino acids of the amino acid sequence shown in FIG. 4 (SEQ ID NO:4) and FIG. 102 (SEQ ID NO:112). In one embodiment, the FGFR3-JAKMIP1 fusion comprises an amino acid sequence containing at least 5, 10, 20, 50, 100, 500, 600, 700, 800, 900, 1000, or more contiguous amino acids of the amino acid sequence shown in FIG. 4 (SEQ ID NO:4) and at least 5, 10, 20, 50, 100, 500, 600, 700, 800, 900, 1000, or more contiguous amino acids of the amino acid sequence shown in FIG. 102 (SEQ ID NO:112). In one embodiment, the FGFR3-JAKMIP1 fusion polypeptide includes a FGFR3 receptor tyrosine kinase domain or a functional fragment thereof. In an embodiment, the FGFR3-JAKMIP1 fusion polypeptide comprises sufficient JAKMIP1 and sufficient FGFR3 sequence such that it has kinase activity, e.g., has elevated activity, e.g., FGFR3 kinase activity, as compared with wild type FGFR3, e.g., in a cell of a cancer referred to herein.

In another aspect, the invention features a FGFR3-JAKMIP1 fusion polypeptide (e.g., a purified FGFR3-JAKMIP1 fusion polypeptide), a biologically active or antigenic fragment thereof, as well as reagents (e.g., antibody molecules that bind to a FGFR3-JAKMIP1 fusion polypeptide), methods for modulating a FGFR3-JAKMIP1 polypeptide activity and detection of a FGFR3-JAKMIP1 polypeptide.

In one embodiment, the FGFR3-JAKMIP1 fusion polypeptide has at least one biological activity, e.g., an FGFR3 kinase activity. In one embodiment, at least one biological activity of the FGFR3-JAKMIP1 fusion polypeptide is reduced or inhibited by an anti-cancer drug, e.g., a kinase inhibitor (e.g., a multikinase inhibitor or an FGFR3-specific inhibitor). In one embodiment, at least one biological activity of the FGFR3-JAKMIP1 fusion polypeptide is reduced or inhibited by an FGFR3 kinase inhibitor chosen from e.g., TAE-684 (also referred to herein as "NVP-TAE694"), PF02341066 (also referred to herein as "crizotinib" or "1066"), AF-802, LDK-378, ASP-3026, CEP-37440, CEP-28122, CEP-18050 and AP26113.

In yet other embodiments, the FGFR3-JAKMIP1 fusion polypeptide is encoded by a nucleic acid molecule described herein. In one embodiment, the FGFR3-JAKMIP1 fusion polypeptide is encoded by an in-frame fusion of intron 18 of FGFR3 with intron 3 of JAKMIP1. In another embodiment, the FGFR3-JAKMIP1 fusion polypeptide includes an amino acid sequence encoded by a nucleotide sequence comprising a fusion junction between the FGFR3 transcript and the JAKMIP1 transcript.

In certain embodiments, the FGFR3-JAKMIP1 fusion polypeptide comprises one or more of encoded exons 1-17 from FGFR3 and one or more of encoded exons 4-21 of JAKMIP1. In certain embodiments, the FGFR3-JAKMIP1 fusion polypeptide comprises at least 1, 2, 3, 4, 5, 6, 7, 8, 9, 10, 11, 12, 13, 14, 15, 16 or more encoded exons from FGFR3 and at least 1, 2, 3, 4, 5, 6, 7, 8, 9, 10, 11, 12, 13, 14, 15, 16, 17 or more, encoded exons from JAKMIP1. In certain embodiments, the FGFR3-JAKMIP1 fusion polypeptide comprises a fusion of encoded exons 1-17 from FGFR3 and encoded exons 4-21 from JAKMIP1 (or a fragment thereof). In other embodiments, the fusion comprises least 1, 2, 3, 4, 5, 6, 7, 8, 9, 10, 11, 12, 13, 14, 15, 16 encoded exon from FGFR3; and at least 1, 2, 3, 4, 5, 6, 7, 8, 9, 10, 11, 12, 13, 14, 15, 16, 17 encoded exons from JAKMIP1. In certain embodiments, the FGFR3-JAKMIP1 fusion polypeptide comprises encoded exons 1-17 from FGFR3 and exons 4-21 of JAKMIP1. In certain embodiments, the 5' FGFR3-3' JAKMIP1 fusion polypeptide comprises a fusion junction of the sequence of exons 1-17 from FGFR3 and the sequence of exons 4-21 from JAKMIP1.

In certain embodiments, the FGFR3-JAKMIP1 fusion comprises the amino acid sequence corresponding to exons 1-17 or a fragment thereof from FGFR3, and the amino acid sequence corresponding to exons 4-21 or a fragment thereof from JAKMIP1 (e.g., as shown in FIG. 4 (SEQ ID NO:4) and FIG. 102 (SEQ ID NO:112)). In one embodiment, the FGFR3-JAKMIP1 fusion comprises at least 5, 10, 15, 20 or more amino acids from exons 1-17 of FGFR3 (e.g., from the amino acid sequence of FGFR3 preceding the fusion junction with JAKMIP1, e.g., of the FGFR3 sequence shown in FIG. 4 (SEQ ID NO:4)), and at least 5, 10, 15, 20 or more amino acids from exons 4-21 of JAKMIP1 (e.g., from the amino acid sequence of JAKMIP1 following the fusion junction with FGFR3, e.g., of the JAKMIP1 sequence shown in FIG. 102 (SEQ ID NO:112)).

In one embodiment, the FGFR3-JAKMIP1 fusion polypeptide includes a FGFR3 tyrosine kinase domain or a functional fragment thereof. In a related aspect, the invention features FGFR3-JAKMIP1 fusion polypeptide or fragments operatively linked to heterologous polypeptides to form fusion proteins.

In another embodiment, the FGFR3-JAKMIP1 fusion polypeptide or fragment is a peptide, e.g., an immunogenic peptide or protein, that contains a fusion junction described herein. Such immunogenic peptides or proteins can be used to raise antibodies specific to the fusion protein. In other embodiments, such immunogenic peptides or proteins can be used for vaccine preparation. The vaccine preparation can include other components, e.g., an adjuvant.

In another aspect, the invention features antibody molecules that bind to a FGFR3-JAKMIP1 fusion polypeptide or fragment described herein. In embodiments, the antibody can distinguish wild type JAKMIP1 (or FGFR3) from FGFR3-JAKMIP1.

Detection Reagents and Detection of Mutations

In another aspect, the invention features a detection reagent, e.g., a purified or an isolated preparation thereof. Detection reagents can distinguish a nucleic acid, or protein sequence, having a breakpoint, e.g., a FGFR3-JAKMIP1 breakpoint; from a reference sequence. In one embodiment, the detection reagent detects (e.g., specifically detects) a FGFR3-JAKMIP1 fusion nucleic acid or a polypeptide (e.g., distinguishes a wild type JAKMIP1 or another JAKMIP1 fusion (or FGFR3) from a FGFR3-JAKMIP1 nucleic acid (e.g., as described herein in FIG. 3 (SEQ ID NO:3) and FIG. 101 (SEQ ID NO:111); or a FGFR3-JAKMIP1 polypeptide (e.g., as described herein in FIG. 4 (SEQ ID NO:4) and FIG. 102 (SEQ ID NO:112).

Detection reagents, e.g., nucleic acid-based detection reagents, can be used to identify mutations in a target nucleic acid, e.g., DNA, e.g., genomic DNA or cDNA, or RNA, e.g., in a sample, e.g., a sample of nucleic acid derived from a neoplastic or tumor cell, e.g., a melanocytic neoplasm, melanoma or metastatic cell. Detection reagents, e.g., antibody-based detection reagents, can be used to identify mutations in a target protein, e.g., in a sample, e.g., a sample of protein derived from, or produced by, a neoplastic or tumor cell, e.g., a melanocytic neoplasm, melanoma or metastatic cell.

Method of Treatment

The FGFR family plays an important role in cell differentiation, growth, and angiogenesis, and FGFR amplification and gain of function mutations have been reported in several cancer types (Powers C J, McLeskey S W, Wellstein A (2000) Fibroblast growth factors, their receptors and signaling. Endocr Relat Cancer 7(3):165-97; 11021964, Eswarakumar V P, Lax I, Schlessinger J (2005) Cellular signaling by fibroblast growth factor receptors. Cytokine Growth Factor Rev 16(2):139-49). The rearrangement reported herein is a FGFR3-JAKMIP1 inframe fusion, with breakpoints at FGFR3 exon 18 and JAKMIP1 intron 3. The fusion protein is expected to contain all or most of FGFR3, which has 18 transcribed exons, fused to JAKMIP1 exons 4-12, corresponding to amino acids 279-627 (Mapback, http://cbio.mskcc.org/Mapback/, January 2013). The fusion protein is expected to contain all or most FGFR3 functional domains, including the kinase domain, and some protein interaction domains from JAKMIP1 (uniprot.org). FGFR3 is a commonly mutated gene in urothelial (transitional cell) carcinoma (UC), reported in 45% of urothelial carcinoma in the COSMIC database (COSMIC, December 2012). Frequently observed mutations in bladder cancer are in FGFR3 and TP53; this observation has led to the suggestion that urothelial carcinomas develop through at least two molecular pathways, one related to FGFR3, typically in less invasive tumors, and one related to TP53, characterized by higher grade invasive tumors (Wu X R (2005) Urothelial tumorigenesis: a tale of divergent pathways. Nat Rev Cancer 5(9):713-25). FGFR3 mutations have been associated with low tumor stage and higher survival rate in bladder, ureter, and renal pelvis tumors (van Oers J M, Zwarthoff E C, Rehman I, et al. (2009) FGFR3 mutations indicate better survival in invasive upper urinary tract and bladder tumours. Eur Urol 55(3):650-7). A recent article reported a subset of high grade tumors which harbored FGFR3 mutations and whose cells displayed a distinct morphological appearance (Al-Ahmadie H A, Iyer G, Janakiraman M, et al. (2011) Somatic mutation of fibroblast growth factor receptor-3 (FGFR3) defines a distinct morphological subtype of high-grade urothelial carcinoma. J Pathol 224(2):270-9). Tumors with activating mutations of FGFR3 may be sensitive to Fgfr family inhibitors, and clinical trials of these agents, including pazopanib (FDA-approved for use in renal cell carcinoma and soft tissue sarcoma), are currently underway in solid tumors (Turner N, Grose R (2010) Fibroblast growth factor signalling: from development to cancer. Nat Rev Cancer 10(2):116-29). Additionally, the multi-kinase inhibitor ponatinib (AP24534), recently approved by the FDA for use in chronic myelogenous leukemia, has also been shown to have substantial activity against all four Fgfr kinases (Cortes J E, Kim, D-W, Pinilla-Ibarz J et al. (2012) A Pivotal Phase 2 Trial of Ponatinib in Patients with Chronic Myeloid Leukemia (CML) and Philadelphia Chromosome-Positive Acute Lymphoblastic Leukemia (Ph+ALL) Resistant or Intolerant to Dasatinib or Nilotinib, or with the T315I BCR-ABL Mutation: 12-Month Follow-up of the PACE Trial American Society of Hematology ASH 2012, Abstract 163, Gozgit J M, Wong M J, Moran L, et al. (2012) Ponatinib (AP24534), a multitargeted pan-FGFR inhibitor with activity in multiple FGFR-amplified or mutated cancer models. Mol Cancer Ther 11(3):690-9).

Pazopanib is a tyrosine kinase inhibitor that targets Vegfr1/2/3, Pdgfr-alpha, Fgfr1/3, Kit, Itk, Lck, and c-Fms. Pazopanib has been FDA-approved for the treatment of advanced renal cell carcinoma and soft tissue sarcomas that have progressed after prior chemotherapy. Amplification, overexpression, or constitutive activation of FGFR3 may predict sensitivity to pazopanib. Clinical trials of pazopanib are in progress in multiple tumor types. A Phase 2 trial of single-agent pazopanib in advanced urothelial cancer reported partial responses in 7/41 patients enrolled in the study and stable disease in 14/41 patients, resulting in a disease control rate of 51.2% (Necchi A, Mariani L, Zaffaroni N, et al. (2012) Pazopanib in advanced and platinum-resistant urothelial cancer: an open-label, single group, phase 2 trial. Lancet Oncol 13(8):810-6).

Ponatinib is a multi-kinase inhibitor targeting BCR-ABL, as well as VEGFRs and FGFRs. Ponatinib has been approved by the FDA for use in chronic myeloid leukemia (CML) and Philadelphia chromosome-positive acute lymphoblastic leukemia (ALL). Activating mutations or amplification of FGFR3 may predict sensitivity to ponatinib (Gozgit J M, Wong M J, Moran L, et al. (2012) Ponatinib (AP24534), a multitargeted pan-FGFR inhibitor with activity in multiple FGFR-amplified or mutated cancer models. Mol Cancer Ther 11(3):690-9). Ponatinib has not yet been studied in clinical trials in transitional cell carcinoma.

Accordingly, in another aspect, a method of inhibiting, reducing, or treating a hyperproliferative disorder, e.g., a neoplasm (including benign, pre-malignant or malignant (e.g., a cancer), in a subject is provided. The method includes administering to the subject a preselected therapeutic agent, e.g., an anti-cancer agent (e.g., an inhibitor), as a single agent, or in combination, in an amount sufficient to reduce, inhibit or treat the activity or expression of FGFR3-JAKMIP1 (e.g., a FGFR3-JAKMIP1 fusion described herein), thereby inhibiting, reducing, or treating the hyperproliferative disorder in the subject.

In one embodiment, the subject treated has a FGFR3-JAKMIP1 fusion; e.g., the subject has a tumor or cancer harboring a FGFR3-JAKMIP1 fusion. In other embodiments, the subject has been previously identified as having a FGFR3-JAKMIP1 fusion. In yet other embodiments, the subject has been previously identified as being likely or unlikely to respond to treatment with a protein kinase inhibitor, e.g., a subject that has previously participated in a clinical trial. In other embodiments, the subject has been previously identified as being likely or unlikely to respond to treatment with a protein kinase inhibitor, based on the presence of the FGFR3-JAKMIP1 fusion. In one embodiment, the subject is a mammal, e.g., a human. In one embodiment, the subject has, or at risk of having a cancer at any stage of disease. In other embodiments, the subject is a patient, e.g., a cancer patient.

In certain embodiments, the neoplasm or neoplastic cell is a benign, pre-malignant, malignant (cancer) or metastasis. In certain embodiments, the cancer is a solid tumor, a soft tissue tumor, or a metastatic lesion.

In one embodiment, the neoplasm or neoplastic cell is a benign, pre-malignant, malignant (cancer) or metastasis. In certain embodiments, the cancer is a solid tumor, a soft tissue tumor, or a metastatic lesion. In one embodiment, the cancer is an urothelial (transitional cell) carcinoma. In one embodiment, the cancer is a bladder urithelial carcinoma. In one embodiment, the cancer is chosen from a lung cancer, a pancreatic cancer, melanoma, a colorectal cancer, an esophageal-gastric cancer, a thyroid cancer, or an adenocarcinoma. In other embodiment, the lung cancer is chosen from one or more of the following: non-small cell lung cancer (NSCLC), small cell lung cancer (SCLC), squamous cell carcinoma (SCC), adenocarcinoma of the lung, bronchogenic carcinoma, or a combination thereof. In one embodiment, the lung cancer is NSCLC or SCC.

In one embodiment, the anti-cancer agent is a kinase inhibitor. For example, the kinase inhibitor is a multi-kinase inhibitor or a FGFR3-specific inhibitor. In one embodiment, the kinase inhibitor is a FGFR3 inhibitor including, but not limited to, TAE-684 (also referred to herein as "NVP-TAE694"), PF02341066 (also referred to herein as "crizotinib" or "1066"), AF-802, LDK-378, ASP-3026, BGJ398, CEP-37440, CEP-28122, CEP-18050 TKI258, and AP26113. In some embodiments the FGFR3 inhibitor is a FGFR3 inhibitor described herein.

MASP2-MTOR Fusions

In one embodiment, a fusion includes an in-frame fusion of an exon of mannan-binding lectin serine peptidase 2 (MASP2), e.g., one more exons of MASP2 (e.g., one or more of exons 1, 2, 3 of MASP2) or a fragment thereof, and an exon of mammalian target of rapamycin complex 1 (MTOR), e.g., one or more exons of an MTOR (e.g., one or more of exons 9-58 of MTOR) or a fragment thereof. For example, the MASP2-MTOR fusion can include an in-frame fusion within an intron of MASP2 (e.g., intron 3) or a fragment thereof, with an intron of MTOR (e.g., intron 8) or a fragment thereof. In one embodiment, the fusion of the MASP2-MTOR fusion comprises the nucleotide sequence of: chromosome 1 at one or more of nucleotide 11,105,957 (plus or minus 10, 20, 30, 50, 60, 70, 80, 100 or more nucleotides) and chromosome 1 at one or more of nucleotide 11,303,421 (plus or minus 10, 20, 30, 50, 60, 70, 80, 100 or more nucleotides).

In certain embodiments, the MASP2-MTOR fusion is in a 5'-MASP2 to 3'-MTOR configuration (also referred to herein as "5'-MASP2-MTOR-3')." The term "fusion" or "fusion molecule" can refer to a polypeptide or a nucleic acid fusion, depending on the context. It may include a full-length sequence of a fusion or a fragment thereof, e.g., a fusion junction (e.g., a fragment including a portion of MASP2 and a portion of MTOR, e.g., a portion of the MASP2-MTOR fusion described herein). In one embodiment, the MASP2-MTOR fusion polypeptide includes a fragment of the amino acid sequence shown in FIG. 105 (SEQ ID NO:116) and a fragment of the amino acid sequence shown in FIG. 107 (SEQ ID NO:118), or an amino acid sequence substantially identical thereto. In another embodiment, the MASP2-MTOR fusion nucleic acid includes a fragment of the nucleotide sequence shown in FIG. 104 (SEQ ID NO:115) and a fragment of the nucleotide sequence shown in FIG. 106 (SEQ ID NO:117), or a nucleotide sequence substantially identical thereto. In one embodiment, the MASP2-MTOR fusion polypeptide comprises sufficient MASP2 and sufficient MTOR sequence such that the 5' MASP2-3' MTOR fusion has kinase activity, e.g., has elevated activity, e.g., MTOR serine threonine kinase activity, as compared with wild type MTOR, e.g., in a cell of a cancer referred to herein (e.g., cervical squamous cell carcinoma). In certain embodiments, the MTOR sequence has a kinase domain, e.g., a serine/threonine kinase domain, e.g., it may have serine threonine kinase activity.

In certain embodiments, the MASP2-MTOR fusion comprises one or more (or all of) exons 1, 2, 3 from MASP2 and one or more (or all of) exons 9-58 of MTOR (e.g., one or more of the exons shown in FIG. 104 (SEQ ID NO:115) and FIG. 106 (SEQ ID NO:117). In another embodiment, the MASP2-MTOR fusion comprises one or more (or all of) exons 1-3 of MASP2 and one or more (or all of) exons 9-58 of MTOR. In certain embodiments, the MASP2-MTOR fusion comprises at least 1, 2, 3 or more exons (or encoded exons) from MASP2 and at least 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 29, 40, 41, 42, 43, 44, 45, 46, 47, 48, 49 or more exons (or encoded exons) from MTOR (e.g., from the MASP2 and MTOR sequences shown in FIG. 104 and FIG. 105 (SEQ ID NO:115 and 116) and FIG. 106 and FIG. 107 (SEQ ID NOs:117 and 118)).

In certain embodiments, the MASP2-MTOR fusion comprises exons 3 or a fragment thereof from MASP2, and exon 9 or a fragment thereof from MTOR (e.g., as shown in FIG. 104 (SEQ ID NO:115) and FIG. 106 (SEQ ID NO:117)). In one embodiment, the MASP2-MTOR fusion comprises at least 5, 10, 15, 20, 30, 40, 50 or more amino acids from exon 3 of MASP2 (e.g., from the amino acid sequence of MASP2 as shown in FIG. 105 (SEQ ID NO:116) (e.g., from the amino acid sequence of MASP2 preceding the fusion junction with MTOR, and at least 5, 10, 15, 20, 30, 40, 50 or more amino acids from exon 9 of MTOR (e.g., from the amino acid sequence of MTOR as shown in FIG. 107 (SEQ ID NO:118)). In another embodiment, the MASP2-MTOR fusion comprises at least 6, 12, 15, 20, 25, 50, 75, 100 or more nucleotides from exons 3 of MASP2 (e.g., from the nucleotide sequence of MASP2 as shown in FIG. 104 (SEQ ID NO:115) (e.g., from the nucleotide sequence of MASP2 preceding the fusion junction with MTOR); and at least 6, 12, 15, 20, 25, 50, 75, 100 or more nucleotides from exon 9 of MTOR (e.g., from the nucleotide sequence of MTOR as shown in FIG. 106 (SEQ ID NO:117).

MASP2-MTOR Nucleic Acid Molecules

In one aspect, the invention features a nucleic acid molecule (e.g., an isolated or purified) nucleic acid molecule that includes a fragment of a MASP2 gene and a fragment of am MTOR gene. In one embodiment, the nucleotide sequence encodes a MASP2-MTOR fusion polypeptide that includes an MTOR serine threonine kinase domain or a functional fragment thereof. In another embodiment, the nucleotide sequence encodes a fragment of the MTOR polypeptide including the amino acid sequence of SEQ ID NO:118 or a fragment thereof, or a sequence substantially identical thereto. In other embodiments, the nucleic acid molecule includes a fragment of the MASP2 gene encoding the amino acid sequence of SEQ ID NO:116 or a fragment thereof, or a sequence substantially identical thereto. In yet other embodiments, the nucleic acid molecule includes a nucleotide sequence encoding the amino acid sequence shown in FIG. 105 (SEQ ID NO:116), or a fragment thereof, and the amino acid sequence shown in FIG. 107 (SEQ ID NO:118) or a fragment thereof, or a sequence substantially identical thereto.

In one embodiment, the nucleic acid molecule includes a fusion, e.g., an in-frame fusion, between an intron of MASP2 (e.g., intron 3, or a fragment thereof), and an intron of MTOR (e.g., intron 8, or a fragment thereof). The MASP2-MTOR fusion can comprise a fusion of the nucleotide sequence of: chromosome 1 at one or more of nucleotide 11,105,957 (plus or minus 10, 20, 30, 50, 60, 70, 80, 100 nucleotides) and chromosome 1 at one or more of nucleotide 11,303,421 (plus or minus 10, 20, 30, 50, 60, 70, 80, 100 nucleotides), or a fragment thereof. In one embodiment, the MASP2-MTOR fusion comprises a fusion of the nucleotide sequence of: chromosome 1 at one or more of nucleotide 11,105,957 (plus or minus 10, 20, 30, 50, 60, 70, 80, 100 nucleotides) and chromosome 1 at one or more of nucleotide 11,303,421 (plus or minus 10, 20, 30, 50, 60, 70, 80, 100 nucleotides), or a fragment thereof.

In another embodiment, the MASP2-MTOR fusion comprises a nucleotide sequence (e.g., a fragment of a nucleotide sequence) shown in FIG. 104 (SEQ ID NO:115) and a nucleotide sequence (e.g., a fragment of a nucleotide sequence) shown in FIG. 106 (SEQ ID NO:117), or a fragment of the fusion. In one embodiment, the MASP2-MTOR fusion comprises a nucleotide sequence substantially identical to the nucleotide sequence (e.g., a fragment of a nucleotide sequence) shown in FIG. 104 (SEQ ID NO:115)

and the nucleotide sequence (e.g., a fragment of a nucleotide sequence) shown FIG. 106 (SEQ ID NO:117), or a fragment of the fusion. In one embodiment, the MASP2-MTOR fusion comprises a nucleotide sequence at least 70%, at least 75%, at least 80%, at least 85%, at least 90%, at least 95%, at least 99%, at least 99.5 or greater, identical to the nucleotide sequence (e.g., a fragment of a nucleotide sequence) shown in FIG. 104 (SEQ ID NO:115) and to the nucleotide sequence (e.g., a fragment of a nucleotide sequence) shown in FIG. 106 (SEQ ID NO:117). In one embodiment, the MASP2-MTOR fusion comprises a nucleotide sequence containing at least 25, 50, 100, 150, 200, 500, 1000, 1500, 2000, 2500, 3000, or more nucleotides of the nucleotide sequence shown in FIGS. 104A-59C (SEQ ID NO:115) and a nucleotide sequence containing at least 25, 50, 100, 150, 200, 500, 1000, 1500, 2000, 2500, 3000, or more nucleotides of the nucleotide sequence shown in FIG. 106 (SEQ ID NO:117). In one embodiment, the MASP2-MTOR fusion comprises a nucleotide sequence containing at least 25, 50, 100, 150, 200, 500, 1000, 1500, 2000, 2500, 3000, or more contiguous nucleotides of the nucleotide sequence shown in FIG. 104 (SEQ ID NO:115) and a nucleotide sequence containing at least 25, 50, 100, 150, 200, 500, 1000, 1500, 2000, 2500, 3000, or more nucleotides of the nucleotide sequence shown in FIG. 106 (SEQ ID NO:117).

In another embodiment, the nucleic acid molecule includes a fusion, e.g., an in-frame fusion, of at least exons 3 of MASP2 or a fragment thereof (e.g., one or more of exons 1, 2, 3 of MASP2 or a fragment thereof), and at least exon 9 or a fragment thereof (e.g., one or more of exons exons 9-58 of MTOR or a fragment thereof). In yet other embodiments, the nucleic acid molecule includes a fragment the nucleotide sequence shown in FIG. 104 (SEQ ID NO:115) and a fragment of the nucleotide sequence shown in FIG. 106 (SEQ ID NO:117) or a fragment of the fusion, or a sequence substantially identical thereto.

In one embodiment, the nucleic acid molecule is complementary to at least a portion of a nucleotide sequence disclosed herein, e.g., is capable of hybridizing under a stringency condition described herein to SEQ ID NO:115 and/or SEQ ID NO:117, or a fragment thereof. In yet another embodiment, the nucleic acid molecule hybridizes to a nucleotide sequence that is complementary to at least a portion of a nucleotide sequence disclosed herein, e.g., is capable of hybridizing under a stringency condition to a nucleotide sequence complementary to SEQ ID NO:115 and/or SEQ ID NO:117, or a fragment thereof. The nucleotide sequence of a cDNA encoding an exemplary 5' MASP2-3' MTOR fusion is shown in at least exons 3 (e.g., exons 1, 2, 3) of SEQ ID NO:115 and at least exon 9 (e.g., exons 9-58) of SEQ ID NO:117, and the predicted amino acid sequence is shown in the corresponding encoded exons of SEQ ID NO:116 and the corresponding encoded exons of SEQ ID NO:118, respectively.

In an embodiment the MASP2-MTOR nucleic acid molecule comprises sufficient MASP2 and sufficient MTOR sequence such that the encoded 5' MASP2-3' MTOR fusion has kinase activity, e.g., has elevated activity, e.g., MTOR kinase activity, as compared with wild type MTOR, e.g., in a cell of a cancer referred to herein. In certain embodiments, the 5' MASP2-3' MTOR fusion comprises exons 1, 2, 3 from MASP2 and exon exons 9-58 from MTOR. In certain embodiments, the MASP2-MTOR fusion comprises at least 1 or more exons from MASP2 and at least 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 29, 40, 41, 42, 43, 44, 45, 46, 47, 48, 49 or more, exons from MTOR. In certain embodiments, the MASP2-MTOR fusion comprises a fusion of exons 1, 2, 3 from MASP2 and exon 9 from MTOR. In another embodiment, the MASP2-MTOR fusion comprises at least 1 exons from MASP2; and at least 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 29, 40, 41, 42, 43, 44, 45, 46, 47, 48, 49 exons from MTOR.

In one embodiment, the nucleic acid molecule includes a nucleotide sequence that has an in-frame fusion of intron 3 of MASP2 (e.g., NM_006610) with intron 8 of MTOR (e.g., NM_004958). In another embodiment, the nucleic acid molecule includes a nucleotide sequence that includes a breakpoint. For example, the nucleic acid molecule includes a nucleotide sequence that includes the fusion junction between the MASP2 gene and the MTOR gene, e.g., the breakpoint between intron 3 of MASP2 and intron 8 of MTOR. In other embodiments, the nucleic acid molecules includes a nucleotide sequence of one or more of nucleotide 11,105,957 of chromosome 1 coupled to (e.g., directly or indirectly juxtaposed to) one or more of nucleotide 11,303, 421 of chromosome 1. In one embodiment, the nucleic acid molecule includes the nucleotide sequence of: chromosome 1 at one or more of nucleotide 11,105,957 plus or minus 10, 20, 30, 40 50, 60, 80, 100, 150 nucleotides and chromosome 1 at one or more of nucleotide 11,303,421 plus or minus 10, 20, 30, 40 50, 60, 80, 100, 150 nucleotides (corresponding to the breakpoint of a MASP2-MTOR fusion), or a fragment thereof, or a sequence substantially identical thereto. In one embodiment, the nucleic acid molecule is complementary to at least a portion of a nucleotide sequence disclosed herein, e.g., is capable of hybridizing under a stringency condition described herein to SEQ ID NO:115 and/or SEQ ID NO:117 or a fragment thereof. In yet other embodiment, the nucleic acid molecule hybridizes to a nucleotide sequence that is complementary to at least a portion of a nucleotide sequence disclosed herein, e.g., is capable of hybridizing under a stringency condition described herein to a nucleotide sequence complementary to SEQ ID NO:115 or 117 or a fragment thereof.

In another embodiment, the MASP2-MTOR fusion nucleic acid comprises at least 6, 12, 15, 20, 25, 50, 75, 100 or more nucleotides from exons 1-3 of MASP2 (e.g., from the nucleotide sequence of MASP2 preceding the fusion junction with MTOR, e.g., of the MASP2 sequence shown in FIG. 104 (SEQ ID NO:115)), and at least 6, 12, 15, 20, 25, 50, 75, 100 or more nucleotides from exon 9-58 of MTOR (e.g., from the nucleotide sequence of MTOR following the fusion junction with MASP2, e.g., of the MTOR sequence shown in FIG. 106 (SEQ ID NO:117)).

In other embodiments, the nucleic acid molecule includes a nucleotide sequence encoding a MASP2-MTOR fusion polypeptide that includes a fragment of a MASP2 gene and a fragment of an MTOR gene. In one embodiment, the nucleotide sequence encodes a MASP2-MTOR fusion polypeptide that includes e.g., an MTOR serine threonine kinase domain or a functional fragment thereof. In yet other embodiments, the nucleic acid molecule includes a nucleotide sequence encoding the amino acid sequence (e.g., a fragment of the amino acid sequence) shown in FIG. 105 (e.g., SEQ ID NO:116) and a nucleotide sequence encoding the amino acid sequence (e.g., a fragment of the amino acid sequence) shown in FIG. 107 (e.g., SEQ ID NO:118), or a fragment of the fusion, or a sequence substantially identical thereto. In one embodiment, the encoded MASP2-MTOR fusion polypeptide includes an MTOR serine threonine kinase domain or a functional fragment thereof.

In a related aspect, the invention features nucleic acid constructs that include the MASP2-MTOR nucleic acid molecules described herein. In certain embodiments, the nucleic acid molecules are operatively linked to a native or a heterologous regulatory sequence. Also included are vectors and host cells that include the MASP2-MTOR nucleic acid molecules described herein, e.g., vectors and host cells suitable for producing the nucleic acid molecules and polypeptides described herein.

In a related aspect, methods of producing the nucleic acid molecules and polypeptides described herein are also described.

In another aspect, the invention features nucleic acid molecules that reduce or inhibit the expression of a nucleic acid molecule that encodes a MASP2-MTOR fusion described herein. Examples of such nucleic acid molecules include, for example, antisense molecules, ribozymes, RNAi, triple helix molecules that hybridize to a nucleic acid encoding MASP2-MTOR, or a transcription regulatory region of MASP2-MTOR, and blocks or reduces mRNA expression of MASP2-MTOR.

Nucleic Acid Detection and Capturing Reagents

The invention also features a nucleic acid molecule, e.g., nucleic acid fragment, suitable as probe, primer, bait or library member that includes, flanks, hybridizes to, which are useful for identifying, or are otherwise based on, the MASP2-MTOR fusions described herein. In certain embodiments, the probe, primer or bait molecule is an oligonucleotide that allows capture, detection or isolation of a MASP2-MTOR fusion nucleic acid molecule described herein. The oligonucleotide can comprise a nucleotide sequence substantially complementary to a fragment of the MASP2-MTOR fusion nucleic acid molecules described herein. The sequence identity between the nucleic acid fragment, e.g., the oligonucleotide, and the target MASP2-MTOR sequence need not be exact, so long as the sequences are sufficiently complementary to allow the capture, detection or isolation of the target sequence. In one embodiment, the nucleic acid fragment is a probe or primer that includes an oligonucleotide between about 5 and 25, e.g., between 10 and 20, or 10 and 15 nucleotides in length. In other embodiments, the nucleic acid fragment is a bait that includes an oligonucleotide between about 100 to 300 nucleotides, 130 and 230 nucleotides, or 150 and 200 nucleotides, in length.

In one embodiment, the nucleic acid fragment can be used to identify or capture, e.g., by hybridization, a MASP2-MTOR fusion. For example, the nucleic acid fragment can be a probe, a primer, or a bait, for use in identifying or capturing, e.g., by hybridization, a MASP2-MTOR fusion described herein. In one embodiment, the nucleic acid fragment can be useful for identifying or capturing a MASP2-MTOR breakpoint, e.g., the nucleotide sequence of: chromosome 1 at nucleotide 11,105,957 plus or minus 10, 20, 30, 40 50, 60, 80, 100, 150 nucleotides and chromosome 1 at nucleotide 11,303,421 plus or minus 10, 20, 30, 40 50, 60, 80, 100, 150 nucleotides.

In one embodiment, the nucleic acid fragment hybridizes to a nucleotide sequence within a chromosomal rearrangement that creates an in-frame fusion of intron 3 of MASP2 with intron 8 of MTOR. In one embodiment, the nucleic acid fragment hybridizes to a nucleotide sequence in the region In other embodiments, the nucleic acid molecules includes a nucleotide sequence in the region of nucleotides 11,105, 957 of chromosome 1 coupled to (e.g., juxtaposed to) nucleotides in the region of nucleotides 11,303,421 of chromosome 1. In one embodiment, the nucleic acid fragment hybridizes to a nucleotide sequence that includes a breakpoint, e.g., the nucleotide sequence of: chromosome 1 at nucleotide 11,105,957 plus or minus 10, 20, 30, 40 50, 60, 80, 100, 150 or more nucleotides and chromosome 1 at nucleotide 11,303,421 plus or minus 10, 20, 30, 40 50, 60, 80, 100, 150 or more nucleotides. For example, the nucleic acid fragment can hybridize to a nucleotide sequence that includes the fusion junction between the MASP2 gene and the MTOR gene, e.g., a nucleotide sequence that includes a portion of a nucleotide sequence within intron 3 of a MASP2 gene and 19 of an MTOR gene.

In another embodiment, the nucleic acid fragment hybridizes to a nucleotide sequence that comprises at least 6, 12, 15, 20, 25, 50, 75, 100, 150 or more nucleotides from exons 1, 2, 3 of MASP2 (e.g., from the nucleotide sequence of MASP2 preceding the fusion junction with MTOR, e.g., of the MASP2 sequence shown in FIG. 104 (SEQ ID NO:115)), and at least 6, 12, 15, 20, 25, 50, 75, 100, 150 or more nucleotides from exon 9 of MTOR (e.g., from the nucleotide sequence of MTOR following the fusion junction with MASP2, e.g., of the MTOR sequence shown in FIG. 106 (SEQ ID NO:117)).

The probes or primers described herein can be used, for example, for FISH detection or PCR amplification. In one exemplary embodiment where detection is based on PCR, amplification of the MASP2-MTOR fusion junction fusion junction can be performed using a primer or a primer pair, e.g., for amplifying a sequence flanking the fusion junctions described herein, e.g., the mutations or the junction of a chromosomal rearrangement described herein, e.g., MASP2-MTOR.

In one embodiment, a pair of isolated oligonucleotide primers can amplify a region containing or adjacent to a position in the MASP2-MTOR fusion. For example, forward primers can be designed to hybridize to a nucleotide sequence within MASP2 genomic or mRNA sequence (e.g., a nucleotide sequence within exons 1-3 of MASP2 of SEQ ID NO:115), and the reverse primers can be designed to hybridize to a nucleotide sequence of MTOR (e.g., a nucleotide sequence within exons 9-58 of MTOR, of SEQ ID NO:117).

In another embodiment, the nucleic acid fragments can be used to identify, e.g., by hybridization, a MASP2-MTOR fusion. In one embodiment, the nucleic acid fragment hybridizes to a nucleotide sequence that includes a fusion junction between the MASP2 transcript and the MTOR transcript.

In other embodiments, the nucleic acid fragment includes a bait that comprises a nucleotide sequence that hybridizes to a MASP2-MTOR fusion nucleic acid molecule described herein, and thereby allows the capture or isolation said nucleic acid molecule. In one embodiment, a bait is suitable for solution phase hybridization. In other embodiments, a bait includes a binding entity, e.g., an affinity tag, that allows capture and separation, e.g., by binding to a binding entity, of a hybrid formed by a bait and a nucleic acid hybridized to the bait.

In other embodiments, the nucleic acid fragment includes a library member comprising a MASP2-MTOR nucleic acid molecule described herein. In one embodiment, the library member includes a rearrangement that results in a MASP2-MTOR fusion described herein.

The nucleic acid fragment can be detectably labeled with, e.g., a radiolabel, a fluorescent label, a bioluminescent label, a chemiluminescent label, an enzyme label, a binding pair label, or can include an affinity tag; a tag, or identifier (e.g., an adaptor, barcode or other sequence identifier).

MASP2-MTOR Fusion Polypeptides

In another embodiment, the MASP2-MTOR fusion comprises an amino acid sequence (e.g., a fragment of the amino acid sequence) shown in FIG. 105 (SEQ ID NO:116) and an amino acid sequence (e.g., a fragment of the amino acid sequence) shown in FIG. 107 (SEQ ID NO:118), or a fragment of the fusion. In one embodiment, the MASP2-MTOR fusion comprises an amino acid sequence substantially identical to the amino acid sequence (e.g., a fragment of the amino acid sequence) shown in FIG. 105 (SEQ ID NO:116) and the amino acid sequence (e.g., a fragment of the amino acid sequence) shown in FIG. 107 (SEQ ID NO:118), or a fragment thereof. In one embodiment, the MASP2-MTOR fusion comprises an amino acid sequence at least 70%, at least 75%, at least 80%, at least 85%, at least 90%, at least 95%, at least 99%, at least 99.5 or greater, identical to the amino acid sequence (e.g., a fragment of the amino acid sequence) shown in FIG. 105 (SEQ ID NO:116) and the amino acid sequence (e.g., a fragment of the amino acid sequence) shown in FIG. 107 (SEQ ID NO:118). In one embodiment, the MASP2-MTOR fusion comprises a sequence containing at least 10, 20, 50, 100, 500, 600, 700, 800, 900, 1000, or more amino acids of the amino acid sequence shown in FIG. 105 (SEQ ID NO:116) and FIG. 107 (SEQ ID NO:118). In one embodiment, the MASP2-MTOR fusion comprises an amino acid sequence containing at least 5, 10, 20, 50, 100, 500, 600, 700, 800, 900, 1000, or more contiguous amino acids of the amino acid sequence shown in FIG. 105 (SEQ ID NO:116) and at least 5, 10, 20, 50, 100, 500, 600, 700, 800, 900, 1000, or more contiguous amino acids of the amino acid sequence shown in FIG. 107 (SEQ ID NO:118). In one embodiment, the 5' MASP2-3' MTOR fusion polypeptide includes an MTOR receptor serine threonine kinase domain or a functional fragment thereof. In an embodiment, the 5'MASP2-3'MTOR fusion polypeptide comprises sufficient MTOR and sufficient MASP2 sequence such that it has kinase activity, e.g., has elevated activity, e.g., MTOR kinase activity, as compared with wild type MTOR, e.g., in a cell of a cancer referred to herein.

In another aspect, the invention features a MASP2-MTOR fusion polypeptide (e.g., a purified MASP2-MTOR fusion polypeptide), a biologically active or antigenic fragment thereof, as well as reagents (e.g., antibody molecules that bind to a MASP2-MTOR fusion polypeptide), methods for modulating a MASP2-MTOR polypeptide activity and detection of a MASP2-MTOR polypeptide.

In one embodiment, the MASP2-MTOR fusion polypeptide has at least one biological activity, e.g., an MTOR kinase activity. In one embodiment, at least one biological activity of the MASP2-MTOR fusion polypeptide is reduced or inhibited by an anti-cancer drug, e.g., a kinase inhibitor (e.g., a multikinase inhibitor or an MTOR-specific inhibitor). In one embodiment, at least one biological activity of the MASP2-MTOR fusion polypeptide is reduced or inhibited by an MTOR kinase inhibitor chosen from e.g., BEZ235 (NVP-BEZ235); Everolimus (RAD001); Rapamycin (Sirolimus, AY-22989, WY-090217); AZD8055; Temsirolimus (CCI-779, Torisel); PI-103; Ku-0063794; Deforolimus (Ridaforolimus, AP23573, MK-8669); PP242; XL765; GSK1059615; WYE-354; OSI-027; GDC-0980 (RG7422); GSK2126458; PF-05212384 (PKI-587); PF-04691502; Palomid 529 (P529); PP-121; WYE-125132; WYE-687; NVP-BGT226; WAY-600; AZD2014; CH5132799; INK 128; or Torinl.

In yet other embodiments, the MASP2-MTOR fusion polypeptide is encoded by a nucleic acid molecule described herein. In one embodiment, the MASP2-MTOR fusion polypeptide is encoded by an in-frame fusion of intron 3 of MASP2 with intron 8 of MTOR (e.g., a sequence on chromosome 1). In another embodiment, the MASP2-MTOR fusion polypeptide includes an amino acid sequence encoded by a nucleotide sequence comprising a fusion junction between the MASP2 transcript and the MTOR transcript.

In certain embodiments, the MASP2-MTOR fusion polypeptide comprises one or more of encoded exons 1-3 from MASP2 and one or more of encoded exon exons 9-58 of MTOR. In certain embodiments, the MASP2-MTOR fusion polypeptide comprises at least 1, 2, 3 or more encoded exons from MASP2 and at least 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 29, 40, 41, 42, 43, 44, 45, 46, 47, 48, 49 or more, encoded exons from MTOR. In certain embodiments, the MASP2-MTOR fusion polypeptide comprises a fusion of encoded exons 1-3 from MASP2 and encoded exons 9-58 from MTOR (or a fragment thereof). In other embodiments, the fusion comprises least 1, 2, 3 encoded exon from MASP2; and at least 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 29, 40, 41, 42, 43, 44, 45, 46, 47, 48, 49 encoded exons from MTOR. In certain embodiments, the MASP2-MTOR fusion polypeptide comprises encoded exons 1-3 from MASP2 and exon exons 9-58 of MTOR. In certain embodiments, the 5' MASP2-3' MTOR fusion polypeptide comprises a fusion junction of the sequence of exons 1-3 from MASP2 and the sequence of exon 9-58 from MTOR.

In certain embodiments, the MASP2-MTOR fusion comprises the amino acid sequence corresponding to exons 1-3 or a fragment thereof from MASP2, and the amino acid sequence corresponding to exons 9-58 or a fragment thereof from MTOR (e.g., as shown in FIG. 105 (SEQ ID NO:116) and FIG. 107 (SEQ ID NO:118)). In one embodiment, the MASP2-MTOR fusion comprises at least 5, 10, 15, 20 or more amino acids from exons 1, 2, 3 of MASP2 (e.g., from the amino acid sequence of MASP2 preceding the fusion junction with MTOR, e.g., of the MASP2 sequence shown in FIG. 105 (SEQ ID NO:116)), and at least 5, 10, 15, 20 or more amino acids from exon 9 of MTOR (e.g., from the amino acid sequence of MTOR following the fusion junction with MASP2, e.g., of the MTOR sequence shown in FIG. 107 (SEQ ID NO:118)).

In one embodiment, the MASP2-MTOR fusion polypeptide includes an MTOR serine threonine kinase domain or a functional fragment thereof. In a related aspect, the invention features MASP2-MTOR fusion polypeptide or fragments operatively linked to heterologous polypeptides to form fusion proteins.

In another embodiment, the MASP2-MTOR fusion polypeptide or fragment is a peptide, e.g., an immunogenic peptide or protein, that contains a fusion junction described herein. Such immunogenic peptides or proteins can be used to raise antibodies specific to the fusion protein. In other embodiments, such immunogenic peptides or proteins can be used for vaccine preparation. The vaccine preparation can include other components, e.g., an adjuvant.

In another aspect, the invention features antibody molecules that bind to a MASP2-MTOR fusion polypeptide or fragment described herein. In embodiments, the antibody can distinguish wild type MTOR (or MASP2) from MASP2-MTOR.

Detection Reagents and Detection of Mutations

In another aspect, the invention features a detection reagent, e.g., a purified or an isolated preparation thereof. Detection reagents can distinguish a nucleic acid, or protein sequence, having a breakpoint, e.g., a MASP2-MTOR breakpoint; from a reference sequence. In one embodiment, the detection reagent detects (e.g., specifically detects) a MASP2-MTOR fusion nucleic acid or a polypeptide (e.g., distinguishes a wild type MTOR or another MTOR fusion (or MASP2) from a MASP2-MTOR nucleic acid (e.g., as described herein in FIG. 104 (SEQ ID NO:115) and FIG. 106 (SEQ ID NO:117); or a MASP2-MTOR polypeptide (e.g., as described herein in FIG. 105 (SEQ ID NO:116) and FIG. 107 (SEQ ID NO:118).

Detection reagents, e.g., nucleic acid-based detection reagents, can be used to identify mutations in a target nucleic acid, e.g., DNA, e.g., genomic DNA or cDNA, or RNA, e.g., in a sample, e.g., a sample of nucleic acid derived from a neoplastic or tumor cell, e.g., a melanocytic neoplasm, melanoma or metastatic cell. Detection reagents, e.g., antibody-based detection reagents, can be used to identify mutations in a target protein, e.g., in a sample, e.g., a sample of protein derived from, or produced by, a neoplastic or tumor cell, e.g., a melanocytic neoplasm, melanoma or metastatic cell.

Method of Treatment

In a related aspect, a method of inhibiting, reducing, or treating a hyperproliferative disorder, e.g., a neoplasm (including benign, pre-malignant or malignant (e.g., a cancer), in a subject is provided. The method includes administering to the subject a preselected therapeutic agent, e.g., an anti-cancer agent (e.g., a kinase inhibitor), as a single agent, or in combination, in an amount sufficient to reduce, inhibit or treat the activity or expression of MASP2-MTOR (e.g., a MASP2-MTOR fusion described herein), thereby inhibiting, reducing, or treating the hyperproliferative disorder in the subject.

In one embodiment, the subject treated has a MASP2-MTOR fusion; e.g., the subject has a tumor or cancer harboring a MASP2-MTOR fusion. In other embodiments, the subject has been previously identified as having a MASP2-MTOR fusion. In yet other embodiments, the subject has been previously identified as being likely or unlikely to respond to treatment with a protein kinase inhibitor, e.g., a subject that has previously participated in a clinical trial. In other embodiments, the subject has been previously identified as being likely or unlikely to respond to treatment with a protein kinase inhibitor, based on the presence of the MASP2-MTOR fusion. In one embodiment, the subject is a mammal, e.g., a human. In one embodiment, the subject has, or at risk of having a cancer at any stage of disease. In other embodiments, the subject is a patient, e.g., a cancer patient.

In certain embodiments, the neoplasm or neoplastic cell is a benign, pre-malignant, malignant (cancer) or metastasis. In certain embodiments, the cancer is a solid tumor, a soft tissue tumor, or a metastatic lesion.

In one embodiment, the neoplasm or neoplastic cell is a benign, pre-malignant, malignant (cancer) or metastasis. In certain embodiments, the cancer is a solid tumor, a soft tissue tumor, or a metastatic lesion. In an embodiment, the cancer is a carcinoma. In an embodiment the cancer is a squamous cell carcinoma. In an embodiment, the cancer is a cervix squamous cell carcinoma. In an embodiment, the cancer is a lung adenocarcinoma. In one embodiment, the cancer is chosen from a lung cancer, a pancreatic cancer, melanoma, a colorectal cancer, an esophageal-gastric cancer, a thyroid cancer, or an adenocarcinoma. In one embodiment, the cancer is a lung adenocarcinoma. In other embodiment, the lung cancer is chosen from one or more of the following: non-small cell lung cancer (NSCLC), small cell lung cancer (SCLC), squamous cell carcinoma (SCC), adenocarcinoma of the lung, bronchogenic carcinoma, or a combination thereof. In one embodiment, the lung cancer is NSCLC or SCC.

In one embodiment, the anti-cancer agent is a kinase inhibitor. For example, the kinase inhibitor is a multi-kinase inhibitor or an MTOR-specific inhibitor. In one embodiment, the kinase inhibitor is an MTOR inhibitor including, but not limited to, BEZ235 (NVP-BEZ235); Everolimus (RAD001); Rapamycin (Sirolimus, AY-22989, WY-090217); AZD8055; Temsirolimus (CCI-779, Torisel); PI-103; Ku-0063794; Deforolimus (Ridaforolimus, AP23573, MK-8669); PP242; XL765; GSK1059615; WYE-354; OSI-027; GDC-0980 (RG7422); GSK2126458; PF-05212384 (PKI-587); PF-04691502; Palomid 529 (P529); PP-121; WYE-125132; WYE-687; NVP-BGT226; WAY-600; AZD2014; CH5132799; INK 128; or Torin1. In some embodiments the MTOR inhibitor is a MTOR inhibitor described herein.

FGFR2-BICC1 fusions

In one embodiment, a fusion includes an in-frame fusion of an exon of fibroblast growth factor receptor 2 (FGFR2), e.g., one more exons of FGFR2 (e.g., exons 1-16 of FGFR2) or a fragment thereof, and an exon of bicaudal C homolog 1 (BICC1), e.g., one or more exons of a BICC1 (e.g., exons 18-21 of BICC1) or a fragment thereof. For example, the FGFR2-BICC1 fusion can include an in-frame fusion within an intron of FGFR2 (e.g., intron 16) or a fragment thereof, with an intron of BICC1 (e.g., intron 17) or a fragment thereof. In one embodiment, the fusion of the FGFR2-BICC1 fusion comprises the nucleotide sequence of: chromosome 10 at one or more of nucleotide 123,241,713 (plus or minus 10, 20, 30, 50, 60, 70, 80, 100 or more nucleotides) and chromosome 10 at one or more of nucleotide 60,567,607 (plus or minus 10, 20, 30, 50, 60, 70, 80, 100 or more nucleotides). In one embodiment, the FGFR2-BICC1 fusion is a translocation, e.g., a translocation of a portion of chromosome 10 or a portion of chromosome 10.

In certain embodiments, the FGFR2-BICC1 fusion is in a 5'-FGFR2 to 3'-BICC1 configuration (also referred to herein as "5'-FGFR2-BICC1-3')." The term "fusion" or "fusion molecule" can refer to a polypeptide or a nucleic acid fusion, depending on the context. It may include a full-length sequence of a fusion or a fragment thereof, e.g., a fusion junction (e.g., a fragment including a portion of FGFR2 and a portion of BICC1, e.g., a portion of the FGFR2-BICC1 fusion described herein). In one embodiment, the FGFR2-BICC1 fusion polypeptide includes a fragment of the amino acid sequence shown in FIG. 93 (SEQ ID NO:100) and a fragment of the amino acid sequence shown in FIG. 99 (SEQ ID NO:108), or an amino acid sequence substantially identical thereto. In another embodiment, the FGFR2-BICC1 fusion nucleic acid includes a fragment of the nucleotide sequence shown in FIG. 92 (SEQ ID NO:99) and a fragment of the nucleotide sequence shown in FIG. 98 (SEQ ID NO:107), or a nucleotide sequence substantially identical thereto. In one embodiment, the FGFR2-BICC1 fusion polypeptide comprises sufficient FGFR2 and sufficient BICC1 sequence such that the 5' FGFR2-3' BICC1 fusion has kinase activity, e.g., has elevated activity, e.g., FGFR2 tyrosine kinase activity, as compared with wild type FGFR2, e.g., in a cell of a cancer referred to herein (e.g., cholangiocarcinoma). In one embodiment, the BICC1 sequence has a coiled-coil domain, e.g., it may dimerize with one or more partners.

In certain embodiments, the FGFR2-BICC1 fusion comprises exons 1-16 from FGFR2 and exons 18-21 of BICC1 (e.g., one or more of the exons shown in FIG. 92 (SEQ ID NO:99) and FIG. 98 (SEQ ID NO:107). In another embodiment, the FGFR2-BICC1 fusion comprises exons 1-16 of FGFR2 and exons 18-21 of BICC1. In certain embodiments, the FGFR2-BICC1 fusion comprises at least one or more exons (or encoded exons) from FGFR2 and at least one or more exons (or encoded exons) from BICC1 (e.g., from the FGFR2 and BICC1 sequences shown in FIG. 92 and FIG. 93 (SEQ ID NO:99 and 100) and FIG. 98 and FIG. 99 (SEQ ID NOs:107 and 108).

In certain embodiments, the FGFR2-BICC1 fusion comprises exons 1-16 or a fragment thereof from FGFR2, and exons 18-21 or a fragment thereof from BICC1 (e.g., as shown in FIG. 92 (SEQ ID NO:99) and FIG. 98 (SEQ ID NO:107)). In one embodiment, the FGFR2-BICC1 fusion comprises at least 5, 10, 15, 20, 30, 40, 50 or more amino acids encoded by exons 1-16 of FGFR2 (e.g., from the amino acid sequence of FGFR2 as shown in FIG. 92 (SEQ ID NO:99) (e.g., from the amino acid sequence of FGFR2 preceding the fusion junction with BICC1, and at least 5, 10, 15, 20, 30, 40, 50 or more amino acids encoded by exons 18-21 of BICC1 (e.g., from the amino acid sequence of BICC1 as shown in FIG. 99 (SEQ ID NO:108)). In another embodiment, the FGFR2-BICC1 fusion comprises at least 6, 12, 15, 20, 25, 50, 75, 100 or more nucleotides from exons 1-16 of FGFR2 (e.g., from the nucleotide sequence of FGFR2 as shown in FIG. 92 (SEQ ID NO:99) (e.g., from the nucleotide sequence of FGFR2 preceding the fusion junction with BICC1); and at least 6, 12, 15, 20, 25, 50, 75, 100 or more nucleotides from exons 18-21 of BICC1 (e.g., from the nucleotide sequence of BICC1 as shown in FIG. 98 (SEQ ID NO:107)).

FGFR2-BICC1 Nucleic Acid Molecules

In one aspect, the invention features a nucleic acid molecule (e.g., an isolated or purified) nucleic acid molecule that includes a fragment of a FGFR2 gene and a fragment of a BICC1 gene. In one embodiment, the nucleotide sequence encodes a FGFR2-BICC1 fusion polypeptide that includes a FGFR2 tyrosine kinase domain or a functional fragment thereof. In another embodiment, the nucleotide sequence encodes a fragment of the BICC1 polypeptide including the amino acid sequence of SEQ ID NO:108 or a fragment thereof, or a sequence substantially identical thereto. In other embodiments, the nucleic acid molecule includes a fragment of the FGFR2 gene encoding the amino acid sequence of SEQ ID NO:100 or a fragment thereof, or a sequence substantially identical thereto. In yet other embodiments, the nucleic acid molecule includes a nucleotide sequence encoding the amino acid sequence shown in FIG. 92 (SEQ ID NO:99), or a fragment thereof, and the amino acid sequence shown in FIG. 99 (SEQ ID NO:108) or a fragment thereof, or a sequence substantially identical thereto.

In one embodiment, the nucleic acid molecule includes a fusion, e.g., an in-frame fusion, between an intron of FGFR2 (e.g., intron 16, or a fragment thereof), and an intron of BICC1 (e.g., intron 17, or a fragment thereof). The FGFR2-BICC1 fusion can comprise a fusion of the nucleotide sequence of: chromosome 10 at one or more of nucleotide 123,241,713 (plus or minus 10, 20, 30, 50, 60, 70, 80, 100 nucleotides) and chromosome 10 at one or more of nucleotide 60,567,607 (plus or minus 10, 20, 30, 50, 60, 70, 80, 100 nucleotides), or a fragment thereof. In one embodiment, the FGFR2-BICC1 fusion comprises a fusion of the nucleotide sequence of: chromosome 10 at one or more of nucleotide 123,241,713 (plus or minus 10, 20, 30, 50, 60, 70, 80, 100 nucleotides) and chromosome 10 at one or more of nucleotide 60,567,607 (plus or minus 10, 20, 30, 50, 60, 70, 80, 100 nucleotides), or a fragment thereof.

In another embodiment, the FGFR2-BICC1 fusion comprises a nucleotide sequence (e.g., a fragment of a nucleotide sequence) shown in FIG. 92 (SEQ ID NO:99) and a nucleotide sequence (e.g., a fragment of a nucleotide sequence) shown in FIG. 98 (SEQ ID NO:107), or a fragment of the fusion. In one embodiment, the FGFR2-BICC1 fusion comprises a nucleotide sequence substantially identical to the nucleotide sequence (e.g., a fragment of a nucleotide sequence) shown in FIG. 92 (SEQ ID NO:99) and the nucleotide sequence (e.g., a fragment of a nucleotide sequence) shown FIG. 98 (SEQ ID NO:107), or a fragment of the fusion. In one embodiment, the FGFR2-BICC1 fusion comprises a nucleotide sequence at least 70%, at least 75%, at least 80%, at least 85%, at least 90%, at least 95%, at least 99%, at least 99.5 or greater, identical to the nucleotide sequence (e.g., a fragment of a nucleotide sequence) shown in FIG. 92 (SEQ ID NO:99) and to the nucleotide sequence (e.g., a fragment of a nucleotide sequence) shown in FIG. 98 (SEQ ID NO:107). In one embodiment, the FGFR2-BICC1 fusion comprises a nucleotide sequence containing at least 25, 50, 100, 150, 200, 500, 1000, 1500, 2000, 2500, 3000, or more nucleotides of the nucleotide sequence shown in FIG. 92 (SEQ ID NO:99) and a nucleotide sequence containing at least 25, 50, 100, 150, 200, 500, 1000, 1500, 2000, 2500, 3000, or more nucleotides of the nucleotide sequence shown in FIG. 98 (SEQ ID NO:107). In one embodiment, the FGFR2-BICC1 fusion comprises a nucleotide sequence containing at least 25, 50, 100, 150, 200, 500, 1000, 1500, 2000, 2500, 3000, or more contiguous nucleotides of the nucleotide sequence shown in FIG. 92 (SEQ ID NO:99) and a nucleotide sequence containing at least 25, 50, 100, 150, 200, 500, 1000, 1500, 2000, 2500, 3000, or more nucleotides of the nucleotide sequence shown in FIG. 98 (SEQ ID NO:107).

In another embodiment, the nucleic acid molecule includes a fusion, e.g., an in-frame fusion, of at least exons 1-16 of FGFR2 or a fragment thereof (e.g., exons 1-16 of FGFR2 or a fragment thereof), and at least exons 18-21 or a fragment thereof (e.g., exons 18-21 of BICC1 or a fragment thereof). In yet other embodiments, the nucleic acid molecule includes a fragment the nucleotide sequence shown in FIG. 92 (SEQ ID NO:99) and a fragment of the nucleotide sequence shown in FIG. 98 (SEQ ID NO:107) or a fragment of the fusion, or a sequence substantially identical thereto.

In one embodiment, the nucleic acid molecule is complementary to at least a portion of a nucleotide sequence disclosed herein, e.g., is capable of hybridizing under a stringency condition described herein to SEQ ID NO:99 and/or SEQ ID NO:98, or a fragment thereof. In yet another embodiment, the nucleic acid molecule hybridizes to a nucleotide sequence that is complementary to at least a portion of a nucleotide sequence disclosed herein, e.g., is capable of hybridizing under a stringency condition to a nucleotide sequence complementary to SEQ ID NO:99 and/or SEQ ID NO:98, or a fragment thereof. The nucleotide sequence of a cDNA encoding an exemplary 5' FGFR2-3' BICC1 fusion is shown in at least exons 1-16 (e.g., exons 1-16) of SEQ ID NO:99 and at least exons 18-21 (e.g., exons 18-21) of SEQ ID NO:98, and the predicted amino acid sequence is shown in the corresponding encoded exons of SEQ ID NO:100 and the corresponding encoded exons of SEQ ID NO:108, respectively.

In an embodiment the FGFR2-BICC1 nucleic acid molecule comprises sufficient FGFR2 and sufficient BICC1 sequence such that the encoded 5' FGFR2-3' BICC1 fusion has kinase activity, e.g., has elevated activity, e.g., FGFR2 kinase activity, as compared with wild type FGFR2, e.g., in a cell of a cancer referred to herein. In certain embodiments, the 5' FGFR2-3' BICC1 fusion comprises exons 1-16 from FGFR2 and exons 18-21 from BICC1. In certain embodiments, the FGFR2-BICC1 fusion comprises at least 1, 2, 3, 4, 5, 6, 7, 8, 9, 10, 11, 12, 13, 14, 15, 16 or more exons from FGFR2 and at least 1, 2, 3, 4 or more, exons from BICC1. In certain embodiments, the FGFR2-BICC1 fusion comprises a fusion of exons 1-16 from FGFR2 and exons 18-21 from BICC1. In another embodiment, the FGFR2-BICC1 fusion comprises at least 1, 2, 3, 4, 5, 6, 7, 8, 9, 10, 11, 12, 13, 14, 15, 16 exon from FGFR2; and at least 1, 2, 3, 4 exon from BICC1.

In one embodiment, the nucleic acid molecule includes a nucleotide sequence that has an in-frame fusion of intron 16 of FGFR2 (e.g., NM_001144915) with intron 1 of BICC1 (e.g., NM_001080512). In another embodiment, the nucleic acid molecule includes a nucleotide sequence that includes a breakpoint. For example, the nucleic acid molecule includes a nucleotide sequence that includes the fusion junction between the FGFR2 gene and the BICC1 gene, e.g., the breakpoint between intron 16 of FGFR2 and intron 17 of BICC1. In other embodiments, the nucleic acid molecules includes a nucleotide sequence of one or more of nucleotide 123,241,713 of chromosome 10 coupled to (e.g., directly or indirectly juxtaposed to) one or more of nucleotide 60,567,607 of chromosome 10. In one embodiment, the nucleic acid molecule includes the nucleotide sequence of: chromosome 10 at one or more of nucleotide 123,241,713 plus or minus 10, 20, 30, 40 50, 60, 80, 100, 150 nucleotides and chromosome 10 at one or more of nucleotide 60,567,607 plus or minus 10, 20, 30, 40 50, 60, 80, 100, 150 nucleotides (corresponding to the breakpoint of a FGFR2-BICC1 fusion), or a fragment thereof, or a sequence substantially identical thereto. In one embodiment, the nucleic acid molecule is complementary to at least a portion of a nucleotide sequence disclosed herein, e.g., is capable of hybridizing under a stringency condition described herein to SEQ ID NO:99 and/or SEQ ID NO:98 or a fragment thereof. In yet other embodiment, the nucleic acid molecule hybridizes to a nucleotide sequence that is complementary to at least a portion of a nucleotide sequence disclosed herein, e.g., is capable of hybridizing under a stringency condition described herein to a nucleotide sequence complementary to SEQ ID NO:99 or 107 or a fragment thereof.

In another embodiment, the FGFR2-BICC1 fusion nucleic acid comprises at least 6, 12, 15, 20, 25, 50, 75, 100 or more nucleotides from exons 1-16 of FGFR2 (e.g., from the nucleotide sequence of FGFR2 preceding the fusion junction with BICC1, e.g., of the FGFR2 sequence shown in FIG. 92 (SEQ ID NO:99)), and at least 6, 12, 15, 20, 25, 50, 75, 100 or more nucleotides from exons 18-21 of BICC1 (e.g., from the nucleotide sequence of BICC1 following the fusion junction with FGFR2, e.g., of the BICC1 sequence shown in FIG. 98 (SEQ ID NO:107)).

In other embodiments, the nucleic acid molecule includes a nucleotide sequence encoding a FGFR2-BICC1 fusion polypeptide that includes a fragment of a FGFR2 gene and a fragment of an BICC1 gene. In one embodiment, the nucleotide sequence encodes a FGFR2-BICC1 fusion polypeptide that includes e.g., an FGFR2 tyrosine kinase domain or a functional fragment thereof. In yet other embodiments, the nucleic acid molecule includes a nucleotide sequence encoding the amino acid sequence (e.g., a fragment of the amino acid sequence) shown in FIG. 93 (e.g., SEQ ID NO:100) and a nucleotide sequence encoding the amino acid sequence (e.g., a fragment of the amino acid sequence) shown in FIG. 99 (e.g., SEQ ID NO:108), or a fragment of the fusion, or a sequence substantially identical thereto. In one embodiment, the encoded FGFR2-BICC1 fusion polypeptide includes an FGFR2 tyrosine kinase domain or a functional fragment thereof.

In a related aspect, the invention features nucleic acid constructs that include the FGFR2-BICC1 nucleic acid molecules described herein. In certain embodiments, the nucleic acid molecules are operatively linked to a native or a heterologous regulatory sequence. Also included are vectors and host cells that include the FGFR2-BICC1 nucleic acid molecules described herein, e.g., vectors and host cells suitable for producing the nucleic acid molecules and polypeptides described herein.

In a related aspect, methods of producing the nucleic acid molecules and polypeptides described herein are also described.

In another aspect, the invention features nucleic acid molecules that reduce or inhibit the expression of a nucleic acid molecule that encodes a FGFR2-BICC1 fusion described herein. Examples of such nucleic acid molecules include, for example, antisense molecules, ribozymes, RNAi, triple helix molecules that hybridize to a nucleic acid encoding FGFR2-BICC1, or a transcription regulatory region of FGFR2-BICC1, and blocks or reduces mRNA expression of FGFR2-BICC1.

Nucleic Acid Detection and Capturing Reagents

The invention also features a nucleic acid molecule, e.g., nucleic acid fragment, suitable as probe, primer, bait or library member that includes, flanks, hybridizes to, which are useful for identifying, or are otherwise based on, the FGFR2-BICC1 fusions described herein. In certain embodiments, the probe, primer or bait molecule is an oligonucleotide that allows capture, detection or isolation of a FGFR2-BICC1 fusion nucleic acid molecule described herein. The oligonucleotide can comprise a nucleotide sequence substantially complementary to a fragment of the FGFR2-BICC1 fusion nucleic acid molecules described herein. The sequence identity between the nucleic acid fragment, e.g., the oligonucleotide, and the target FGFR2-BICC1 sequence need not be exact, so long as the sequences are sufficiently complementary to allow the capture, detection or isolation of the target sequence. In one embodiment, the nucleic acid fragment is a probe or primer that includes an oligonucleotide between about 5 and 25, e.g., between 10 and 20, or 10 and 15 nucleotides in length. In other embodiments, the nucleic acid fragment is a bait that includes an oligonucleotide between about 100 to 300 nucleotides, 130 and 230 nucleotides, or 150 and 200 nucleotides, in length.

In one embodiment, the nucleic acid fragment can be used to identify or capture, e.g., by hybridization, a FGFR2-BICC1 fusion. For example, the nucleic acid fragment can be a probe, a primer, or a bait, for use in identifying or capturing, e.g., by hybridization, a FGFR2-BICC1 fusion described herein. In one embodiment, the nucleic acid fragment can be useful for identifying or capturing a FGFR2-BICC1 breakpoint, e.g., the nucleotide sequence of: chromosome 10 at nucleotide 123,241,713 plus or minus 10, 20, 30, 40 50, 60, 80, 100, 150 nucleotides and chromosome 10 at nucleotide 60,567,607 plus or minus 10, 20, 30, 40 50, 60, 80, 100, 150 nucleotides.

In one embodiment, the nucleic acid fragment hybridizes to a nucleotide sequence within a chromosomal rearrangement that creates an in-frame fusion of intron 16 of FGFR2 with intron 17 of BICC1. In one embodiment, the nucleic acid fragment hybridizes to a nucleotide sequence in the region In other embodiments, the nucleic acid molecules includes a nucleotide sequence in the region of nucleotides 123,241,713 of chromosome 10 coupled to (e.g., juxtaposed to) nucleotides in the region of nucleotides 60,567,607 of chromosome 10. In one embodiment, the nucleic acid fragment hybridizes to a nucleotide sequence that includes a breakpoint, e.g., the nucleotide sequence of: chromosome 10 at nucleotide 123,241,713 plus or minus 10, 20, 30, 40 50, 60, 80, 100, 150 or more nucleotides and chromosome 10 at nucleotide 60,567,607 plus or minus 10, 20, 30, 40 50, 60, 80, 100, 150 or more nucleotides. For example, the nucleic acid fragment can hybridize to a nucleotide sequence that includes the fusion junction between the FGFR2 gene and the BICC1 gene, e.g., a nucleotide sequence that includes a portion of a nucleotide sequence within intron 16 of a FGFR2 gene and 17 of a BICC1 gene.

In another embodiment, the nucleic acid fragment hybridizes to a nucleotide sequence that comprises at least 6, 12, 15, 20, 25, 50, 75, 100, 150 or more nucleotides from exons 1-16 of FGFR2 (e.g., from the nucleotide sequence of FGFR2 preceding the fusion junction with BICC1, e.g., of the FGFR2 sequence shown in FIG. 92 (SEQ ID NO:99)), and at least 6, 12, 15, 20, 25, 50, 75, 100, 150 or more nucleotides from exons 18-21 of BICC1 (e.g., from the nucleotide sequence of BICC1 following the fusion junction with FGFR2, e.g., of the BICC1 sequence shown in FIG. 98 (SEQ ID NO:107)).

The probes or primers described herein can be used, for example, for FISH detection or PCR amplification. In one exemplary embodiment where detection is based on PCR, amplification of the FGFR2-BICC1 fusion junction fusion junction can be performed using a primer or a primer pair, e.g., for amplifying a sequence flanking the fusion junctions described herein, e.g., the mutations or the junction of a chromosomal rearrangement described herein, e.g., FGFR2-BICC1.

In one embodiment, a pair of isolated oligonucleotide primers can amplify a region containing or adjacent to a position in the FGFR2-BICC1 fusion. For example, forward primers can be designed to hybridize to a nucleotide sequence within FGFR2 genomic or mRNA sequence (e.g., a nucleotide sequence within exons 1-16 of FGFR2 of SEQ ID NO:99), and the reverse primers can be designed to hybridize to a nucleotide sequence of BICC1 (e.g., a nucleotide sequence within exons 18-21 of BICC1, of SEQ ID NO:98).

In another embodiment, the nucleic acid fragments can be used to identify, e.g., by hybridization, a FGFR2-BICC1 fusion. In one embodiment, the nucleic acid fragment hybridizes to a nucleotide sequence that includes a fusion junction between the FGFR2 transcript and the BICC1 transcript.

In other embodiments, the nucleic acid fragment includes a bait that comprises a nucleotide sequence that hybridizes to a FGFR2-BICC1 fusion nucleic acid molecule described herein, and thereby allows the capture or isolation said nucleic acid molecule. In one embodiment, a bait is suitable for solution phase hybridization. In other embodiments, a bait includes a binding entity, e.g., an affinity tag, that allows capture and separation, e.g., by binding to a binding entity, of a hybrid formed by a bait and a nucleic acid hybridized to the bait.

In other embodiments, the nucleic acid fragment includes a library member comprising a FGFR2-BICC1 nucleic acid molecule described herein. In one embodiment, the library member includes a rearrangement that results in a FGFR2-BICC1 fusion described herein.

The nucleic acid fragment can be detectably labeled with, e.g., a radiolabel, a fluorescent label, a bioluminescent label, a chemiluminescent label, an enzyme label, a binding pair label, or can include an affinity tag; a tag, or identifier (e.g., an adaptor, barcode or other sequence identifier).

FGFR2-BICC1 Fusion Polypeptides

In another embodiment, the FGFR2-BICC1 fusion comprises an amino acid sequence (e.g., a fragment of the amino acid sequence) shown in FIG. 93 (SEQ ID NO:100) and an amino acid sequence (e.g., a fragment of the amino acid sequence) shown in FIG. 99 (SEQ ID NO:108), or a fragment of the fusion. In one embodiment, the FGFR2-BICC1 fusion comprises an amino acid sequence substantially identical to the amino acid sequence (e.g., a fragment of the amino acid sequence) shown in FIG. 93 (SEQ ID NO:100) and the amino acid sequence (e.g., a fragment of the amino acid sequence) shown in FIG. 99 (SEQ ID NO:108), or a fragment thereof. In one embodiment, the FGFR2-BICC1 fusion comprises an amino acid sequence at least 70%, at least 75%, at least 80%, at least 85%, at least 90%, at least 95%, at least 99%, at least 99.5 or greater, identical to the amino acid sequence (e.g., a fragment of the amino acid sequence) shown in FIG. 93 (SEQ ID NO:100) and the amino acid sequence (e.g., a fragment of the amino acid sequence) shown in FIG. 99 (SEQ ID NO:108). In one embodiment, the FGFR2-BICC1 fusion comprises a sequence containing at least 10, 20, 50, 100, 500, 600, 700, 800, 900, 1000, or more amino acids of the amino acid sequence shown in FIG. 93 (SEQ ID NO:100) and FIG. 99 (SEQ ID NO:108). In one embodiment, the FGFR2-BICC1 fusion comprises an amino acid sequence containing at least 5, 10, 20, 50, 100, 500, 600, 700, 800, 900, 1000, or more contiguous amino acids of the amino acid sequence shown in FIG. 93 (SEQ ID NO:100) and at least 5, 10, 20, 50, 100, 500, 600, 700, 800, 900, 1000, or more contiguous amino acids of the amino acid sequence shown in FIG. 99 (SEQ ID NO:108). In one embodiment, the FGFR2-BICC1 fusion polypeptide includes a FGFR2 receptor tyrosine kinase domain or a functional fragment thereof. In an embodiment, the FGFR2-BICC1 fusion polypeptide comprises sufficient BICC1 and sufficient FGFR2 sequence such that it has kinase activity, e.g., has elevated activity, e.g., FGFR2 kinase activity, as compared with wild type FGFR2, e.g., in a cell of a cancer referred to herein.

In another aspect, the invention features a FGFR2-BICC1 fusion polypeptide (e.g., a purified FGFR2-BICC1 fusion polypeptide), a biologically active or antigenic fragment thereof, as well as reagents (e.g., antibody molecules that bind to a FGFR2-BICC1 fusion polypeptide), methods for modulating a FGFR2-BICC1 polypeptide activity and detection of a FGFR2-BICC1 polypeptide.

In one embodiment, the FGFR2-BICC1 fusion polypeptide has at least one biological activity, e.g., an FGFR2 kinase activity. In one embodiment, at least one biological activity of the FGFR2-BICC1 fusion polypeptide is reduced or inhibited by an anti-cancer drug, e.g., a kinase inhibitor (e.g., a multikinase inhibitor or an FGFR2-specific inhibitor). In one embodiment, at least one biological activity of the FGFR2-BICC1 fusion polypeptide is reduced or inhibited by an FGFR2 kinase inhibitor chosen from e.g., BIBF1120 (Vargatef); Panatinib (AP24534); AZD4547; BGJ398 (NVP-BGJ398); or Brivanib alaninate (BMS-582664).

In yet other embodiments, the FGFR2-BICC1 fusion polypeptide is encoded by a nucleic acid molecule described herein. In one embodiment, the FGFR2-BICC1 fusion polypeptide is encoded by an in-frame fusion of intron 1 of FGFR2 with intron 1 of BICC1. In another embodiment, the FGFR2-BICC1 fusion polypeptide includes an amino acid sequence encoded by a nucleotide sequence comprising a fusion junction between the FGFR2 transcript and the BICC1 transcript.

In certain embodiments, the FGFR2-BICC1 fusion polypeptide comprises one or more of encoded exons 1-16 from FGFR2 and one or more of encoded exons 18-21 of BICC1. In certain embodiments, the FGFR2-BICC1 fusion polypeptide comprises at least 1 or more encoded exons from FGFR2 and at least 1, 2, 3, 4, 5, 6, 7, 8, 9, 10, 11, 12, 13, 14, 15, 16 or more, encoded exons from BICC1. In certain embodiments, the FGFR2-BICC1 fusion polypeptide comprises a fusion of encoded exons 1-16 from FGFR2 and encoded exons 18-21 from BICC1 (or a fragment thereof). In other embodiments, the fusion comprises least 1 encoded exon from FGFR2; and at least 1, 2, 3, 4, 5, 6 encoded exons from BICC1. In certain embodiments, the FGFR2-BICC1 fusion polypeptide comprises encoded exons 1-16 from FGFR2 and exons 18-21 of BICC1. In certain embodiments, the 5' FGFR2-3' BICC1 fusion polypeptide comprises a fusion junction of the sequence of exons 1-16 from FGFR2 and the sequence of exons 18-21 from BICC1.

In certain embodiments, the FGFR2-BICC1 fusion comprises the amino acid sequence corresponding to exons 1-16 or a fragment thereof from FGFR2, and the amino acid sequence corresponding to exons 18-21 or a fragment thereof from BICC1 (e.g., as shown in FIG. 93 (SEQ ID NO:100) and FIG. 99 (SEQ ID NO:108)). In one embodiment, the FGFR2-BICC1 fusion comprises at least 5, 10, 15, 20 or more amino acids from exons 1-16 of FGFR2 (e.g., from the amino acid sequence of FGFR2 preceding the fusion junction with BICC1, e.g., of the FGFR2 sequence shown in FIG. 93 (SEQ ID NO:100)), and at least 5, 10, 15, 20 or more amino acids from exons 18-21 of BICC1 (e.g., from the amino acid sequence of BICC1 following the fusion junction with FGFR2, e.g., of the BICC1 sequence shown in FIG. 99 (SEQ ID NO:108)).

In one embodiment, the FGFR2-BICC1 fusion polypeptide includes a FGFR2 tyrosine kinase domain or a functional fragment thereof. In a related aspect, the invention features FGFR2-BICC1 fusion polypeptide or fragments operatively linked to heterologous polypeptides to form fusion proteins.

In another embodiment, the FGFR2-BICC1 fusion polypeptide or fragment is a peptide, e.g., an immunogenic peptide or protein, that contains a fusion junction described herein. Such immunogenic peptides or proteins can be used to raise antibodies specific to the fusion protein. In other embodiments, such immunogenic peptides or proteins can be used for vaccine preparation. The vaccine preparation can include other components, e.g., an adjuvant.

In another aspect, the invention features antibody molecules that bind to a FGFR2-BICC1 fusion polypeptide or fragment described herein. In embodiments, the antibody can distinguish wild type BICC1 (or FGFR2) from FGFR2-BICC1.

Detection Reagents and Detection of Mutations

In another aspect, the invention features a detection reagent, e.g., a purified or an isolated preparation thereof. Detection reagents can distinguish a nucleic acid, or protein sequence, having a breakpoint, e.g., a FGFR2-BICC1 breakpoint; from a reference sequence. In one embodiment, the detection reagent detects (e.g., specifically detects) a FGFR2-BICC1 fusion nucleic acid or a polypeptide (e.g., distinguishes a wild type BICC1 or another BICC1 fusion (or FGFR2) from a FGFR2-BICC1 nucleic acid (e.g., as described herein in FIG. 92 (SEQ ID NO:99) and FIG. 98 (SEQ ID NO:107); or a FGFR2-BICC1 polypeptide (e.g., as described herein in FIG. 92 (SEQ ID NO:99) and FIG. 98 (SEQ ID NO:107).

Detection reagents, e.g., nucleic acid-based detection reagents, can be used to identify mutations in a target nucleic acid, e.g., DNA, e.g., genomic DNA or cDNA, or RNA, e.g., in a sample, e.g., a sample of nucleic acid derived from a neoplastic or tumor cell, e.g., a melanocytic neoplasm, melanoma or metastatic cell. Detection reagents, e.g., antibody-based detection reagents, can be used to identify mutations in a target protein, e.g., in a sample, e.g., a sample of protein derived from, or produced by, a neoplastic or tumor cell, e.g., a melanocytic neoplasm, melanoma or metastatic cell.

Method of Treatment

FGFR2 encodes a tyrosine kinase cell surface receptor that plays an important role in cell differentiation, growth, and angiogenesis (Powers C J, McLeskey S W, Wellstein A (2000) Fibroblast growth factors, their receptors and signaling. Endocr Relat Cancer 7(3):165-97). Gain of function mutations in FGFRs have been reported in several cancer types (Eswarakumar V P, Lax I, Schlessinger J (2005) Cellular signaling by fibroblast growth factor receptors. Cytokine Growth Factor Rev 16(2):139-49). The rearrangement in this tumor is predicted to result in an in-frame fusion between the N-terminal portion of FGFR2 (containing the kinase domain) to the C-terminus of BICC1 (containing the protein-binding SAM domain and lacking both RNA-binding KH domains) (UniProt.org, http://cbio.mskcc.org/Mapback) (Garcia-Mayoral M F, Hollingworth D, Masino L, et al. (2007) The structure of the C-terminal KH domains of KSRP reveals a noncanonical motif important for mRNA degradation. Structure 15(4):485-98, Kim C A, Bowie J U (2003) SAM domains: uniform structure, diversity of function. Trends Biochem Sci 28(12):625-8). Other in-frame fusions containing the kinase domain of Fgfr2 have been shown to result in kinase activation (Singh D, Chan J M, Zoppoli P, et al. (2012) Transforming fusions of FGFR and TACC genes in human glioblastoma. Science 337(6099):1231-5, Lorenzi M V, Horii Y, Yamanaka R, et al. (1996) FRAG1, a gene that potently activates fibroblast growth factor receptor by C-terminal fusion through chromosomal rearrangement. Proc Natl Acad Sci USA 93(17):8956-61). FGFR2 mutations have been reported in 2% of tumors analyzed in COSMIC, with the highest prevalence in endometrial cancer (10%) and lower incidence in several other cancers (COSMIC, February 2013). FGFR2 signaling has been described as tumorigenic in lung, pancreatic and gastric cancers (Yamayoshi T, Nagayasu T, Matsumoto K, et al. (2004) Expression of keratinocyte growth factor/fibroblast growth factor-7 and its receptor in human lung cancer: correlation with tumour proliferative activity and patient prognosis. J Pathol 204(1):110-8, Cho K, Ishiwata T, Uchida E, et al. (2007) Enhanced expression of keratinocyte growth factor and its receptor correlates with venous invasion in pancreatic cancer. Am J Pathol 170(6):1964-74, Toyokawa T, Yashiro M, Hirakawa K (2009) Co-expression of keratinocyte growth factor and K-sam is an independent prognostic factor in gastric carcinoma. Oncol Rep 21(4):875-80). However, FGFR2 has also been described as a tumor suppressor in the context of other cancers, such as melanoma (Gartside M G, Chen H, Ibrahimi O A, et al. (2009) Loss-of-function fibroblast growth factor receptor-2 mutations in melanoma. Mol Cancer Res 7(1):41-54). Clinical trials of multiple Fgfr inhibitors are currently underway (Turner and Grose, 2010; 20094046). Additionally, the multi-kinase inhibitor ponatinib (AP24534), recently approved by the FDA for use in chronic myelogenous leukemia, has also been shown to have substantial activity against all four Fgfr kinases (Cortes J E, Kim, D-W, Pinilla-Ibarz J et al. (2012) A Pivotal Phase 2 Trial of Ponatinib in Patients with Chronic Myeloid Leukemia (CML) and Philadelphia Chromosome-Positive Acute Lymphoblastic Leukemia (Ph+ALL) Resistant or Intolerant to Dasatinib or Nilotinib, or with the T315I BCR-ABL Mutation: 12-Month Follow-up of the PACE Trial American Society of Hematology ASH 2012, Abstract 163, Gozgit J M, Wong M J, Moran L, et al. (2012) Ponatinib (AP24534), a multitargeted pan-FGFR inhibitor with activity in multiple FGFR-amplified or mutated cancer models. Mol Cancer Ther 11(3):690-9).

Ponatinib is a multi-kinase inhibitor targeting BCR-ABL, as well as VEGFRs and FGFRs. Ponatinib has been approved by the FDA for use in chronic myeloid leukemia (CML) and Philadelphia chromosome-Ponatinib positive acute lymphoblastic leukemia (ALL). Activating mutations or amplification of FGFR2 may predict sensitivity to ponatinib (Gozgit J M, Wong M J, Moran L, et al. (2012) Ponatinib (AP24534), a multitargeted pan-FGFR inhibitor with activity in multiple FGFR-amplified or mutated cancer models. Mol Cancer Ther 11(3):690-9).

Accordingly, in another aspect, a method of inhibiting, reducing, or treating a hyperproliferative disorder, e.g., a neoplasm (including benign, pre-malignant or malignant (e.g., a cancer), in a subject is provided. The method includes administering to the subject a preselected therapeutic agent, e.g., an anti-cancer agent (e.g., an inhibitor), as a single agent, or in combination, in an amount sufficient to reduce, inhibit or treat the activity or expression of FGFR2-BICC1 (e.g., a FGFR2-BICC1 fusion described herein), thereby inhibiting, reducing, or treating the hyperproliferative disorder in the subject.

In one embodiment, the subject treated has a FGFR2-BICC1 fusion; e.g., the subject has a tumor or cancer harboring a FGFR2-BICC1 fusion. In other embodiments, the subject has been previously identified as having a FGFR2-BICC1 fusion. In yet other embodiments, the subject has been previously identified as being likely or unlikely to respond to treatment with a protein kinase inhibitor, e.g., a subject that has previously participated in a clinical trial. In other embodiments, the subject has been previously identified as being likely or unlikely to respond to treatment with a protein kinase inhibitor, based on the presence of the FGFR2-BICC1 fusion. In one embodiment, the subject is a mammal, e.g., a human. In one embodiment, the subject has, or at risk of having a cancer at any stage of disease. In other embodiments, the subject is a patient, e.g., a cancer patient.

In certain embodiments, the neoplasm or neoplastic cell is a benign, pre-malignant, malignant (cancer) or metastasis. In certain embodiments, the cancer is a solid tumor, a soft tissue tumor, or a metastatic lesion.

In one embodiment, the neoplasm or neoplastic cell is a benign, pre-malignant, malignant (cancer) or metastasis. In certain embodiments, the cancer is a solid tumor, a soft tissue tumor, or a metastatic lesion. In certain embodiments, the cancer is ac carcinoma, e.g., cholangiocarcinoma. In one embodiment, the cancer is an urothelial (transitional cell) carcinoma. In one embodiment, the cancer is chosen from a lung cancer, a pancreatic cancer, melanoma, a colorectal cancer, an esophageal-gastric cancer, a thyroid cancer, or an adenocarcinoma. In other embodiment, the lung cancer is chosen from one or more of the following: non-small cell lung cancer (NSCLC), small cell lung cancer (SCLC), squamous cell carcinoma (SCC), adenocarcinoma of the lung, bronchogenic carcinoma, or a combination thereof. In one embodiment, the lung cancer is NSCLC or SCC.

In certain embodiments, the cancer is a cholangiocarcinoma. In some embodiments, such cancers of the bile ducts can arise within the liver as an intrahepatic cholangiocarcinoma (ICC) or originate from extrahepatic bile ducts as a bile duct carcinoma also referred to as an extrahepatic cholangiocarcinoma. ICC is the second most common primary hepatic malignancy after hepatocellular carcinoma (HCC) and accounts for 3% of the malignant tumors of the gastrointestinal system and 15% of primary hepatic malignancies. In that ICC has a routine histologic appearance of an adenocarcinoma, the diagnosis of ICC on a liver biopsy requires an immunohistochemical (IHC) study of the tumor and a thorough clinical workup including imaging studies to rule out a metastatic adenocarcinoma to the liver. ICC is associated with primary sclerosing cholangitis, parasitic biliary infection, polycystic disease of the liver, congenital intrahepatic bile duct dilatation (Caroli's Disease), congenital hepatic fibrosis, and choledochal cysts. Chronic Hepatitis C infection is an established cause of ICC with some studies describing a more than 300 fold increase in ICC incidence in patients with long-standing Hepatitis C infections. ICC has also been associated with cigarette smoking, alcohol consumption and exposure to a variety of toxins and chemical carcinogens. In certain embodiments, the cancer is a sarcoma, e.g., a cholangiosarcoma, e.g., a liver cholangiosarcoma.

In one embodiment, the anti-cancer agent is a kinase inhibitor. For example, the kinase inhibitor is a multi-kinase inhibitor, an FGF receptor inhibitor (e.g., a pan FGFR2 inhibitor), or a FGFR2-specific inhibitor. In one embodiment, the kinase inhibitor is chosen from one or more of: BIBF1120 (Vargatef); Panatinib (AP24534); AZD4547; BGJ398 (NVP-BGJ398); Brivanib alaninate (BMS-582664), AZD-4547; Regorafenib; Masitinib; Lenvatinib; Dovitinib; Brivanib; Ponatinib; ENMD-2076; AZD-2171 (Cediranib); BIBF1120; LY2874455; TKi258; and/or JNJ42756493. In some embodiments the FGFR2 inhibitor is a FGFR2 inhibitor described herein.

In one embodiment, the therapeutic agent is an agent that binds and inhibits FGFR2 or BICC1. For example, the therapeutic agent is an antibody molecule (e.g., a monoclonal antibody) against FGFR2; and/or a small molecule (e.g., kinase) inhibitor that is selective for FGFR2 or BICC1.

In another embodiment, the therapeutic agent is selected from antisense molecules, ribozymes, RNAi, triple helix molecules that hybridize to a nucleic acid encoding the fusion, or a transcription regulatory region that blocks or reduces mRNA expression of the fusion.

CD74-ROS1 Fusions

In one embodiment, a fusion includes an in-frame fusion of an exon of CD74 molecule, major histocompatibility complex, class II invariant chain (CD74), e.g., one more exons of CD74 (e.g., one or more of exons 1-6 of CD74) or a fragment thereof, and an exon of C-Ros oncogene 1 (ROS1), e.g., one or more exons of a ROS1 (e.g., one or more of exons 33-43 of ROS1) or a fragment thereof. For example, the CD74-ROS1 fusion can include an in-frame fusion within an intron of CD74 (e.g., intron 6) or a fragment thereof, with an intron of ROS1 (e.g., intron 32) or a fragment thereof. In one embodiment, the fusion of the CD74-ROS1 fusion comprises the nucleotide sequence of: chromosome 5 at one or more of nucleotide 149,783,724 (plus or minus 10, 20, 30, 50, 60, 70, 80, 100 or more nucleotides) and chromosome 6 at one or more of nucleotide 117,649,290 (plus or minus 10, 20, 30, 50, 60, 70, 80, 100 or more nucleotides). In one embodiment, the CD74-ROS1 fusion is a translocation, e.g., an inversion of a portion of chromosome 5 and a portion of chromosome 6.

In certain embodiments, the CD74-ROS1 fusion is in a 5'-CD74 to 3'-ROS1 configuration (also referred to herein as "5'-CD74-ROS1-3')." The term "fusion" or "fusion molecule" can refer to a polypeptide or a nucleic acid fusion, depending on the context. It may include a full-length sequence of a fusion or a fragment thereof, e.g., a fusion junction (e.g., a fragment including a portion of CD74 and a portion of ROS1, e.g., a portion of the CD74-ROS1 fusion described herein). In one embodiment, the CD74-ROS1 fusion polypeptide includes a fragment of the amino acid sequence shown in FIG. 111 (SEQ ID NO:124) and a fragment of the amino acid sequence shown in FIG. 113 (SEQ ID NO:126), or an amino acid sequence substantially identical thereto. In another embodiment, the CD74-ROS1 fusion nucleic acid includes a fragment of the nucleotide sequence shown in FIG. 110 (SEQ ID NO:123) and a fragment of the nucleotide sequence shown in FIG. 112 (SEQ ID NO:125), or a nucleotide sequence substantially identical thereto. In one embodiment, the CD74-ROS1 fusion polypeptide comprises sufficient CD74 and sufficient ROS1 sequence such that the 5' CD74-3' ROS1 fusion has kinase activity, e.g., has elevated activity, e.g., tyrosine kinase activity, as compared with wild type, e.g., in a cell of a cancer referred to herein (e.g., carcinoma, e.g., an adenocarcinoma, e.g., a lung adenocarcinoma).

In certain embodiments, the CD74-ROS1 fusion comprises one or more (or all of) exons 1-6 from CD74 and one or more (or all of) exons 33-43 of ROS1 (e.g., one or more of the exons shown in FIG. 110 (SEQ ID NO:123) and FIG. 112 (SEQ ID NO:125). In another embodiment, the CD74-ROS1 fusion comprises one or more (or all of) exons 1-6 of CD74 and one or more (or all of) exons 33-43 of ROS1. In certain embodiments, the CD74-ROS1 fusion comprises at least 1, 2, 3, 4, 5, 6 or more exons (or encoded exons) from CD74 and at least 1, 2, 3, 4, 5, 6, 7, 8, 9, 10, 11, 10, 11 or more exons (or encoded exons) from ROS1 (e.g., from the CD74 and ROS1 sequences shown in FIG. 110 and FIG. 111 (SEQ ID NO:123 and 124) and FIG. 112 and FIG. 113 (SEQ ID NO:125 and 126).

In certain embodiments, the CD74-ROS1 fusion comprises exon 1-6 or a fragment thereof from CD74, and exons 33-43 or a fragment thereof from ROS1 (e.g., as shown in FIG. 110 (SEQ ID NO:123) and FIG. 112 (SEQ ID NO:125)). In one embodiment, the CD74-ROS1 fusion comprises at least 5, 10, 15, 20, 30, 40, 50 or more amino acids from exon 1-6 of CD74 (e.g., from the amino acid sequence of CD74 as shown in FIG. 111 (SEQ ID NO:124) (e.g., from the amino acid sequence of CD74 preceding the fusion junction with ROS1, and at least 5, 10, 15, 20, 30, 40, 50 or more amino acids from exons 33-43 of ROS1 (e.g., from the amino acid sequence of ROS1 as shown in FIG. 113 (SEQ ID NO:126)). In another embodiment, the CD74-ROS1 fusion comprises at least 6, 12, 15, 20, 25, 50, 75, 100 or more nucleotides from exons 1-6 of CD74 (e.g., from the nucleotide sequence of CD74 as shown in FIG. 110 (SEQ ID NO:123) (e.g., from the nucleotide sequence of CD74 preceding the fusion junction with ROS1); and at least 6, 12, 15, 20, 25, 50, 75, 100 or more nucleotides from exons 33-43 of ROS1 (e.g., from the nucleotide sequence of ROS1 as shown in FIG. 112 (SEQ ID NO:125)).

CD74-ROS1 Nucleic Acid Molecules

In one aspect, the invention features a nucleic acid molecule (e.g., an isolated or purified) nucleic acid molecule that includes a fragment of a CD74 gene and a fragment of a ROS1 gene. In one embodiment, the nucleotide sequence encodes a CD74-ROS1 fusion polypeptide that includes a tyrosine kinase domain or a functional fragment thereof. In another embodiment, the nucleotide sequence encodes a fragment of the ROS1 polypeptide including the amino acid sequence of SEQ ID NO:126 or a fragment thereof, or a sequence substantially identical thereto. In other embodiments, the nucleic acid molecule includes a fragment of the CD74 gene encoding the amino acid sequence of SEQ ID NO:124 or a fragment thereof, or a sequence substantially identical thereto. In yet other embodiments, the nucleic acid molecule includes a nucleotide sequence encoding the amino acid sequence shown in FIG. 111 (SEQ ID NO:124), or a fragment thereof, and the amino acid sequence shown in FIG. 113 (SEQ ID NO:126) or a fragment thereof, or a sequence substantially identical thereto.

In one embodiment, the nucleic acid molecule includes a fusion, e.g., an in-frame fusion, between an intron of CD74 (e.g., intron 6, or a fragment thereof), and an intron of ROS1 (e.g., intron 32, or a fragment thereof). The CD74-ROS1 fusion can comprise a fusion of the nucleotide sequence of: chromosome 5 at one or more of nucleotide 149,783,724 (plus or minus 10, 20, 30, 50, 60, 70, 80, 100 nucleotides) and chromosome 6 at one or more of nucleotide 117,649,290 (plus or minus 10, 20, 30, 50, 60, 70, 80, 100 nucleotides), or a fragment thereof. In one embodiment, the CD74-ROS1 fusion comprises a fusion of the nucleotide sequence of: chromosome 5 at one or more of nucleotide 149,783,724 (plus or minus 10, 20, 30, 50, 60, 70, 80, 100 nucleotides) and chromosome 6 at one or more of nucleotide 117,649,290 (plus or minus 10, 20, 30, 50, 60, 70, 80, 100 nucleotides), or a fragment thereof.

In another embodiment, the CD74-ROS1 fusion comprises a nucleotide sequence (e.g., a fragment of a nucleotide sequence) shown in FIG. 110 (SEQ ID NO:123) and a nucleotide sequence (e.g., a fragment of a nucleotide sequence) shown in FIG. 112 (SEQ ID NO:125), or a fragment of the fusion. In one embodiment, the CD74-ROS1 fusion comprises a nucleotide sequence substantially identical to the nucleotide sequence (e.g., a fragment of a nucleotide sequence) shown in FIG. 110 (SEQ ID NO:123) and the nucleotide sequence (e.g., a fragment of a nucleotide sequence) shown FIG. 112 (SEQ ID NO:125), or a fragment of the fusion. In one embodiment, the CD74-ROS1 fusion comprises a nucleotide sequence at least 70%, at least 75%, at least 80%, at least 85%, at least 90%, at least 95%, at least 99%, at least 99.5 or greater, identical to the nucleotide sequence (e.g., a fragment of a nucleotide sequence) shown in FIG. 110 (SEQ ID NO:123) and to the nucleotide sequence (e.g., a fragment of a nucleotide sequence) shown in FIG. 112 (SEQ ID NO:125). In one embodiment, the CD74-ROS1 fusion comprises a nucleotide sequence containing at least 25, 50, 100, 150, 200, 500, 1000, 1500, 2000, 2500, 3000, or more nucleotides of the nucleotide sequence shown in FIG. 110 (SEQ ID NO:123) and a nucleotide sequence containing at least 25, 50, 100, 150, 200, 500, 1000, 1500, 2000, 2500, 3000, or more nucleotides of the nucleotide sequence shown in FIG. 112 (SEQ ID NO:125). In one embodiment, the CD74-ROS1 fusion comprises a nucleotide sequence containing at least 25, 50, 100, 150, 200, 500, 1000, 1500, 2000, 2500, 3000, or more contiguous nucleotides of the nucleotide sequence shown in FIG. 110 (SEQ ID NO:123) and a nucleotide sequence containing at least 25, 50, 100, 150, 200, 500, 1000, 1500, 2000, 2500, 3000, or more nucleotides of the nucleotide sequence shown in FIG. 112 (SEQ ID NO:125).

In another embodiment, the nucleic acid molecule includes a fusion, e.g., an in-frame fusion, of at least 1, 2, 3, 4, 5, 6 or more exons of CD74 or a fragment thereof (e.g., one or more of exons 1-6 of CD74 or a fragment thereof), and at least 1, 2, 3, 4, 5, 6, 7, 8, 9, 10, 11, 10, 11 or more exons or a fragment thereof (e.g., one or more of exons 33-43 of ROS1 or a fragment thereof). In yet other embodiments, the nucleic acid molecule includes a fragment the nucleotide sequence shown in FIG. 110 (SEQ ID NO:123) and a fragment of the nucleotide sequence shown in FIG. 112 (SEQ ID NO:125) or a fragment of the fusion, or a sequence substantially identical thereto.

In one embodiment, the nucleic acid molecule is complementary to at least a portion of a nucleotide sequence disclosed herein, e.g., is capable of hybridizing under a stringency condition described herein to SEQ ID NO:123 and/or SEQ ID NO:125, or a fragment thereof. In yet another embodiment, the nucleic acid molecule hybridizes to a nucleotide sequence that is complementary to at least a portion of a nucleotide sequence disclosed herein, e.g., is capable of hybridizing under a stringency condition to a polynucleotide sequence complementary to SEQ ID NO:123 and/or SEQ ID NO:125, or a fragment thereof. The nucleotide sequence of a cDNA encoding an exemplary 5' CD74-3' ROS1 fusion is shown in at least exon 6 (e.g., exons 1-6) of SEQ ID NO:123 and at least exon 33 (e.g., exons 33-43) of SEQ ID NO:125, and the predicted amino acid sequence is shown in the corresponding encoded exons of SEQ ID NO:124 and the corresponding encoded exons of SEQ ID NO:126, respectively.

In an embodiment the CD74-ROS1 nucleic acid molecule comprises sufficient CD74 and sufficient ROS1 sequence such that the encoded 5' CD74-3' ROS1 fusion has kinase activity, e.g., has elevated activity. In certain embodiments, the 5' CD74-3' ROS1 fusion comprises exons 1-6 from CD74 and exons 33-43 from ROS1. In certain embodiments, the CD74-ROS1 fusion comprises at least 1, 2, 3, 4, 5, 6 or more exons from CD74 and at least 1, 2, 3, 4, 5, 6, 7, 8, 9, 10, 11 or more, exons from ROS1. In certain embodiments, the CD74-ROS1 fusion comprises a fusion of exon 2 from CD74 and exon 2 from ROS1. In another embodiment, the CD74-ROS1 fusion comprises at least 1, 2, 3, 4, 5, 6 exons from CD74; and at least 1, 2, 3, 4, 5, 6, 7, 8, 9, 10, 11 exons from ROS1.

In one embodiment, the nucleic acid molecule includes a nucleotide sequence that has an in-frame fusion of intron 6 of CD74 (e.g., NM_004355) with intron 32 of ROS1 (e.g., NM_002944). In another embodiment, the nucleic acid molecule includes a nucleotide sequence that includes a breakpoint. For example, the nucleic acid molecule includes a nucleotide sequence that includes the fusion junction between the CD74 gene and the ROS1 gene, e.g., the breakpoint between intron 6 of CD74 and intron 32 of ROS1. In other embodiments, the nucleic acid molecules includes a nucleotide sequence of one or more of nucleotide 149,783,724 of chromosome 5 coupled to (e.g., directly or indirectly juxtaposed to) one or more of nucleotide 117,649,290 of chromosome 6. In one embodiment, the nucleic acid molecule includes the nucleotide sequence of: chromosome 5 at one or more of nucleotide 149,783,724 plus or minus 10, 20, 30, 40 50, 60, 80, 100, 150 nucleotides and chromosome 6 at one or more of nucleotide 117,649,290 plus or minus 10, 20, 30, 40 50, 60, 80, 100, 150 nucleotides (corresponding to the breakpoint of a CD74-ROS1 fusion), or a fragment thereof, or a sequence substantially identical thereto. In one embodiment, the nucleic acid molecule is complementary to at least a portion of a nucleotide sequence disclosed herein, e.g., is capable of hybridizing under a stringency condition described herein to SEQ ID NO:123 and/or SEQ ID NO:125 or a fragment thereof. In yet other embodiment, the nucleic acid molecule hybridizes to a nucleotide sequence that is complementary to at least a portion of a nucleotide sequence disclosed herein, e.g., is capable of hybridizing under a stringency condition described herein to a nucleotide sequence complementary to SEQ ID NO:123 or SEQ ID NO:125 or a fragment thereof.

In another embodiment, the CD74-ROS1 fusion nucleic acid comprises at least 6, 12, 15, 20, 25, 50, 75, 100 or more nucleotides from exon 6 of CD74 (e.g., from the nucleotide sequence of CD74 preceding the fusion junction with ROS1, e.g., of the CD74 sequence shown in FIG. 110 (SEQ ID NO:123)), and at least 6, 12, 15, 20, 25, 50, 75, 100 or more nucleotides from exon 33 of ROS1 (e.g., from the nucleotide sequence of ROS1 following the fusion junction with CD74, e.g., of the ROS1 sequence shown in FIG. 112 (SEQ ID NO:125)).

In other embodiments, the nucleic acid molecule includes a nucleotide sequence encoding a CD74-ROS1 fusion polypeptide that includes a fragment of a CD74 gene and a fragment of a ROS1 gene. In one embodiment, the nucleotide sequence encodes a CD74-ROS1 fusion polypeptide that includes e.g., a tyrosine kinase domain or a functional fragment thereof. In yet other embodiments, the nucleic acid molecule includes a nucleotide sequence encoding the amino acid sequence (e.g., a fragment of the amino acid sequence) shown in FIG. 111 (e.g., SEQ ID NO:124) and a nucleotide sequence encoding the amino acid sequence (e.g., a fragment of the amino acid sequence) shown in FIG. 113 (e.g., SEQ ID NO:126), or a fragment of the fusion, or a sequence substantially identical thereto. In one embodiment, the encoded CD74-ROS1 fusion polypeptide includes a tyrosine kinase domain or a functional fragment thereof.

In a related aspect, the invention features nucleic acid constructs that include the CD74-ROS1 nucleic acid molecules described herein. In certain embodiments, the nucleic acid molecules are operatively linked to a native or a heterologous regulatory sequence. Also included are vectors and host cells that include the CD74-ROS1 nucleic acid molecules described herein, e.g., vectors and host cells suitable for producing the nucleic acid molecules and polypeptides described herein.

In a related aspect, methods of producing the nucleic acid molecules and polypeptides described herein are also described.

In another aspect, the invention features nucleic acid molecules that reduce or inhibit the expression of a nucleic acid molecule that encodes a CD74-ROS1 fusion described herein. Examples of such nucleic acid molecules include, for example, antisense molecules, ribozymes, RNAi, triple helix molecules that hybridize to a nucleic acid encoding CD74-ROS1, or a transcription regulatory region of CD74-ROS1, and blocks or reduces mRNA expression of CD74-ROS1.

Nucleic Acid Detection and Capturing Reagents

The invention also features a nucleic acid molecule, e.g., nucleic acid fragment, suitable as probe, primer, bait or library member that includes, flanks, hybridizes to, which are useful for identifying, or are otherwise based on, the CD74-ROS1 fusions described herein. In certain embodiments, the probe, primer or bait molecule is an oligonucleotide that allows capture, detection or isolation of a CD74-ROS1 fusion nucleic acid molecule described herein. The oligonucleotide can comprise a nucleotide sequence substantially complementary to a fragment of the CD74-ROS1 fusion nucleic acid molecules described herein. The sequence identity between the nucleic acid fragment, e.g., the oligonucleotide, and the target CD74-ROS1 sequence need not be exact, so long as the sequences are sufficiently complementary to allow the capture, detection or isolation of the target sequence. In one embodiment, the nucleic acid fragment is a probe or primer that includes an oligonucleotide between about 5 and 25, e.g., between 10 and 20, or 10 and 15 nucleotides in length. In other embodiments, the nucleic acid fragment is a bait that includes an oligonucleotide between about 100 to 300 nucleotides, 130 and 230 nucleotides, or 150 and 200 nucleotides, in length.

In one embodiment, the nucleic acid fragment can be used to identify or capture, e.g., by hybridization, a CD74-ROS1 fusion. For example, the nucleic acid fragment can be a probe, a primer, or a bait, for use in identifying or capturing, e.g., by hybridization, a CD74-ROS1 fusion described herein. In one embodiment, the nucleic acid fragment can be useful for identifying or capturing a CD74-ROS1 breakpoint, e.g., the nucleotide sequence of: chromosome 5 at nucleotide 149,783,724 plus or minus 10, 20, 30, 40, 50, 60, 80, 100, 150 nucleotides and chromosome 6 at nucleotide 117,649,290 plus or minus 10, 20, 30, 40 50, 60, 80, 100, 150 nucleotides.

In one embodiment, the nucleic acid fragment hybridizes to a nucleotide sequence within a chromosomal rearrangement that creates an in-frame fusion of intron 6 of CD74 with intron 32 of ROS1. In one embodiment, the nucleic acid fragment hybridizes to a nucleotide sequence in the region In other embodiments, the nucleic acid molecules includes a nucleotide sequence in the region of nucleotides 149,783, 724 of chromosome 5 coupled to (e.g., juxtaposed to) nucleotides in the region of nucleotides 117,649,290 of chromosome 6. In one embodiment, the nucleic acid fragment hybridizes to a nucleotide sequence that includes a breakpoint, e.g., the nucleotide sequence of: chromosome 5 at nucleotide 149,783,724 plus or minus 10, 20, 30, 40 50, 60, 80, 100, 150 or more nucleotides and chromosome 6 at nucleotide 117,649,290 plus or minus 10, 20, 30, 40 50, 60, 80, 100, 150 or more nucleotides. For example, the nucleic acid fragment can hybridize to a nucleotide sequence that includes the fusion junction between the CD74 gene and the ROS1 gene, e.g., a nucleotide sequence that includes a portion of a nucleotide sequence within intron 6 of a CD74 gene and intron 32 of a ROS1 gene.

In another embodiment, the nucleic acid fragment hybridizes to a nucleotide sequence that comprises at least 6, 12, 15, 20, 25, 50, 75, 100, 150 or more nucleotides from exon 6 of CD74 (e.g., from the nucleotide sequence of CD74 preceding the fusion junction with ROS1, e.g., of the CD74 sequence shown in FIG. 110 (SEQ ID NO:123)), and at least 6, 12, 15, 20, 25, 50, 75, 100, 150 or more nucleotides from exon 33 of ROS1 (e.g., from the nucleotide sequence of ROS1 following the fusion junction with CD74, e.g., of the ROS1 sequence shown in FIG. 112 (SEQ ID NO:125)).

The probes or primers described herein can be used, for example, for FISH detection or PCR amplification. In one exemplary embodiment where detection is based on PCR, amplification of the CD74-ROS1 fusion junction fusion junction can be performed using a primer or a primer pair, e.g., for amplifying a sequence flanking the fusion junctions described herein, e.g., the mutations or the junction of a chromosomal rearrangement described herein, e.g., CD74-ROS1.

In one embodiment, a pair of isolated oligonucleotide primers can amplify a region containing or adjacent to a position in the CD74-ROS1 fusion. For example, forward primers can be designed to hybridize to a nucleotide sequence within CD74 genomic or mRNA sequence (e.g., a nucleotide sequence within exon 6 of CD74 of SEQ ID NO:123), and the reverse primers can be designed to hybridize to a nucleotide sequence of ROS1 (e.g., a nucleotide sequence within exon 3 of ROS1, of SEQ ID NO:125).

In another embodiment, the nucleic acid fragments can be used to identify, e.g., by hybridization, a CD74-ROS1 fusion. In one embodiment, the nucleic acid fragment hybridizes to a nucleotide sequence that includes a fusion junction between the CD74 transcript and the ROS1 transcript.

In other embodiments, the nucleic acid fragment includes a bait that comprises a nucleotide sequence that hybridizes to a CD74-ROS1 fusion nucleic acid molecule described herein, and thereby allows the capture or isolation said nucleic acid molecule. In one embodiment, a bait is suitable for solution phase hybridization. In other embodiments, a bait includes a binding entity, e.g., an affinity tag, that allows capture and separation, e.g., by binding to a binding entity, of a hybrid formed by a bait and a nucleic acid hybridized to the bait.

In other embodiments, the nucleic acid fragment includes a library member comprising a CD74-ROS1 nucleic acid molecule described herein. In one embodiment, the library member includes a rearrangement that results in a CD74-ROS1 fusion described herein.

The nucleic acid fragment can be detectably labeled with, e.g., a radiolabel, a fluorescent label, a bioluminescent label, a chemiluminescent label, an enzyme label, a binding pair label, or can include an affinity tag; a tag, or identifier (e.g., an adaptor, barcode or other sequence identifier).

CD74-ROS1 Fusion Polypeptides

In another embodiment, the CD74-ROS1 fusion comprises an amino acid sequence (e.g., a fragment of the amino acid sequence) shown in FIG. 111 (SEQ ID NO:124) and an amino acid sequence (e.g., a fragment of the amino acid sequence) shown in FIG. 113 (SEQ ID NO:126), or a fragment of the fusion. In one embodiment, the CD74-ROS1 fusion comprises an amino acid sequence substantially identical to the amino acid sequence (e.g., a fragment of the amino acid sequence) shown in FIG. 111 (SEQ ID NO:124) and the amino acid sequence (e.g., a fragment of the amino acid sequence) shown in FIG. 113 (SEQ ID NO:126), or a fragment thereof. In one embodiment, the CD74-ROS1 fusion comprises an amino acid sequence at least 70%, at least 75%, at least 80%, at least 85%, at least 90%, at least 95%, at least 99%, at least 99.5 or greater, identical to the amino acid sequence (e.g., a fragment of the amino acid sequence) shown in FIG. 111 (SEQ ID NO:124) and the amino acid sequence (e.g., a fragment of the amino acid sequence) shown in FIG. 113 (SEQ ID NO:126). In one embodiment, the CD74-ROS1 fusion comprises a sequence containing at least 10, 20, 50, 100, 500, 600, 700, 800, 900, 1000, or more amino acids of the amino acid sequence shown in FIG. 111 (SEQ ID NO:124) and FIG. 113 (SEQ ID NO:126). In one embodiment, the CD74-ROS1 fusion comprises an amino acid sequence containing at least 5, 10, 20, 50, 100, 500, 600, 700, 800, 900, 1000, or more contiguous amino acids of the amino acid sequence shown in FIG. 111 (SEQ ID NO:124) and at least 5, 10, 20, 50, 100, 500, 600, 700, 800, 900, 1000, or more contiguous amino acids of the amino acid sequence shown in FIG. 113 (SEQ ID NO:126). In one embodiment, the 5' CD74-3' ROS1 fusion polypeptide includes a receptor tyrosine kinase domain or a functional fragment thereof. In an embodiment, the 5'CD74-3'ROS1 fusion polypeptide comprises sufficient ROS1 and sufficient CD74 sequence such that it has kinase activity, e.g., has elevated activity.

In another aspect, the invention features a CD74-ROS1 fusion polypeptide (e.g., a purified CD74-ROS1 fusion polypeptide), a biologically active or antigenic fragment thereof, as well as reagents (e.g., antibody molecules that bind to a CD74-ROS1 fusion polypeptide), methods for modulating a CD74-ROS1 polypeptide activity and detection of a CD74-ROS1 polypeptide.

In one embodiment, the CD74-ROS1 fusion polypeptide has at least one biological activity. In one embodiment, at least one biological activity of the CD74-ROS1 fusion polypeptide is reduced or inhibited by an anti-cancer drug, e.g., a CD74 inhibitor, a ROS1 inhibitor, a Flt3 inhibitor. In one embodiment, at least one biological activity of the CD74-ROS1 fusion polypeptide is reduced or inhibited by a ROS1 inhibitor. In one embodiment, at least one biological activity of the CD74-ROS1 fusion polypeptide is reduced or inhibited by an CD74 inhibitor. In one embodiment, at least one biological activity of the CD74-ROS1 fusion polypeptide is reduced or inhibited by a ROS1 inhibitor, e.g., Ganetespib; Crizotinib; TAE684; a dual ALK and ROS1 inhibitor.

In yet other embodiments, the CD74-ROS1 fusion polypeptide is encoded by a nucleic acid molecule described herein. In one embodiment, the CD74-ROS1 fusion polypeptide is encoded by an in-frame fusion of intron 6 of CD74 with intron 32 of ROS1 (e.g., a sequence on chromosome 11 and a sequence on chromosome 11). In another embodiment, the CD74-ROS1 fusion polypeptide includes an amino acid sequence encoded by a nucleotide sequence comprising a fusion junction between the CD74 transcript and the ROS1 transcript.

In certain embodiments, the CD74-ROS1 fusion polypeptide comprises one or more of encoded exons 1-6 from CD74 and one or more of encoded exons 33-43 of ROS1. In certain embodiments, the CD74-ROS1 fusion polypeptide comprises at least 1, 2, 3, 4, 5, 6 or more encoded exons from CD74 and at least 1, 2, 3, 4, 5, 6, 7, 8, 9, 10, 11 or more, encoded exons from ROS1. In certain embodiments, the CD74-ROS1 fusion polypeptide comprises a fusion of encoded exon 6 from CD74 and encoded exon 33 from ROS1 (or a fragment thereof). In other embodiments, the fusion comprises least 1, 2, 3, 4, 5, 6 encoded exons from CD74; and at least 1, 2, 3, 4, 5, 6, 7, 8, 9, 10, 11 encoded exons from ROS1. In certain embodiments, the CD74-ROS1 fusion polypeptide comprises encoded exons 1-6 from CD74 and exons 33-43 of ROS1. In certain embodiments, the 5' CD74-3' ROS1 fusion polypeptide comprises a fusion junction of the sequence of exon 6 from CD74 and the sequence of exon 33 from ROS1.

In certain embodiments, the CD74-ROS1 fusion comprises the amino acid sequence corresponding to exon 6 or a fragment thereof from CD74, and the amino acid sequence corresponding to exon 33 or a fragment thereof from ROS1 (e.g., as shown in FIG. 111 (SEQ ID NO:124) and FIG. 113 (SEQ ID NO:126)). In one embodiment, the CD74-ROS1 fusion comprises at least 5, 10, 15, 20 or more amino acids from exon 2 of CD74 (e.g., from the amino acid sequence of CD74 preceding the fusion junction with ROS1, e.g., of the CD74 sequence shown in FIG. 111 (SEQ ID NO:124)), and at least 5, 10, 15, 20 or more amino acids from exon 2 of ROS1 (e.g., from the amino acid sequence of ROS1 following the fusion junction with CD74, e.g., of the ROS1 sequence shown in FIG. 113 (SEQ ID NO:126)).

In one embodiment, the CD74-ROS1 fusion polypeptide includes a tyrosine kinase domain or a functional fragment thereof. In a related aspect, the invention features CD74-ROS1 fusion polypeptide or fragments operatively linked to heterologous polypeptides to form fusion proteins.

In another embodiment, the CD74-ROS1 fusion polypeptide or fragment is a peptide, e.g., an immunogenic peptide or protein, that contains a fusion junction described herein. Such immunogenic peptides or proteins can be used to raise antibodies specific to the fusion protein. In other embodiments, such immunogenic peptides or proteins can be used for vaccine preparation. The vaccine preparation can include other components, e.g., an adjuvant.

In another aspect, the invention features antibody molecules that bind to a CD74-ROS1 fusion polypeptide or fragment described herein. In embodiments, the antibody can distinguish wild type ROS1 (or CD74) from CD74-ROS1.

Detection Reagents and Detection of Mutations

In another aspect, the invention features a detection reagent, e.g., a purified or an isolated preparation thereof. Detection reagents can distinguish a nucleic acid, or protein sequence, having a breakpoint, e.g., a CD74-ROS1 breakpoint; from a reference sequence. In one embodiment, the detection reagent detects (e.g., specifically detects) a CD74-ROS1 fusion nucleic acid or a polypeptide (e.g., distinguishes a wild type ROS1 or another ROS1 fusion (or CD74) from a CD74-ROS1 nucleic acid (e.g., as described herein in FIG. 110 (SEQ ID NO:123) and FIG. 112 (SEQ ID NO:125); or a CD74-ROS1 polypeptide (e.g., as described herein in FIG. 111 (SEQ ID NO:124) and FIG. 113 (SEQ ID NO:126).

Detection reagents, e.g., nucleic acid-based detection reagents, can be used to identify mutations in a target nucleic acid, e.g., DNA, e.g., genomic DNA or cDNA, or RNA, e.g., in a sample, e.g., a sample of nucleic acid derived from a neoplastic or tumor cell, e.g., a melanocytic neoplasm, melanoma or metastatic cell. Detection reagents, e.g., antibody-based detection reagents, can be used to identify mutations in a target protein, e.g., in a sample, e.g., a sample of protein derived from, or produced by, a neoplastic or tumor cell, e.g., a melanocytic neoplasm, melanoma or metastatic cell.

Method of Treatment

In a related aspect, a method of inhibiting, reducing, or treating a hyperproliferative disorder, e.g., a neoplasm (including benign, pre-malignant or malignant (e.g., a cancer), in a subject is provided. The method includes administering to the subject a preselected therapeutic agent, e.g., an anti-cancer agent (e.g., a kinase inhibitor), as a single agent, or in combination, in an amount sufficient to reduce, inhibit or treat the activity or expression of CD74-ROS1 (e.g., a CD74-ROS1 fusion described herein), thereby inhibiting, reducing, or treating the hyperproliferative disorder in the subject.

In one embodiment, the subject treated has a CD74-ROS1 fusion; e.g., the subject has a tumor or cancer harboring a CD74-ROS1 fusion. In other embodiments, the subject has been previously identified as having a CD74-ROS1 fusion. In yet other embodiments, the subject has been previously identified as being likely or unlikely to respond to treatment with a protein kinase inhibitor, e.g., a subject that has previously participated in a clinical trial. In other embodiments, the subject has been previously identified as being likely or unlikely to respond to treatment with a protein kinase inhibitor, based on the presence of the CD74-ROS1 fusion. In one embodiment, the subject is a mammal, e.g., a human. In one embodiment, the subject has, or at risk of having a cancer at any stage of disease. In other embodiments, the subject is a patient, e.g., a cancer patient.

In certain embodiments, the neoplasm or neoplastic cell is a benign, pre-malignant, malignant (cancer) or metastasis. In certain embodiments, the cancer is a solid tumor, a soft tissue tumor, or a metastatic lesion.

In one embodiment, the neoplasm or neoplastic cell is a benign, pre-malignant, malignant (cancer) or metastasis. In certain embodiments, the cancer is a solid tumor, a soft tissue tumor, or a metastatic lesion. In one embodiment, the cancer is a carcinoma. In one embodiment, the cancer is an adenocarcinoma. In an embodiment, the cancer is a lung adenocarcinoma. In one embodiment, the cancer is chosen from a lung cancer, a pancreatic cancer, melanoma, a colorectal cancer, an esophageal-gastric cancer, a thyroid cancer, or an adenocarcinoma. In one embodiment, the cancer is a lung adenocarcinoma. In other embodiment, the lung cancer is chosen from one or more of the following: non-small cell lung cancer (NSCLC), small cell lung cancer (SCLC), squamous cell carcinoma (SCC), adenocarcinoma of the lung, bronchogenic carcinoma, or a combination thereof. In one embodiment, the lung cancer is NSCLC or SCC.

In one embodiment, the anti-cancer agent is a ROS1 inhibitor. In one embodiment, the anti-cancer agent is a CD74 inhibitor. In one embodiment, the anti-cancer agent is a kinase inhibitor. In one embodiment, the anti-cancer agent is a ROS1 inhibitor, e.g., Ganetespib; Crizotinib; TAE684; a dual ALK and ROS1 inhibitor. In some embodiments the ROS1 inhibitor is a ROS1 inhibitor described herein.

Nucleic Acid Molecules

In one aspect, the invention features, an isolated nucleic acid molecule, or an isolated preparation of nucleic acid molecules, that includes a genetic alteration or mutation, e.g., a rearrangement, disclosed herein, e.g., in this section entitled Nucleic Acid Molecules, or in FIG. 1A, 1B, or 1C. Such nucleic acid molecules or preparations thereof can be used to detect, e.g., sequence, a genetic alteration or mutation disclosed herein and to characterize a sample in which they are contained. The isolated nucleic acid can be a genomic or a transcribed sequence, e.g., cDNA sequence.

In another aspect, the invention features, a nucleic acid molecule (e.g., an isolated or purified) nucleic acid molecule that includes a fragment of a first gene, and a fragment of a second gene, typically a gene that encodes a kinase. In embodiments, the first gene is a gene from FIG. 1A, 1B, or 1C and the second gene is a gene, e.g., a kinase from FIG. 1A, 1B, or 1C. In an embodiment the fusion protein has the fusion partners of a fusion protein described in FIG. 1A, 1B, or 1C.

The isolated nucleic acid molecule can comprise the entire sequence of the first fragment and the entire sequence of the second fragment, e.g., as shown in FIG. 1A, 1B, or 1C.

In embodiments the isolated nucleic acid is a genomic nucleic acid molecule comprises sequence encoding the entire sequence, e.g., from the control region or beginning of the open reading frame, through the breakpoint, which may be in an intron or an exon, of the first gene, fused to the a sequence for the second gene which begins at its breakpoint and extends to the end of the gene, e.g., through the end of the open reading frame of that gene. In other embodiments the isolated nucleic acid will include the fusion junction but only a portion of the fragment of the first or second gene present in the rearrangement.

In embodiments the isolated nucleic acid is a transcribed nucleic acid, e.g., a cDNA or mRNA, and comprises sequence encoding the entire sequence, e.g., from the beginning of the mRNA through the breakpoint of the first gene fused to the a sequence for the second gene which begins at its breakpoint and extends to the end of the mRNA of the second gene. In other embodiments the isolated nucleic acid will include the fusion junction but only a portion of the fragment of the first or second gene present in the rearrangement. In embodiments a transcribed nucleic acid will have one or more exon from the first gene fused, in frame, to one or more exons of the second gene. In embodiments a transcribed nucleic acid will have comprise the fusion of the C terminus of C terminal exon of the first gene fragment with the N terminus of the N terminal exon of the second gene.

In embodiments the fusion puts the kinase activity of the second gene under the control of the first gene.

In embodiments the isolated nucleic acid, e.g., a genomic or transcribed nucleic acid, e.g., a cDNA or RNA, comprises the fusion junction, e.g., a fusion junction from FIG. 1A, a1B, or 1C, and is at least 10, 20, 30, 40, 50, 60, 70, 80, 100, 125, 150, 200, 250, 300, 350, or 400 nucleotides in length, but optionally less than 1,000, 1,500, or 2,000 nucleotides in length. In embodiments, the isolated nucleic acid, e.g., a genomic or transcribed nucleic acid, e.g., a cDNA or RNA, comprises the fusion junction, e.g., a fusion junction from FIG. 1A, 1B, or 1C, and is between 10 and 2,000, 10 and 1,500, 10 and 1,000, 10 and 500, 10 and 400, 10 and 300, 10 and 200, 10 and 100, 20 and 2,000, 20 and 1,500, 20 and 1,000, 20 and 500, 20 and 400, 20 and 300, 20 and 200, 20 and 100, 30 and 2,000, 30 and 1,500, 30 and 1,000, 30 and 500, 30 and 400, 30 and 300, 30 and 200, 30 and 100 nucleotides in length.

In one embodiment, the isolated nucleic acid, e.g., a transcribed nucleic acid, e.g., a cDNA or RNA, comprises a fusion, e.g., an in-frame fusion, from FIG. 1C or a fusion transcribed from a genomic fusion from FIG. 1A or 1B.

In an embodiment, the isolated nucleic acid, e.g., a transcribed nucleic acid, e.g., a cDNA or RNA, comprises a fusion, e.g., an in-frame fusion, of the 3' terminus of an exon of a fragment of the first gene of FIG. 1C to the 5' terminus of an exon of a fragment of the second gene of FIG. 1C. In an embodiment the fusion is between the exons listed in FIG. 1C. In embodiments, fusion is not be between the specific exons found in FIG. 1C but is between other exons of the first gene to other exons of the second gene of a fusion from FIG. 1C.

In an embodiment, the isolated nucleic acid, e.g., a transcribed nucleic acid, e.g., a cDNA or RNA, comprises a fusion, e.g., an in-frame fusion, of the C terminal exon of a fragment of first gene of FIG. 1C to the N terminus of an exon a fragment of the second gene other than the second gene exon shown in FIG. 1C. By way of example, an exon, e.g., exon 9 of TRIM24 is fused to an exon, of BRAF other than the exon listed in FIG. X1, e.g., it is fused to an exon other than exon 9.

In an embodiment, the isolated nucleic acid, e.g., a transcribed nucleic acid, e.g., a cDNA or RNA, comprises a fusion, e.g., an in-frame fusion, of the N terminal exon of a fragment of the second gene of FIG. X1 to the C terminus of an exon of a fragment of the first gene other than the first-gene exon shown in FIG. X1. By way of example, exon 9 of BRAF is fused to an exon of TRM24 other than the exon listed in FIG. 1C (exon 9).

In an embodiment of the isolated nucleic acid, e.g., a genomic or transcribed nucleic acid, e.g., a cDNA or RNA, the second gene is a kinase and sufficient exonic sequence is present to confer kinase activity. In an embodiment of the isolated nucleic acid, e.g., a genomic or transcribed nucleic acid, e.g., a cDNA or mRNA, sufficient sequence of the first gene is present to allow expression of kinase activity of the fusion partner.

In an embodiment of the isolated nucleic acid, e.g., a transcribed nucleic acid, e.g., a cDNA or RNA, comprises a fusion junction between:
  FGFR3 and TACC3;
  TRIM24 and BRAF;
  CNTLN and RAF1;
  TRIM33 and RAF1;
  TRIM33 and RET;
  LMNA and NTRK1;
  RABGAP1L and NTRK1;
  MPRIP and NTRK1;
  PDZRN3 and RAF1;
  FGFR1 and NTM;
  TTC23 and IGF1R;
  DOT1L and MYST3 (KAT6A);
  SMAD4 and MYO5B;
  HMGXB3 and FLT4;
  MLL and YAP1;
  TMPRSS2 and MX1;
  MCDF2 and ALK;
  RANBP17 and FGFR3;
  NUMA1 and ERBB4,
  TPM3 and NTRK1;
  SNAPC4 and NOTCH1;
  TSC2 and CREBBP;
  C5orf42 and ERBB4;
  USP2 and CBL;
  STK32B and ALK;
  FGFR2 and TACC3;
  FGFR2 and KIAA1598;
  BICC1 and FGFR2;
  FGFR3 and JAKMIP1;
  MASP2 and MTOR;
  FGFR2 and BICC1 or
  CD74 and ROS1;
  wherein sufficient exonic sequence from the kinase is present to confer kinase activity and sufficient sequence of the other gene is present to allow expression of kinase activity of the fusion partner.

Also included are genomic fusion that can be transcribed to provide a transcribed nucleic acid, e.g., a cDNA or RNA, described herein.

In one embodiment, the isolated nucleic acid, e.g., a genomic nucleic acid, comprises a fusion of a first and second gene from FIG. 1A or 1B.

In embodiments, the fusion is between genes that are fusion partners in a fusion described in FIG. 1A, 1B, or 1C. In an embodiment sufficient sequence from the second gene is present to confer kinase activity on an encoded protein and sufficient sequence is present from the first gene to provide for expression of the kinase activity of the fusion partner in an encoded protein.

In an embodiment, the isolated nucleic acid, e.g., a genomic sequence, comprises a fusion of the 3' terminus of a fragment of a first gene to the 5' terminus of a fragment of a second gene, shown in FIG. 1A or 1B. In an embodiment, the 3' terminus of the fragment of the first gene is within 10, 20, 30, 40, 50 60, 70, 80, 90, or 100 nucleotides (in either direction) of the 3-terminus provided in FIG. 1A or 1B for the first gene. In an embodiment, the 5' terminus of the fragment of the second gene is within 10, 20, 30, 40, 50 60, 70, 80, 90, or 100 nucleotides (in either direction) of the 5' terminus provided in FIG. 1 for the second gene. By way of example, for the TRIM24-BRAF fusion from a melanoma sample, the 3' terminus can be chr7:1,140,489,369+/−N nucleotides and the 5' terminus is chr7:138,241,731+/−N nucleotides, wherein N, independently is 10, 20, 30, 40, 50, 60, 70, 80, 90, or 100 nucleotides. In embodiments, N is 50 nucleotides.

The fusion need not be between the specific exons found in FIG. 1A, 1B, or 1C but can be fusions of other exons of the first gene to other exons of the second gene, provided that sufficient sequence from the second gene is present to confer kinase activity on an encoded protein and sufficient sequence is present from the first gene to provide for expression of the kinase activity of the fusion partner in an encoded protein.

In another aspect, methods of producing the nucleic acid molecules and polypeptides described herein are also described.

Detection Reagents and Detection of Mutations

In another aspect, the invention features a detection reagent, e.g., a purified or an isolated preparation thereof. Detection reagents can distinguish a nucleic acid, e.g., a genomic or transcribed nucleic acid, e.g., a cDNA or RNA, or protein sequence, having a breakpoint or fusion junction described herein, e.g., in FIG. 1A, 1B, or 1C, or in the section herein entitled Nucleic Acid Molecules, from a reference sequence, e.g., a sequence not having the breakpoint or fusion junction.

In one embodiment, the detection reagent detects (e.g., specifically detects) a fusion nucleic acid or a polypeptide (e.g., distinguishes a wild type or another fusion from a fusion described herein, e.g., in FIG. 1A, 1B, or 1C or in the section herein entitled Nucleic Acid Molecules.

Detection reagents, e.g., nucleic acid-based detection reagents, can be used to identify mutations, e.g., rearrangements or fusion junctions described herein, e.g., in FIG. 1A, 1B, or 1C or in the section herein entitled Nucleic Acid Molecules, in a target nucleic acid, e.g., DNA, e.g., genomic DNA or a transcribed nucleic acid, cDNA, or RNA, e.g., in a sample, e.g., a sample of nucleic acid derived from a neoplastic or tumor cell, e.g., a primary or metastatic cell. In an embodiment a rearrangement or fusion junction described in FIG. 1A, 1B, or 1C or in the section herein entitled Nucleic Acid Molecules, is detected in a sample of the corresponding cancer listed in FIG. 1A or 1B. Detection reagents, e.g., antibody-based detection reagents, can be used to identify, mutations described herein, e.g., in FIG. 1A, 1B, or 1C or in the section herein entitled Nucleic Acid Molecules, in a target protein, e.g., in a sample, e.g., a sample of protein derived from, or produced by, a primary or metastatic cell.

Nucleic Acid-Based Detection Reagents

In an embodiment, the detection reagent comprises a nucleic acid molecule, e.g., a DNA, RNA or mixed DNA/RNA molecule, comprising sequence which is complementary with a nucleic acid sequence on a target nucleic acid, e.g., a nucleic acid that includes the rearrangement or fusion junction, (the sequence on the target nucleic acid that is bound by the detection reagent is referred to herein as the "detection reagent binding site" and the portion of the detection reagent that corresponds to the detection reagent binding site is referred to as the "target binding site"). In an embodiment, the detection reagent binding site is disposed in relationship to the interrogation position, e.g., one or both nucleotides flanking the fusion junction, such that binding (or in embodiments, lack of binding) of the detection reagent to the detection reagent binding site, or the proximity of binding to probes of a detection reagent to their detection binding sites, allows differentiation of mutant and reference sequences for a mutant described herein (e.g., a rearrangement having a breakpoint described herein, e.g., in FIG. 1A, 1B, or 1C or in the section herein entitled Nucleic Acid Molecules, from a reference sequence. The detection reagent can be modified, e.g., with a label or other moiety, e.g., a moiety that allows capture.

In embodiments, a mutation described herein, e.g., in FIG. 1A, 1B, or 1C or in the section herein entitled Nucleic Acid Molecules, is distinguished from reference by binding or lack of binding of a detection reagent.

In embodiments, e.g., with proximity based probes, e.g., FISH probes, a mutation described herein, e.g., in FIG. 1A, 1B, or 1C or in the section herein entitled Nucleic Acid Molecules, and a reference are distinguished by the proximity of the binding of two probes of the detection reagent. E.g., a genomic rearrangement that alters the distance between two binding sites can be detected with proximity based probes, e.g., FISH probes.

In an embodiment, the detection reagent comprises a nucleic acid molecule, e.g., a DNA, RNA or mixed DNA/RNA molecule, which, e.g., in its target binding site, includes the interrogation position, e.g., one or more of the nucleotides that flank a fusion junction, and which can distinguish (e.g., by affinity of binding of the detection reagent to a target nucleic acid, e.g., a genomic or transcribed nucleic acid, e.g., a cDNA or RNA, or the ability for a reaction, e.g., a ligation or extension reaction with the detection reagent) between a mutation, e.g., a translocation described herein, and a reference sequence. In embodiments, the interrogation position, e.g., one or both nucleotides flanking the fusion junction can correspond to a terminal, e.g., to a 3' or 5' terminal nucleotide, a nucleotide immediately adjacent to a 3' or 5' terminal nucleotide, or to another internal nucleotide, of the detection reagent or target binding site.

In embodiments, the difference in the affinity of the detection reagent for a target nucleic acid, e.g., a genomic or transcribed nucleic acid, e.g., a cDNA or RNA, comprising the mutant, e.g., a rearrangement or fusion junction, described in FIG. 1A, 1B, or 1C or in the section herein entitled Nucleic Acid Molecules, and that for a target nucleic acid comprising the reference sequence allows determination of the presence or absence of the mutation (or reference) sequence. Typically, such detection reagents, under assay conditions, will exhibit substantially higher levels of binding only to the mutant or only to the reference sequence, e.g., will exhibit substantial levels of binding only to the mutant or only to the reference sequence.

In embodiments, binding allows (or inhibits) a subsequent reaction, e.g., a subsequent reaction involving the detection reagent or the target nucleic acid. E.g., binding can allow ligation, or the addition of one or more nucleotides to a nucleic acid, e.g., the detection reagent, e.g., by DNA polymerase, which can be detected and used to distinguish mutant from reference. In embodiments, the interrogation position, e.g., one or both nucleotides flanking the fusion junction is located at the terminus, or sufficiently close to the terminus, of the detection reagent or its target binding site, such that hybridization, or a chemical reaction, e.g., the addition of one or more nucleotides to the detection reagent, e.g., by DNA polymerase, only occurs, or occurs at a substantially higher rate, when there is a perfect match between the detection reagent and the target nucleic acid at the interrogation position, e.g., one or both nucleotides flanking the fusion junction or at a nucleotide position within 1, 2, or 3 nucleotides of the interrogation position, e.g., one or both nucleotides flanking the fusion junction.

In an embodiment, the detection reagent comprises a nucleic acid, e.g., a DNA, RNA or mixed DNA/RNA molecule wherein the molecule, or its target binding site, is adjacent (or flanks), e.g., directly adjacent, to the interrogation position, e.g., one or more of the nucleotides that flank a fusion junction, and which can distinguish between a mutation, e.g., a mutant, e.g., a rearrangement or fusion junction, described in FIG. 1A, 1B, or 1C or in the section herein entitled Nucleic Acid Molecules, and a reference sequence, in a target nucleic acid, e.g., a genomic or transcribed nucleic acid, e.g., a cDNA or RNA.

In embodiments, the detection reagent binding site is adjacent to the interrogation position, e.g., one or both nucleotides flanking the fusion junction—e.g., the 5' or 3'terminal nucleotide of the detection reagent, or its target binding site, is adjacent, e.g., between 0 (directly adjacent) and 1,000, 500, 400, 200, 100, 50, 10, 5, 4, 3, 2, or 1 nucleotides from the interrogation position, e.g., one or both nucleotides flanking the fusion junction. In embodiments, the outcome of a reaction will vary with the identity of the nucleotide at the interrogation position, e.g., one or both nucleotides flanking the fusion junction, allowing one to distinguish between mutant and reference sequences. E.g., in the presence of a first nucleotide at the interrogation position, e.g., one or both nucleotides flanking the fusion junction, a first reaction will be favored over a second reaction. E.g., in a ligation or primer extension reaction, the product will differ, e.g., in charge, sequence, size, or susceptibility to a further reaction (e.g., restriction cleavage) depending on the identity of the nucleotide at the interrogation position, e.g., one or both nucleotides flanking the fusion junction. In embodiments the detection reagent comprises paired molecules (e.g., forward and reverse primers), allowing for amplification, e.g., by PCR amplification, of a duplex containing the interrogation position, e.g., one or both nucleotides flanking the fusion junction. In such embodiments, the presence of the mutation can be determined by a difference in the property of the amplification product, e.g., size, sequence, charge, or susceptibility to a reaction, resulting from a sequence comprising the interrogation position, e.g., one or both nucleotides flanking the fusion junction, and a corresponding sequence having a reference nucleotide at the interrogation position, e.g., one or both nucleotides flanking the fusion junctions. In embodiments, the presence or absence of a characteristic amplification product is indicative of the identity of the nucleotide at the interrogation site and thus allows detection of the mutation.

In embodiments, the detection reagent, or its target binding site, is directly adjacent to the interrogation position, e.g., one or both nucleotides flanking the fusion junction, e.g., the 5' or 3'terminal nucleotide of the detection reagent is directly adjacent to the interrogation position, e.g., one or both nucleotides flanking the fusion junction. In embodiments, the identity of the nucleotide at the interrogation position, e.g., one or both nucleotides flanking the fusion junction, will determine the nature of a reaction, e.g., a reaction involving the detection reagent, e.g., the modification of one end of the detection reagent. E.g., in the presence of a first nucleotide at the interrogation position, e.g., one or both nucleotides flanking the fusion junction, a first reaction will be favored over a second reaction. By way of example, the presence of a first nucleotide at the interrogation position, e.g., one or both nucleotides flanking the fusion junction—e.g., a nucleotide associated with a mutation, can promote a first reaction, e.g., the addition of a complementary nucleotide to the detection reagent. By way of example, the presence of an A at the interrogation position, e.g., one or both nucleotides flanking the fusion junction, will cause the incorporation of a T, having, e.g., a first colorimetric label, while the presence of a G and the interrogation position, e.g., one or both nucleotides flanking the fusion junction, will cause the incorporation for a C, having, e.g., a second colorimetric label. In an embodiment, the presence of a first nucleotide at the nucleotide will result in ligation of the detection reagent to a second nucleic acid. E.g., a third nucleic acid can be hybridized to the target nucleic acid sufficiently close to the interrogation site that if the third nucleic acid has an exact match at the interrogation site it will be ligated to the detection reagent. Detection of the ligation product, or its absence, is indicative of the identity of the nucleotide at the interrogation site and thus allows detection of the mutation.

A variety of readouts can be employed. E.g., binding of the detection reagent to the mutant or reference sequence can be followed by a moiety, e.g., a label, associated with the detection reagent, e.g., a radioactive or enzymatic label. In embodiments the label comprises a quenching agent and a signaling agent and hybridization results in altering the distance between those two elements, e.g., increasing the distance and un-quenching the signaling agent. In embodiments, the detection reagent can include a moiety that allows separation from other components of a reaction mixture. In embodiments, binding allows cleavage of the bound detection reagent, e.g., by an enzyme, e.g., by the nuclease activity of the DNA polymerase or by a restriction enzyme. The cleavage can be detected by the appearance or disappearance of a nucleic acid or by the separation of a quenching agent and a signaling agent associated with the detection reagent. In embodiments, binding protects, or renders the target susceptible, to further chemical reaction, e.g., labeling or degradation, e.g., by restriction enzymes. In embodiments binding with the detection reagent allows capture separation or physical manipulation of the target nucleic acid to thereby allow for identification. In embodiments binding can result in a detect localization of the detection reagent or target, e.g., binding could capture the target nucleic acid or displace a third nucleic acid. Binding can allow for determination of the presence of mutant or reference sequences with FISH, particularly in the case of rearrangements. Binding can allow for the extension or other size change in a component, e.g., the detection reagent, allowing distinction between mutant and reference sequences. Binding can allow for the production, e.g., by PCR, of an amplicon that distinguishes mutant from reference sequence.

In an embodiment the detection reagent, or the target binding site, is between 5 and 2000, 5 and 1000, 5 and 500, 5 and 300, 5 and 250, 5 and 200, 5 and 150, 5 and 100, 5 and 50, 5 and 25, 5 and 20, 5 and 15, or 5 and 10 nucleotides in length. In an embodiment the detection reagent, or the target binding site, is between 10 and 2000, 10 and 1000, 10 and 500, 10 and 300, 10 and 250, 10 and 200, 10 and 150, 10 and 100, 10 and 50, 10 and 25, 10 and 20, or 10 and 15, nucleotides in length. In an embodiment the detection reagent, or the target binding site, is between 10 and 2000, 10 and 1000, 20 and 500, 20 and 300, 20 and 250, 20 and 200, 20 and 150, 20 and 100, 20 and 50, or 20 and 25 nucleotides in length. In an embodiment the detection reagent, or the target binding site, is sufficiently long to distinguish between mutant and reference sequences and is less than 100, 200, 300, 400, 500, 1,000, 1,500, and 2,000 nucleotides in length.

In embodiments, the detection reagent comprises two probes which will bind with a first proximity to one another if a mutation described herein, e.g, a rearrangement or fusion junction, described in FIG. 1A, 1B, or 1C or in the section herein entitled *Nucleic Acid Molecules*, is present and with a second proximity if the mutation is not present. Typically, one of the proximities will result in production of a signal and the other will not. E.g., one probe can comprise a signal generator and the other can comprise a signal quencher. If the proximity is close there will be no signal and if the proximity is less close then signal will be produced.

Preparations of Mutant Nucleic Acid and Uses Thereof

In another aspect, the invention features purified or isolated preparations of a neoplastic or tumor cell nucleic acid, e.g., DNA, e.g., genomic DNA or cDNA, or RNA, containing an interrogation position described herein, useful for determining if a mutation disclosed herein is present. The nucleic acid includes the interrogation position, and typically additional fusion sequence on one or both sides of the interrogation position. In addition the nucleic acid can contain heterologous sequences, e.g., adaptor or priming sequences, typically attached to one or both terminus of the nucleic acid. The nucleic acid also includes a label or other moiety, e.g., a moiety that allows separation or localization.

In embodiments, the nucleic acid is between 20 and 1,000, 30 and 900, 40 and 800, 50 and 700, 60 and 600, 70 and 500, 80 and 400, 90 and 300, or 100 and 200 nucleotides in length (with or without heterologous sequences). In one embodiment, the nucleic acid is between 40 and 1,000, 50 and 900, 60 and 800, 70 and 700, 80 and 600, 90 and 500, 100 and 400, 110 and 300, or 120 and 200 nucleotides in length (with or without heterologous sequences). In another embodiment, the nucleic acid is between 50 and 1,000, 50 and 900, 50 and 800, 50 and 700, 50 and 600, 50 and 500, 50 and 400, 50 and 300, or 50 and 200 nucleotides in length (with or without heterologous sequences). In embodiments, the nucleic acid is of sufficient length to allow sequencing (e.g., by chemical sequencing or by determining a difference in $T_m$ between mutant and reference preparations) but is optionally less than 100, 200, 300, 400, or 500 nucleotides in length (with or without heterologous sequences).

Such preparations can be used to sequence nucleic acid from a sample, e.g., a neoplastic or tumor sample. In an embodiment the purified preparation is provided by in situ amplification of a nucleic acid provided on a substrate. In embodiments the purified preparation is spatially distinct from other nucleic acids, e.g., other amplified nucleic acids, on a substrate.

In an embodiment, the purified or isolated preparation of nucleic acid is derived from a neoplasm or tumor of a type described herein, e.g., neoplasm and/or cancer, e.g., a melanocytic neoplasm, melanoma or metastatic cancer. In one embodiment, the fusion nucleic acid is derived from a histiocytoses, e.g., a non-Langerhans cell histiocytosis.

Such preparations can be used to determine if a sample comprises mutant sequence, e.g., a translocation as described herein. In one embodiment, the translocation includes a breakpoint. Nucleic acids that include the aforesaid breakpoint, e.g., a breakpoint described herein, are collectively referred to herein as fusion nucleic acids.

In another aspect, the invention features, a method of determining the sequence of an interrogation position for a mutation described herein, comprising:

providing a purified or isolated preparations of nucleic acid or fusion nucleic acid, e.g., DNA, e.g., genomic DNA or cDNA, or RNA, containing an interrogation position described herein, sequencing, by a method that breaks or forms a chemical bond, e.g., a covalent or non-covalent chemical bond, e.g., in a detection reagent or a target sequence, the nucleic acid so as to determine the identity of the nucleotide at an interrogation position. The method allows determining if a mutation described herein is present.

In an embodiment, sequencing comprises contacting the fusion nucleic acid with a detection reagent described herein.

In an embodiment, sequencing comprises determining a physical property, e.g., stability of a duplex form of the fusion nucleic acid, e.g., $T_m$, that can distinguish mutant from reference sequence.

In an embodiment, the fusion nucleic acid is derived from a neoplasm or a tumor of a type described herein, e.g., a melanocytic neoplasm, melanoma or metastatic cancer. In one embodiment, the fusion nucleic acid is derived from a histiocytoses, e.g., a non-Langerhans cell histiocytosis.

Reaction Mixtures and Devices

In another aspect, the invention features, a reaction mixture comprising:

a) a sample, or nucleic acid, e.g., DNA, e.g., genomic DNA or cDNA, or RNA, e.g., from a cancer, containing:

an interrogation position for a mutation, e.g., a rearrangement or fusion junction, described in FIG. 1A, 1B, 1C, 1D, 1E, 1F, 1G, or 1H or in the section herein entitled *Nucleic Acid Molecules*; or a mutation, e.g., a rearrangement or fusion junction, described in FIG. 1A, 1B, or 1C or in the section herein entitled *Nucleic Acid Molecules*; and b) a detection reagent described herein, e.g., a detection reagent described in the section herein entitled, Detection Reagents and Detection of Mutations, e.g., in the section herein entitled, *Nucleic Acid-based Detection Reagents*.

In an embodiment, the sample comprises nucleic acid from a cancer.

In an embodiment the sample, or nucleic acid in the sample, is from a cancer listed in FIG. 1A or 1B, and the detection reagent detects a mutant, e.g., a rearrangement or fusion junction disclosed in FIG. 1A, 1B, 1C, 1D, 1E, 1F, 1G, or 1H or in the section herein entitled *Nucleic Acid Molecules*.

In an embodiment, the sample, or nucleic acid in the sample, is from a cancer listed in FIG. 1A or 1B, and the detection reagent detects a mutant, e.g., a rearrangement or fusion junction disclosed in FIG. 1A, 1B, 1C, 1D, 1E, 1F, 1G, or 1H or in the section herein entitled *Nucleic Acid Molecules*, in a fusion of the two genes in the fusion associated with that cancer in FIG. 1A or 1B.

In an embodiment:

the sample, or nucleic acid in the sample, is from a lung adenocarcinoma, and the detection reagent is one that detects a fusion of the FGFR3 and TACC3 genes, e.g., a detection reagent that detects a mutant, e.g., a rearrangement or fusion junction described in FIG. 1A, 1B, 1C, 1D, 1E, 1F, 1G, or 1H or in the section herein entitled *Nucleic Acid Molecules*, for a fusion of FGFR3 and TACC3;

the sample, or nucleic acid in the sample, is from a cervical adenocarcinoma, and the detection reagent is one that detects a fusion of the FGFR3 and TACC3 genes, e.g., a detection reagent that detects a mutant, e.g., a rearrangement or fusion junction described in FIG. 1A, 1B, 1C, 1D, 1E, 1F, 1G, or 1H or in the section herein entitled *Nucleic Acid Molecules*, for a fusion of FGFR3 and TACC3;

the sample, or nucleic acid in the sample, is from a uterus endometrial adenocarcinoma, and the detection reagent is one that detects a fusion of the FGFR3 and TACC3 genes, e.g., a detection reagent that detects a mutant, e.g., a rearrangement or fusion junction described in FIG. 1A, 1B, 1C, 1D, 1E, 1F, 1G, or 1H or in the section herein entitled *Nucleic Acid Molecules*, for a fusion of FGFR3 and TACC3;

the sample, or nucleic acid in the sample, is from a glioblastoma, and the detection reagent is one that detects a fusion of the TRIM24 and BRAF genes, e.g., a detection reagent that detects a mutant, e.g., a rearrangement or fusion junction described in FIG. 1A, 1B, 1C, 1D, 1E, 1F, 1G, or 1H or in the section herein entitled *Nucleic Acid Molecules*, for a fusion of TRIM24 and BRAF;

the sample, or nucleic acid in the sample, is from a melanoma, and the detection reagent is one that detects a fusion of the TRIM24 and BRAF genes, e.g., a detection reagent that detects a mutant, e.g., a rearrangement or fusion junction described in FIG. 1A, 1B, 1C, 1D, 1E, 1F, 1G, or 1H or in the section herein entitled *Nucleic Acid Molecules*, for a fusion of TRIM24 and BRAF;

the sample, or nucleic acid in the sample, is from a spindle cell carcinoma, and the detection reagent is one that detects a fusion of the CNTLN and RAF1 genes, e.g., a detection reagent that detects a mutant, e.g., a rearrangement or fusion junction described in FIG. 1A, 1B, 1C, 1D, 1E, IF, 1G, or 1H or in the section herein entitled *Nucleic Acid Molecules*, for a fusion of CNTLN and RAF1;

the sample, or nucleic acid in the sample, is from a amelioblastic fibrosarcoma, and the detection reagent is one that detects a fusion of the TRIM33 and RAF1 genes, e.g., a detection reagent that detects a mutant, e.g., a rearrangement or fusion junction described in FIG. 1A, 1B, 1C, 1D, 1E, IF, 1G, or 1H or in the section herein entitled *Nucleic Acid Molecules*, for a fusion of TRIM33 and RAF1;

the sample, or nucleic acid in the sample, is from a lung adenocarcinoma, and the detection reagent is one that detects a fusion of the TRIM33 and RET genes, e.g., a detection reagent that detects a mutant, e.g., a rearrangement or fusion junction described in FIG. 1A, 1B, 1C, 1D, 1E, IF, 1G, or 1H or in the section herein entitled *Nucleic Acid Molecules*, for a fusion of TRIM33 and RET;

the sample, or nucleic acid in the sample, is from a non-langerhans histocytosis, and the detection reagent is one that detects a fusion of the LMNA and NTRK1 genes, e.g., a detection reagent that detects a mutant, e.g., a rearrangement or fusion junction described in FIG. 1A, 1B, 1C, 1D, 1E, 1F, 1G, or 1H or in the section herein entitled *Nucleic Acid Molecules*, for a fusion of LMNA and NTRK1;

the sample, or nucleic acid in the sample, is from a cholangiocarcinoma, and the detection reagent is one that detects a fusion of the RABGAP1L and NTRK1 genes, e.g., a detection reagent that detects a mutant, e.g., a rearrangement or fusion junction described in FIG. 1A, 1B, 1C, 1D, 1E, 1F, 1G, or 1H or in the section herein entitled *Nucleic Acid Molecules*, for a fusion of RABGAP1L and NTRK1;

the sample, or nucleic acid in the sample, is from a lung adenocarcinoma, and the detection reagent is one that detects a fusion of the MPRIP and NTRK1 genes, e.g., a detection reagent that detects a mutant, e.g., a rearrangement or fusion junction described in FIG. 1A, 1B, 1C, 1D, 1E, 1F, 1G, or 1H or in the section herein entitled *Nucleic Acid Molecules*, for a fusion of MPRIP and NTRK1;

the sample, or nucleic acid in the sample, is from a adenocarcinoma, and the detection reagent is one that detects a fusion of the PDZRN3 and RAF1 genes, e.g., a detection reagent that detects a mutant, e.g., a rearrangement or fusion junction described in FIG. 1A, 1B, 1C, 1D, 1E, 1F, 1G, or 1H or in the section herein entitled *Nucleic Acid Molecules*, for a fusion of PDZRN3 and RAF1;

the sample, or nucleic acid in the sample, is from a urothelial (transitional cell) carcinoma, and the detection reagent is one that detects a fusion of the FGFR1 and NTM genes, e.g., a detection reagent that detects a mutant, e.g., a rearrangement or fusion junction described in FIG. 1A, 1B, 1C, 1D, 1E, 1F, 1G, or 1H or in the section herein entitled *Nucleic Acid Molecules*, for a fusion of FGFR1 and NTN;

the sample, or nucleic acid in the sample, is from a ovarian epithelial carcinoma and the detection reagent is one that detects a fusion of the TTC23 and IGF1R genes, e.g., a detection reagent that detects a mutant, e.g., a rearrangement or fusion junction described in FIG. 1A, 1B, 1C, 1D, 1E, 1F, 1G, or 1H or in the section herein entitled *Nucleic Acid Molecules*, for a fusion of TTC23 and IGF1R;

the sample, or nucleic acid in the sample, is from a lung adenocarcinoma, and the detection reagent is one that detects a fusion of the DOT1L and MYST3 (KAT6A) genes, e.g., a detection reagent that detects a mutant, e.g., a rearrangement or fusion junction described in FIG. 1A, 1B, 1C, 1D, 1E, 1F, 1G, or 1H or in the section herein entitled *Nucleic Acid Molecules*, for a fusion of DOT1L and MYST3 (KAT6A);

the sample, or nucleic acid in the sample, is from a colorectal adenocarcinoma, and the detection reagent is one that detects a fusion of the SMAD4 and MYO5B genes, e.g., a detection reagent that detects a mutant, e.g., a rearrangement or fusion junction described in FIG. 1A, 1B, 1C, 1D, 1E, 1F, 1G, or 1H or in the section herein entitled *Nucleic Acid Molecules*, for a fusion of SMAD4 and MYO5B;

the sample, or nucleic acid in the sample, is from a breast carcinoma, and the detection reagent is one that detects a fusion of the HMGXB3 and FLT4 genes, e.g., a detection reagent that detects a mutant, e.g., a rearrangement or fusion junction described in FIG. 1A, 1B, 1C, 1D, 1E, 1F, 1G, or 1H or in the section herein entitled *Nucleic Acid Molecules*, for a fusion of HMGXB3 and FLT4;

the sample, or nucleic acid in the sample, is from a prostate carcinoma, and the detection reagent is one that detects a fusion of the TMPRSS2 and MX1 genes, e.g., a detection reagent that detects a mutant, e.g., a rearrangement or fusion junction described in FIG. 1A, 1B, 1C, 1D, 1E, 1F, 1G, or 1H or in the section herein entitled *Nucleic Acid Molecules*, for a fusion of TMPRSS2 and MX1;

the sample, or nucleic acid in the sample, is from a lung adenocarcinoma, and the detection reagent is one that detects a fusion of the MCDF2 and ALK genes, e.g., a detection reagent that detects a mutant, e.g., a rearrangement or fusion junction described in FIG. 1A, 1B, 1C, 1D, 1E, 1F, 1G, or 1H or in the section herein entitled *Nucleic Acid Molecules*, for a fusion of MCDF2 and ALK;

the sample, or nucleic acid in the sample, is from a breast carcinoma, and the detection reagent is one that detects a fusion of the RANBP17 and FGFR3 genes, e.g., a detection reagent that detects a mutant, e.g., a rearrangement or fusion junction described in FIG. 1A, 1B, 1C, 1D, 1E, 1F, 1G, or 1H or in the section herein entitled *Nucleic Acid Molecules*, for a fusion of RANBP17 and FGFR3;

the sample, or nucleic acid in the sample, is from a pancreas ductal adenocarcinoma, and the detection reagent is one that detects a fusion of the NUMA1 and ERBB4 genes, e.g., a detection reagent that detects a mutant, e.g., a rearrangement or fusion junction described in FIG. 1A, 1B, 1C, 1D, 1E, 1F, 1G, or 1H or in the section herein entitled *Nucleic Acid Molecules*, for a fusion of NUMA1 and ERBB4;

the sample, or nucleic acid in the sample, is from a colorectal cancer, and the detection reagent is one that detects a fusion of the TPM3 and NTRK1 genes, e.g., a detection reagent that detects a mutant, e.g., a rearrangement or fusion junction described in FIG. 1A, 1B, 1C, 1D, 1E, 1F, 1G, or 1H or in the section herein entitled *Nucleic Acid Molecules*, for a fusion of TPM3 and NTRK1;

the sample, or nucleic acid in the sample, is from a breast cancer, e.g., triple negative breast cancer, and the detection reagent is one that detects a fusion of the SNAPC4 and NOTCH1 genes, e.g., a detection reagent that detects a mutant, e.g., a rearrangement or fusion junction described in FIG. 1A, 1B, 1C, 1D, 1E, 1F, 1G, or 1H or in the section herein entitled *Nucleic Acid Molecules*, for a fusion of SNAPC4 and NOTCH1;

the sample, or nucleic acid in the sample, is from a breast cancer, e.g., triple negative breast cancer, and the detection reagent is one that detects a fusion of the TSC2 and CREBBP genes, e.g., a detection reagent that detects a mutant, e.g., a rearrangement or fusion junction described in FIG. 1A, 1B, 1C, 1D, 1E, 1F, 1G, or 1H or in the section herein entitled *Nucleic Acid Molecules*, for a fusion of TSC2 and CREBBP;

the sample, or nucleic acid in the sample, is from a breast cancer, e.g., triple negative breast cancer, and the detection reagent is one that detects a fusion of the C5orf42 and ERBB4 genes, e.g., a detection reagent that detects a mutant, e.g., a rearrangement or fusion junction described in FIG. 1A, 1B, 1C, 1D, 1E, 1F, 1G, or 1H or in the section herein entitled *Nucleic Acid Molecules*, for a fusion of C5orf42 and ERBB4;

the sample, or nucleic acid in the sample, is from a colorectal cancer, and the detection reagent is one that detects a fusion of the USP2 and CBL genes, e.g., a detection reagent that detects a mutant, e.g., a rearrangement or fusion junction described in FIG. 1A, 1B, 1C, 1D, 1E, 1F, 1G, or 1H or in the section herein entitled *Nucleic Acid Molecules*, for a fusion of USP2 and CBL;

the sample, or nucleic acid in the sample, is from a breast cancer, e.g., triple negative breast cancer, and the detection reagent is one that detects a fusion of the STK32B and ALKgenes, e.g., a detection reagent that detects a mutant, e.g., a rearrangement or fusion junction described in FIG. 1A, 1B, 1C, 1D, 1E, 1F, 1G, or 1H or in the section herein entitled *Nucleic Acid Molecules*, for a fusion of STK32B and ALK;

the sample, or nucleic acid in the sample, is from a breast cancer, e.g., triple negative breast cancer, and the detection reagent is one that detects a fusion of the FGFR2 and TACC3 genes, e.g., a detection reagent that detects a mutant, e.g., a rearrangement or fusion junction described in FIG.

1A, 1B, 1C, 1D, 1E, 1F, 1G, or 1H or in the section herein entitled *Nucleic Acid Molecules*, for a fusion of FGFR2 and TACC3;

the sample, or nucleic acid in the sample, is from a breast cancer, e.g., triple negative breast cancer, and the detection reagent is one that detects a fusion of the FGFR2 and KIAA1598 genes, e.g., a detection reagent that detects a mutant, e.g., a rearrangement or fusion junction described in FIG. 1A, 1B, 1C, 1D, 1E, 1F, 1G, or 1H or in the section herein entitled *Nucleic Acid Molecules*, for a fusion of FGFR2 and KIAA1598;

the sample, or nucleic acid in the sample, is from a breast cancer, e.g., triple negative breast cancer, and the detection reagent is one that detects a fusion of the BICC1 and FGFR2 genes, e.g., a detection reagent that detects a mutant, e.g., a rearrangement or fusion junction described in FIG. 1A, 1B, 1C, 1D, 1E, 1F, 1G, or 1H or in the section herein entitled *Nucleic Acid Molecules*, for a fusion of BICC1 and FGFR2;

the sample, or nucleic acid in the sample, is from a breast cancer, e.g., triple negative breast cancer, and the detection reagent is one that detects a fusion of the FGFR3 and JAKMIP1 genes, e.g., a detection reagent that detects a mutant, e.g., a rearrangement or fusion junction described in FIG. 1A, 1B, 1C, 1D, 1E, 1F, 1G, or 1H or in the section herein entitled *Nucleic Acid Molecules*, for a fusion of FGFR3 and JAKMIP1;

the sample, or nucleic acid in the sample, is from a breast cancer, e.g., triple negative breast cancer, and the detection reagent is one that detects a fusion of the MASP2 and MTOR genes, e.g., a detection reagent that detects a mutant, e.g., a rearrangement or fusion junction described in FIG. 1A, 1B, 1C, 1D, 1E, 1F, 1G, or 1H or in the section herein entitled *Nucleic Acid Molecules*, for a fusion of MASP2 and MTOR;

the sample, or nucleic acid in the sample, is from a breast cancer, e.g., triple negative breast cancer, and the detection reagent is one that detects a fusion of the FGFR2 and BICC1 genes, e.g., a detection reagent that detects a mutant, e.g., a rearrangement or fusion junction described in FIG. 1A, 1B, 1C, 1D, 1E, 1F, 1G, or 1H or in the section herein entitled *Nucleic Acid Molecules*, for a fusion of FGFR2 and BICC1;

the sample, or nucleic acid in the sample, is from a breast cancer, e.g., triple negative breast cancer, and the detection reagent is one that detects a fusion of the CD74 and ROS1 genes, e.g., a detection reagent that detects a mutant, e.g., a rearrangement or fusion junction described in FIG. 1A, 1B, 1C, 1D, 1E, 1F, 1G, or 1H or in the section herein entitled *Nucleic Acid Molecules*, for a fusion of CD74 and ROS1.

In another aspect, the invention features, purified or isolated preparations of a fusion nucleic acid, e.g., DNA, e.g., genomic DNA or cDNA, or RNA, containing an interrogation position, e.g., one or both nucleotides flanking the fusion junction, described herein or a mutation, e.g., a rearrangement or fusion junction, described in FIG. 1A, 1B, 1C, 1D, 1E, 1F, 1G, or 1H or in the section herein entitled *Nucleic Acid Molecules*. In embodiments the preparation is useful for determining if a mutation disclosed herein is present. In embodiments the preparation is disposed in a device, e.g., a sequencing device, or a sample holder for use in such a device. In an embodiment, the fusion nucleic acid is derived from a neoplasm or a tumor of a type described herein, e.g., a cancer described in FIG. 1A or 1B. In an embodiment the nucleic acid is from a cancer listed in FIG. 1A or 1B. In an embodiment the nucleic acid is from a cancer listed in FIG. 1A or 1B and the device also includes a detection reagent is one that detects a fusion of the genes associate with that cancer in FIG. 1A or 1B, e.g., a detection reagent that detects a mutant, e.g., a rearrangement or fusion junction described in FIG. 1A, 1B, 1C, 1D, 1E, 1F, 1G, or 1H or in the section herein entitled *Nucleic Acid Molecules*, for a fusion of the genes that are the fusion partners with the fusion associated with the cancer in FIG. 1A or 1B.

In another aspect, the invention features, purified or isolated preparations of a fusion nucleic acid, e.g., DNA, e.g., genomic DNA or cDNA, or RNA, containing an interrogation position, e.g., one or both nucleotides flanking the fusion junction, described herein or a mutation, e.g., a rearrangement or fusion junction, described in FIG. 1A, 1B, or 1C or in the section herein entitled *Nucleic Acid Molecules*., useful for determining if a mutation disclosed herein is present, disposed in a device for determining a physical or chemical property, e.g., stability of a duplex, e.g., $T_m$ or a sample holder for use in such a device. In an embodiment, the device is a calorimeter. In an embodiment the fusion nucleic acid is derived from a neoplasm or a tumor of a type described herein, e.g., in FIG. 1A or 1B.

The detection reagents described herein can be used to determine if a mutation described herein is present in a sample. In embodiments, the sample comprises a nucleic acid that is derived from a neoplastic or a tumor cell, e.g. a cancer described in FIG. XA. The cell can be from a neoplastic or a tumor sample, e.g., a biopsy taken from the neoplasm or the tumor; from circulating tumor cells, e.g., from peripheral blood; or from a blood or plasma sample.

In another aspect, the invention features, a method of making a reaction mixture by combining:

a) a sample, or nucleic acid, e.g., DNA, e.g., genomic DNA or cDNA, or RNA, e.g., from a cancer, containing:

an interrogation position for a mutation, e.g., a rearrangement or fusion junction, described in FIG. 1A, 1B, 1C, 1D, 1E, 1F, 1G, or 1H or in the section herein entitled *Nucleic Acid Molecules*; or a mutation, e.g., a rearrangement or fusion junction, described in FIG. 1A, 1B, 1C, 1D, 1E, 1F, 1G, or 1H or in the section herein entitled *Nucleic Acid Molecules*; and b) a detection reagent described herein, e.g., a detection reagent described in the section herein entitled, *Detection Reagents and Detection of Mutations*, e.g., in the section herein entitled, *Nucleic Acid-based Detection Reagents*.

A mutation described herein, can be distinguished from a reference, e.g., a non-mutant or wildtype sequence, by reaction with an enzyme that reacts differentially with the mutation and the reference. E.g., they can be distinguished by cleavage with a restriction enzyme that has differing activity for the mutant and reference sequences. E.g., the invention includes a method of contacting a nucleic acid comprising a mutation described herein with such an enzyme and determining if a product of that cleavage which can distinguish mutant form reference sequence is present.

In one aspect the inventions provides, a purified preparation of a restriction enzyme cleavage product which can distinguish between mutant and reference sequence, wherein one end of the cleavage product is defined by an enzyme that cleaves differentially between mutant and reference sequence. In an embodiment, the cleavage product includes the interrogation position, e.g., one or both nucleotides flanking the fusion junction.

Protein-Based Detection Reagents, Methods, Reaction Mixtures and Devices

A mutant protein described herein can be distinguished from a reference, e.g., a non-mutant or wild-type protein, by reaction with a reagent, e.g., a substrate, e.g, a substrate for catalytic activity, e.g., phosphorylation or other fusion protein activity, or an antibody that reacts differentially with the mutant and reference protein. In one aspect, the invention includes a method of contacting a sample comprising a mutant protein described herein with such reagent and determining if the mutant protein is present in the sample.

Accordingly, in another aspect, the invention features, a reaction mixture comprising:
  a) a sample, e.g., a cancer sample, comprising a fusion protein having fusion partners described in FIG. 1A, 1B, 1C, 1D, 1E, 1F, 1G, or 1H, e.g., a fusion protein encoded by a mutation described in FIG. 1A, 1B, 1C, 1D, 1E, 1F, 1G, or 1H or in the section herein entitled *Nucleic Acid Molecules*; and
  b) a detection reagent, e.g., a substrate, e.g, a substrate for catalytic activity, e.g., phosphorylation or other fusion protein activity, or an antibody, that reacts differentially with the mutant and reference protein.

In another aspect, the invention features, a method of making a reaction mixture comprising combining:
  a) a sample, e.g., a cancer sample, comprising a fusion protein having fusion partners described in FIG. 1A, 1B, 1C, 1D, 1E, 1F, 1G, or 1H, e.g., a fusion protein encoded by a mutation described in FIG. 1A, 1B, 1C, 1D, 1E, 1F, 1G, or 1H or in the section herein entitled *Nucleic Acid Molecules*; and
  b) a detection reagent, e.g., a substrate, e.g, a substrate for catalytic activity, e.g., phosphorylation or other fusion protein activity, or an antibody, that reacts differentially with the mutant and reference protein.

Kits

In another aspect, the invention features a kit comprising a detection reagent as described herein.

Methods Reducing a Fusion Molecule Activity

In another aspect, the invention features a method of reducing an activity of a fusion molecule described herein. The method includes contacting the fusion molecule, or a fusion molecule-expressing cell, with an agent that inhibits an activity or expression of the fusion molecule (e.g., an inhibitor, e.g., a kinase inhibitor). In one embodiment, the contacting step can be effected in vitro, e.g., in a cell lysate or in a reconstituted system. Alternatively, the method can be performed on cells in culture, e.g., in vitro or ex vivo. In other embodiments, the method can be performed on fusion molecule-expressing cells present in a subject, e.g., as part of an in vivo (e.g., therapeutic or prophylactic) protocol. In an embodiment the method is practiced on an animal subject (e.g., an in vivo animal model). In certain embodiments, the fusion molecule is a nucleic acid molecule or a polypeptide as described herein.

In a related aspect, a method of inhibiting, reducing, or treating a hyperproliferative disorder, e.g., a neoplasm (including benign, pre-malignant or malignant (e.g., a cancer), in a subject is provided. The method includes administering to the subject a preselected therapeutic agent, e.g., an anti-cancer agent (e.g., a kinase inhibitor), as a single agent, or in combination, in an amount sufficient to reduce, inhibit or treat the activity or expression of a fusion molecule described herein), thereby inhibiting, reducing, or treating the hyperproliferative disorder in the subject. "Treatment" as used herein includes, but is not limited to, inhibiting tumor growth, reducing tumor mass, reducing size or number of metastatic lesions, inhibiting the development of new metastatic lesions, prolonged survival, prolonged progression-free survival, prolonged time to progression, and/or enhanced quality of life.

In one embodiment, a kinase inhibitor is administered based on a determination that a fusion molecule described herein is present in a subject, e.g., based on its present in a subject's sample. Thus, treatment can be combined with fusion molecule detection or evaluation method, e.g., as described herein, or administered in response to a determination made by a fusion molecule detection or evaluation method, e.g., as described herein. In certain embodiments, the kinase inhibitor is administered responsive to acquiring knowledge or information of the presence of the fusion molecule in a subject. In one embodiment, the kinase inhibitor is administered responsive to acquiring knowledge or information on the subject's genotype, e.g., acquiring knowledge or information that the patient's genotype has a fusion molecule. In other embodiments, the kinase inhibitor is administered responsive to receiving a communication (e.g., a report) of the presence of the fusion molecule in a subject (e.g., a subject's sample). In yet other embodiments, the kinase inhibitor is administered responsive to information obtained from a collaboration with another party that identifies the presence of the fusion molecule in a subject (e.g., a subject's sample). In other embodiments, the kinase inhibitor is administered responsive to a determination that the fusion molecule is present in a subject. In one embodiment, the determination of the presence of the fusion molecule is carried out using one or more of the methods, e.g., the sequencing methods, described herein. In other embodiments, the determination of the presence of the fusion molecule includes receiving information on the subject's fusion molecule genotype, e.g., from another party or source.

The methods can, optionally, further include the step(s) of identifying (e.g., evaluating, diagnosing, screening, and/or selecting) a subject at risk of having, or having, a fusion molecule described herein. In one embodiment, the method further includes one or more of: acquiring knowledge or information of the presence of the fusion molecule in a subject (e.g., a subject's sample); acquiring knowledge or information on the subject's genotype, e.g., acquiring knowledge or information that the patient's genotype has a fusion molecule; receiving a communication (e.g., a report) of the presence of the fusion molecule in a subject (e.g., a subject's sample); or collaborating with another party that identifies the presence of the fusion molecule in a subject.

In one embodiment, the subject treated has a fusion molecule described herein; e.g., the subject has a tumor or cancer harboring a fusion molecule described herein. In other embodiments, the subject has been previously identified as having a fusion molecule described herein. In yet other embodiments, the subject has been previously identified as being likely or unlikely to respond to treatment with a protein kinase inhibitor, e.g., a subject that has previously participated in a clinical trial. In other embodiments, the subject has been previously identified as being likely or unlikely to respond to treatment with a protein kinase inhibitor, based on the presence of the fusion molecule described herein. In one embodiment, the subject is a mammal, e.g., a human. In one embodiment, the subject has, or at risk of having a cancer at any stage of disease. In other embodiments, the subject is a patient, e.g., a cancer patient.

In other embodiments, the subject treated is a cancer patient who has participated in a clinical trial. For example, the subject participated in a clinical trial that evaluated a kinase inhibitor (e.g., a multikinase inhibitor, a specific kinase inhibitor). In other embodiment, the subject participated in a clinical trial that evaluates upstream or downstream targets of the specific kinase. In one embodiment, said cancer patient responded to the kinase inhibitor evaluated.

In certain embodiments, the neoplasm or neoplastic cell is a benign, pre-malignant, malignant (cancer) or metastasis. In certain embodiments, the cancer is a solid tumor, a soft tissue tumor, or a metastatic lesion. In one embodiment, the cancer is chosen from lung adenocarcinoma, cervical adenocarcinoma, uterus endometrial adenocarcinoma, glioblastoma, melanoma, spindle cell sarcoma, ameloblastic fibroscarcoma, adenocarcinoma, cholangiocarcinoma, urothelial (transitional cell) carcinoma, ovarian epithelial carcinoma, colorectal adenocarcinoma, breast carcinoma, prostate carcinoma, or pancreas ductal adenocarcinoma. In one embodiment, the cancer is chosen from a lung cancer, a pancreatic cancer, melanoma, a colorectal cancer, an esophageal-gastric cancer, a thyroid cancer, or an adenocarcinoma. In other embodiment, the lung cancer is chosen from one or more of the following: non-small cell lung cancer (NSCLC), small cell lung cancer (SCLC), squamous cell carcinoma (SCC), adenocarcinoma of the lung, bronchogenic carcinoma, or a combination thereof. In one embodiment, the lung cancer is NSCLC or SCC.

In one embodiment, the anti-cancer agent is a kinase inhibitor. For example, the kinase inhibitor is a multi-kinase inhibitor or an specific inhibitor.

In other embodiments, the anti-cancer agent is a antagonist of a fusion molecule described herein which inhibits the expression of nucleic acid encoding the fusion molecule. Examples of such fusion molecule antagonists include nucleic acid molecules, for example, antisense molecules, ribozymes, RNAi, triple helix molecules that hybridize to a nucleic acid encoding a fusion molecule described herein, or a transcription regulatory region, and blocks or reduces mRNA expression of the fusion molecule.

In other embodiments, the inhibitor, e.g., kinase inhibitor, is administered in combination with a second therapeutic agent or a different therapeutic modality, e.g., anti-cancer agents, and/or in combination with surgical and/or radiation procedures. For example, the second therapeutic agent can be a cytotoxic or a cytostatic agent. Exemplary cytotoxic agents include antimicrotubule agents, topoisomerase inhibitors, or taxanes, antimetabolites, mitotic inhibitors, alkylating agents, intercalating agents, agents capable of interfering with a signal transduction pathway, agents that promote apoptosis and radiation. In yet other embodiments, the methods can be used in combination with immunodulatory agents, e.g., IL-1, 2, 4, 6, or 12, or interferon alpha or gamma, or immune cell growth factors such as GM-CSF.

Screening Methods

In another aspect, the invention features a method, or assay, for screening for agents that modulate, e.g., inhibit, the expression or activity of a fusion molecule described herein. The method includes contacting a fusion molecule described herein, or a cell expressing a fusion molecule described herein, with a candidate agent; and detecting a change in a parameter associated with a fusion molecule described herein, e.g., a change in the expression or an activity of the fusion molecule. The method can, optionally, include comparing the treated parameter to a reference value, e.g., a control sample (e.g., comparing a parameter obtained from a sample with the candidate agent to a parameter obtained from a sample without the candidate agent). In one embodiment, if a decrease in expression or activity of the fusion molecule is detected, the candidate agent is identified as an inhibitor. In another embodiment, if an increase in expression or activity of the fusion molecule is detected, the candidate agent is identified as an activator. In certain embodiments, the fusion molecule is a nucleic acid molecule or a polypeptide as described herein.

In one embodiment, the contacting step is effected in a cell-free system, e.g., a cell lysate or in a reconstituted system. In other embodiments, the contacting step is effected in a cell in culture, e.g., a cell expressing a fusion molecule described herein (e.g., a mammalian cell, a tumor cell or cell line, a recombinant cell). In yet other embodiments, the contacting step is effected in a cell in vivo (a fusion molecule-expressing cell present in a subject, e.g., an animal subject (e.g., an in vivo animal model).

Exemplary parameters evaluated include one or more of:
(i) a change in binding activity, e.g., direct binding of the candidate agent to a fusion polypeptide described herein; a binding competition between a known ligand and the candidate agent to a fusion polypeptide described herein;
(ii) a change in kinase activity, e.g., phosphorylation levels of a fusion polypeptide described herein (e.g., an increased or decreased autophosphorylation); or a change in phosphorylation of a target of an kinase. In certain embodiments, a change in kinase activity, e.g., phosphorylation, is detected by any of Western blot (e.g., using an antibody specific for either of the genes associated with a fusion molecule described herein; a phosphor-specific antibody, detecting a shift in the molecular weight of a fusion polypeptide described herein), mass spectrometry, immunoprecipitation, immunohistochemistry, immunomagnetic beads, among others;
(iii) a change in an activity of a cell containing a fusion molecule described herein (e.g., a tumor cell or a recombinant cell), e.g., a change in proliferation, morphology or tumorigenicity of the cell;
(iv) a change in tumor present in an animal subject, e.g., size, appearance, proliferation, of the tumor; or
(v) a change in the level, e.g., expression level, of a fusion polypeptide or nucleic acid molecule described herein.

In one embodiment, a change in a cell free assay in the presence of a candidate agent is evaluated. For example, an activity of a fusion molecule described herein, or interaction of a fusion molecule described herein with a downstream ligand can be detected. In one embodiment, a fusion polypeptide described herein is contacted with a ligand, e.g., in solution, and a candidate agent is monitored for an ability to modulate, e.g., inhibit, an interaction, e.g., binding, between the fusion polypeptide and the ligand.

In other embodiments, a change in an activity of a cell is detected in a cell in culture, e.g., a cell expressing a fusion molecule described herein (e.g., a mammalian cell, a tumor cell or cell line, a recombinant cell). In one embodiment, the cell is a recombinant cell that is modified to express a fusion nucleic acid described herein, e.g., is a recombinant cell transfected with a fusion nucleic acid described herein. The transfected cell can show a change in response to the expressed fusion molecule, e.g., increased proliferation, changes in morphology, increased tumorigenicity, and/or acquired a transformed phenotype. A change in any of the activities of the cell, e.g., the recombinant cell, in the presence of the candidate agent can be detected. For example, a decrease in one or more of: proliferation, tumorigenicity, transformed morphology, in the presence of the candidate agent can be indicative of an inhibitor of a fusion molecule described herein. In other embodiments, a change in binding activity or phosphorylation as described herein is detected.

In yet other embodiment, a change in a tumor present in an animal subject (e.g., an in vivo animal model) is detected. In one embodiment, the animal model is a tumor containing animal or a xenograft comprising cells expressing a fusion molecule described herein (e.g., tumorigenic cells expressing a fusion molecule described herein). The candidate agent can be administered to the animal subject and a change in the tumor is detected. In one embodiment, the change in the tumor includes one or more of a tumor growth, tumor size, tumor burden, survival, is evaluated. A decrease in one or more of tumor growth, tumor size, tumor burden, or an increased survival is indicative that the candidate agent is an inhibitor.

In other embodiments, a change in expression of a fusion molecule described herein can be monitored by detecting the nucleic acid or protein levels, e.g., using the methods described herein.

In certain embodiments, the screening methods described herein can be repeated and/or combined. In one embodiment, a candidate agent that is evaluated in a cell-free or cell-based described herein can be further tested in an animal subject.

In one embodiment, the candidate agent is a small molecule compound, e.g., a kinase inhibitor, a nucleic acid (e.g., antisense, siRNA, aptamer, ribozymes, microRNA), an antibody molecule (e.g., a full antibody or antigen binding fragment thereof that binds to a gene of a fusion molecule described herein). The candidate agent can be obtained from a library (e.g., a commercial library of kinase inhibitors) or rationally designed (e.g., based on the kinase domain of a fusion described herein).

Methods for Detecting Fusions

In another aspect, the invention features a method of determining the presence of a fusion as described herein. In one embodiment, the fusion is detected in a nucleic acid molecule or a polypeptide. The method includes detecting whether a fusion nucleic acid molecule or polypeptide is present in a cell (e.g., a circulating cell), a tissue (e.g., a tumor), or a sample, e.g., a tumor sample, from a subject. In one embodiment, the sample is a nucleic acid sample. In one embodiment, the nucleic acid sample comprises DNA, e.g., genomic DNA or cDNA, or RNA, e.g., mRNA. In other embodiments, the sample is a protein sample.

In one embodiment, the sample is, or has been, classified as non-malignant using other diagnostic techniques, e.g., immunohistochemistry.

In one embodiment, the sample is acquired from a subject (e.g., a subject having or at risk of having a cancer, e.g., a patient), or alternatively, the method further includes acquiring a sample from the subject. The sample can be chosen from one or more of: tissue, e.g., cancerous tissue (e.g., a tissue biopsy), whole blood, serum, plasma, buccal scrape, sputum, saliva, cerebrospinal fluid, urine, stool, circulating tumor cells, circulating nucleic acids, or bone marrow. In certain embodiments, the sample is a tissue (e.g., a tumor biopsy), a circulating tumor cell or nucleic acid.

In one embodiment, the cancer is chosen from lung adenocarcinoma, cervical adenocarcinoma, uterus endometrial adenocarcinoma, glioblastoma, melanoma, spindle cell sarcoma, ameloblastic fibrosarcoma, adenocarcinoma, cholangiocarcinoma, urothelial (transitional cell) carcinoma, ovarian epithelial carcinoma, colorectal adenocarcinoma, breast carcinoma, prostate carcinoma, or pancreas ductal adenocarcinoma. In embodiments, the tumor is from a cancer described herein, e.g., is chosen from a lung cancer, a colorectal cancer, an esophageal-gastric cancer, a thyroid cancer, an adenocarcinoma or a melanoma. In one embodiment, the tumor is from a lung cancer, e.g., a NSCLC, a SCLC, a SCC, or a combination thereof.

In one embodiment, the subject is at risk of having, or has a cancer (e.g., a patient with a cancer described herein).

In other embodiments, the fusion molecule is detected in a nucleic acid molecule by a method chosen from one or more of: nucleic acid hybridization assay, amplification-based assays (e.g., polymerase chain reaction (PCR)), PCR-RFLP assay, real-time PCR, sequencing, screening analysis (including metaphase cytogenetic analysis by standard karyotype methods, FISH (e.g., break away FISH), spectral karyotyping or MFISH, comparative genomic hybridization), in situ hybridization, SSP, HPLC or mass-spectrometric genotyping.

In one embodiment, the method includes: contacting a nucleic acid sample, e.g., a genomic DNA sample (e.g., a chromosomal sample or a fractionated, enriched or otherwise pretreated sample) or a gene product (mRNA, cDNA), obtained from the subject, with a nucleic acid fragment (e.g., a probe or primer as described herein (e.g., an exon-specific probe or primer) under conditions suitable for hybridization, and determining the presence or absence of the fusion nucleic acid molecule. The method can, optionally, include enriching a sample for the gene or gene product.

In a related aspect, a method for determining the presence of a fusion nucleic acid molecule described herein is provided. The method includes: acquiring a sequence for a position in a nucleic acid molecule, e.g., by sequencing at least one nucleotide of the nucleic acid molecule (e.g., sequencing at least one nucleotide in the nucleic acid molecule that comprises the fusion), thereby determining that the fusion molecule is present in the nucleic acid molecule. Optionally, the sequence acquired is compared to a reference sequence, or a wild type reference sequence. In one embodiment, the nucleic acid molecule is from a cell (e.g., a circulating cell), a tissue (e.g., a tumor), or any sample from a subject (e.g., blood or plasma sample). In other embodiments, the nucleic acid molecule from a tumor sample (e.g., a tumor or cancer sample) is sequenced. In one embodiment, the sequence is determined by a next generation sequencing method. The method further can further include acquiring, e.g., directly or indirectly acquiring, a sample, e.g., a tumor or cancer sample, from a subject (e.g., a patient). In certain embodiments, the cancer is chosen from a lung cancer, colorectal cancer, esophageal-gastric cancer or melanoma.

In another aspect, the invention features a method of analyzing a tumor or a circulating tumor cell. The method includes acquiring a nucleic acid sample from the tumor or the circulating cell; and sequencing, e.g., by a next generation sequencing method, a nucleic acid molecule, e.g., a nucleic acid molecule that includes a fusion molecule as described herein.

In yet other embodiment, a fusion polypeptide is detected. The method includes: contacting a protein sample with a reagent which specifically binds to a fusion polypeptide described herein; and detecting the formation of a complex of the fusion polypeptide and the reagent. In one embodiment, the reagent is labeled with a detectable group to facilitate detection of the bound and unbound reagent. In one embodiment, the reagent is an antibody molecule, e.g., is selected from the group consisting of an antibody, and antibody derivative, and an antibody fragment.

In yet another embodiment, the level (e.g., expression level) or activity the fusion molecule is evaluated. For example, the level (e.g., expression level) or activity of the fusion molecule (e.g., mRNA or polypeptide) is detected and (optionally) compared to a pre-determined value, e.g., a reference value (e.g., a control sample).

In yet another embodiment, the fusion molecule is detected prior to initiating, during, or after, a treatment, e.g., treatment with a kinase inhibitor, in a subject having a fusion described herein.

In one embodiment, the fusion molecule is detected at the time of diagnosis with a cancer. In other embodiment, the fusion molecule is detected at a pre-determined interval, e.g., a first point in time and at least at a subsequent point in time.

In certain embodiments, responsive to a determination of the presence of the fusion molecule, the method further includes one or more of:
 (1) stratifying a patient population (e.g., assigning a subject, e.g., a patient, to a group or class);
 (2) identifying or selecting the subject as likely or unlikely to respond to a treatment, e.g., a kinase inhibitor treatment as described herein;
 (3) selecting a treatment option, e.g., administering or not administering a preselected therapeutic agent, e.g., a kinase inhibitor as described herein; or
 (4) prognosticating the time course of the disease in the subject (e.g., evaluating the likelihood of increased or decreased patient survival).

In certain embodiments, the kinase inhibitor is a multi-kinase inhibitor or a specific inhibitor.

In certain embodiments, responsive to the determination of the presence of a fusion molecule described herein, the subject is classified as a candidate to receive treatment with a kinase inhibitor, e.g., a kinase inhibitor as described herein. In one embodiment, responsive to the determination of the presence of a fusion molecule described herein, the subject, e.g., a patient, can further be assigned to a particular class if a fusion is identified in a sample of the patient. For example, a patient identified as having a fusion molecule described herein can be classified as a candidate to receive treatment with a kinase inhibitor, e.g., a specific kinase inhibitor as described herein. In one embodiment, the subject, e.g., a patient, is assigned to a second class if the mutation is not present. For example, a patient who has a lung tumor that does not contain a fusion molecule described herein, may be determined as not being a candidate to receive a kinase inhibitor, e.g., a specific kinase inhibitor as described herein.

In another embodiment, responsive to the determination of the presence of the fusion molecule, the subject is identified as likely to respond to a treatment that comprises a kinase inhibitor e.g., a kinase inhibitor as described herein.

In yet another embodiment, responsive to the determination of the presence of the fusion molecule, the method includes administering a kinase inhibitor, e.g., a kinase inhibitor as described herein, to the subject.

Method of Evaluating a Tumor or a Subject

In another aspect, the invention features a method of evaluating a subject (e.g., a patient), e.g., for risk of having or developing a cancer, e.g., a lung cancer, colorectal cancer or skin cancer. The method includes: acquiring information or knowledge of the presence of a fusion as described herein in a subject (e.g., acquiring genotype information of the subject that identifies a fusion as being present in the subject); acquiring a sequence for a nucleic acid molecule identified herein (e.g., a nucleic acid molecule that includes a fusion molecule sequence described herein); or detecting the presence of a fusion nucleic acid or polypeptide in the subject), wherein the presence of the fusion is positively correlated with increased risk for, or having, a cancer associated with such a fusion.

The method can further include acquiring, e.g., directly or indirectly, a sample from a patient and evaluating the sample for the present of a fusion molecule described herein.

The method can further include the step(s) of identifying (e.g., evaluating, diagnosing, screening, and/or selecting) the subject as being positively correlated with increased risk for, or having, a cancer associated with the fusion molecule.

In another embodiment, a subject identified has having a fusion molecule described herein is identified or selected as likely or unlikely to respond to a treatment, e.g., a kinase inhibitor treatment as described herein. The method can further include treating the subject with a kinase inhibitor, e.g., a kinase inhibitor as described herein.

In certain embodiments, the subject is a patient or patient population that has participated in a clinical trial. In one embodiment, the subject has participated in a clinical trial for evaluating a kinase inhibitor (e.g., a multi-kinase inhibitor or a specific kinase inhibitor). In one embodiment, the clinical trial is discontinued or terminated. In one embodiment, the subject responded favorably to the clinical trial, e.g., experience an improvement in at least one symptom of a cancer (e.g., decreased in tumor size, rate of tumor growth, increased survival). In other embodiments, the subject did not respond in a detectable way to the clinical trial.

In a related aspect, a method of evaluating a patient or a patient population is provided. The method includes: identifying, selecting, or obtaining information or knowledge that the patient or patient population has participated in a clinical trial; acquiring information or knowledge of the presence of a fusion molecule described herein in the patient or patient population (e.g., acquiring genotype information of the subject that identifies a fusion molecule described herein as being present in the subject); acquiring a sequence for a nucleic acid molecule identified herein (e.g., a nucleic acid molecule that includes a fusion sequence); or detecting the presence of a fusion nucleic acid or polypeptide described herein, in the subject), wherein the presence of the fusion identifies the patient or patient population as having an increased risk for, or having, a cancer associated with the fusion molecule.

In some embodiments, the method further includes treating the subject with a kinase inhibitor, e.g., a kinase inhibitor as described herein.

Reporting

Methods described herein can include providing a report, such as, in electronic, web-based, or paper form, to the patient or to another person or entity, e.g., a caregiver, e.g., a physician, e.g., an oncologist, a hospital, clinic, third-party payor, insurance company or government office. The report can include output from the method, e.g., the identification of nucleotide values, the indication of presence or absence of a fusion molecule described herein, or wildtype sequence. In one embodiment, a report is generated, such as in paper or electronic form, which identifies the presence or absence of an alteration described herein, and optionally includes an identifier for the patient from which the sequence was obtained.

The report can also include information on the role of a fusion molecule described herein, or wildtype sequence, in disease. Such information can include information on prognosis, resistance, or potential or suggested therapeutic options. The report can include information on the likely effectiveness of a therapeutic option, the acceptability of a therapeutic option, or the advisability of applying the therapeutic option to a patient, e.g., a patient having a sequence, alteration or mutation identified in the test, and in embodiments, identified in the report. For example, the report can include information, or a recommendation on, the administration of a drug, e.g., the administration at a preselected dosage or in a preselected treatment regimen, e.g., in combination with other drugs, to the patient. In an embodiment, not all mutations identified in the method are identified in the report. For example, the report can be limited to mutations in genes having a preselected level of correlation with the occurrence, prognosis, stage, or susceptibility of the cancer to treatment, e.g., with a preselected therapeutic option. The report can be delivered, e.g., to an entity described herein, within 7, 14, or 21 days from receipt of the sample by the entity practicing the method.

In another aspect, the invention features a method for generating a report, e.g., a personalized cancer treatment report, by obtaining a sample, e.g., a tumor sample, from a subject, detecting a fusion molecule described herein in the sample, and selecting a treatment based on the mutation identified. In one embodiment, a report is generated that annotates the selected treatment, or that lists, e.g., in order of preference, two or more treatment options based on the mutation identified. In another embodiment, the subject, e.g., a patient, is further administered the selected method of treatment.

Unless otherwise defined, all technical and scientific terms used herein have the same meaning as commonly understood by one of ordinary skill in the art to which this invention belongs. Although methods and materials similar or equivalent to those described herein can be used in the practice or testing the invention, suitable methods and materials are described below. All publications, patent applications, patents, and other references mentioned herein are incorporated by reference in their entirety. In case of conflict, the present specification, including definitions, will control. In addition, the materials, methods, and the example are illustrative only and not intended to be limiting.

The details of one or more embodiments featured in the invention are set forth in the accompanying drawings and the description below. Other features, objects, and advantages featured in the invention will be apparent from the description and drawings, and from the claims.

BRIEF DESCRIPTION OF DRAWINGS

FIGS. 1A-1H are tables summarizing the fusion molecules and the rearrangement events described herein.

FIG. 1A and FIG. 1B summarize the following: the name of the fusion (referred to as "fusion"); the tissue source (referred to as "disease"); the approximate locations of the first and second breakpoints that give rise to the rearrangement events (+50 nucleotides) (referred to as "Breakpoint 1" and "Breakpoint 2," respectively); and the type of rearrangement (referred to as "rearrangement").

FIG. 1C summarizes the following: the name of the fusion (referred to as "fusion"); the accession number of the full length sequences that contain the 5'- and the 3'-exon sequences (referred to as "5' Transcript ID" and "3' Transcript ID," respectively); and the identity of the last exon of the 5' transcript and the first exon of the 3' transcript. The sequences corresponding to the accession numbers provided in FIG. 1C are set forth in the figures appended herein. Alternatively, the sequences can be found by searching the RefSeq Gene as databased at UCSC Genome Browser (genome.ucsc.edu). For example, the following link can be used: http://genome.ucsc.edu/cgi-bin/hgc?hgsid=309144129&c=chr4&o=1795038&t=1810599&g=refGene&i=NM_000142 to search for Accession Number=NM_000142.

FIG. 1D, FIG. 1E, FIG. 1F, FIG. 1G, and FIG. 1H summarize the following: the name of the fusion; the SEQ ID NOs. of the nucleotide (Nt) and amino acid (Aa) sequences of the fusion (if shown), the 5' partner, and the 3' partner; and the figure in which the sequence is shown. For example, Nt and Aa sequences of the FGFR3-TACC3 fusion have SEQ ID NOs: 1 and 2, respectively, both of which are shown in FIG. 2. The Nt and Aa sequences of FGFR3 have SEQ ID NOs: 3 and 4, respectively, which are shown in FIGS. 3 and 4, respectively. The Nt and Aa sequences of TACC3 have SEQ ID NOs: 5 and 6, which are shown in FIGS. 5 and 6, respectively.

FIGS. 2A-2D depict the nucleotide (SEQ ID NO: 1) and amino acid (SEQ ID NO: 2) sequences of an FGFR3-TACC3 fusion. In this fusion, exon 17 of FGFR3 is fused to exon 8 of TACC3. The nucleotide and amino acid sequences of TACC3 are underlined.

FIGS. 3A-3B depict the nucleotide sequence of FGFR3 cDNA (NM_000142, SEQ ID NO: 3). The exon boundaries are shown in bold and underlined. The start of the first exon is shown by a single underline (e.g., shown as G). Further exons (second, third, fourth and so on) are indicated consecutively from 5' to 3' orientation by the underline of two consecutive nucleotides. For example, nucleotides GT at positions 154-155 correspond to the 3'-end of the first exon at position G, and the 5'-start of the second exon is at position T. The start codon is shown in bold and italics. The stop codon is shown in italics and underlined.

FIG. 4 depicts the amino acid sequence of FGFR3 (SEQ ID NO: 4).

FIGS. 5A-5B depict the nucleotide sequence of TACC3 cDNA (NM_006342, SEQ ID NO: 5). The exon boundaries are shown in bold and underlined. The start of the first exon is shown by a single underline. Further exons (second, third, fourth) are indicated consecutively from 5' to 3' orientation by the underline of two consecutive nucleotides (as exemplified in FIGS. 3A-3B above). The start codon is shown in bold and italics. The stop codon is shown in italics and underlined.

FIG. 6 depicts the amino acid sequence of TACC3 (SEQ ID NO: 6).

FIGS. 7A-7B depict the nucleotide sequence of TRIM24 cDNA (NM_003852, SEQ ID NO: 7). The exon boundaries are shown in bold and underlined. The start of the first exon is shown by a single underline. Further exons (second, third, fourth) are indicated consecutively from 5' to 3' orientation by the underline of two consecutive nucleotides (as exemplified in FIGS. 3A-3B above). The start codon is shown in bold and italics. The stop codon is shown in italics and underlined.

FIG. 8 depicts the amino acid sequence of TRIM24 (SEQ ID NO: 8).

FIGS. 9A-9B depict the nucleotide sequence of BRAF cDNA (NM_004333, SEQ ID NO: 9). The exon boundaries are shown in bold and underlined. The start of the first exon is shown by a single underline. Further exons (second, third, fourth) are indicated consecutively from 5' to 3' orientation by the underline of two consecutive nucleotides (as exemplified in FIGS. 3A-3B above). The start codon is shown in bold and italics. The stop codon is shown in italics and underlined.

FIG. 10 depicts the amino acid sequence of BRAF (SEQ ID NO: 10).

FIGS. 11A-11C depict the nucleotide sequence of CNTLN cDNA (NM_017738, SEQ ID NO: 11). The exon boundaries are shown in bold and underlined. The start of the first exon is shown by a single underline. Further exons (second, third, fourth) are indicated consecutively from 5' to 3' orientation by the underline of two consecutive nucleotides (as exemplified in FIGS. 3A-3B above). The start codon is shown in bold and italics. The stop codon is shown in italics and underlined.

FIG. 12 depicts the amino acid sequence of CNTLN (SEQ ID NO: 12).

FIGS. 13A-13B depict the nucleotide sequence of RAF1 cDNA (NM_002880, SEQ ID NO: 13). The exon boundaries are shown in bold and underlined. The start of the first exon is shown by a single underline. Further exons (second, third, fourth) are indicated consecutively from 5' to 3' orientation by the underline of two consecutive nucleotides (as exemplified in FIGS. 3A-3B above). The start codon is shown in bold and italics. The stop codon is shown in italics and underlined.

FIG. 14 depicts the amino acid sequence of RAF1 (SEQ ID NO: 14).

FIGS. 15A-15D depict the nucleotide sequence of TRIM33 cDNA (NM_015906, SEQ ID NO: 15). The exon boundaries are shown in bold and underlined. The start of the first exon is shown by a single underline. Further exons (second, third, fourth) are indicated consecutively from 5' to 3' orientation by the underline of two consecutive nucleotides (as exemplified in FIGS. 3A-3B above). The start codon is shown in bold and italics. The stop codon is shown in italics and underlined.

FIG. 16 depicts the amino acid sequence of TRIM33 (SEQ ID NO: 16).

FIGS. 17A-17B depict the nucleotide sequence of PDZRN3 cDNA (NM_015009, SEQ ID NO: 17). The exon boundaries are shown in bold and underlined. The start of the first exon is shown by a single underline. Further exons (second, third, fourth) are indicated consecutively from 5' to 3' orientation by the underline of two consecutive nucleotides (as exemplified in FIGS. 3A-3B above). The start codon is shown in bold and italics. The stop codon is shown in italics and underlined.

FIG. 18 depicts the amino acid sequence of PDZRN3 (SEQ ID NO: 18).

FIGS. 19A-19B depict the nucleotide sequence of LMNA cDNA (NM_170707, SEQ ID NO: 19). The exon boundaries are shown in bold and underlined. The start of the first exon is shown by a single underline. Further exons (second, third, fourth) are indicated consecutively from 5' to 3' orientation by the underline of two consecutive nucleotides (as exemplified in FIGS. 3A-3B above). The start codon is shown in bold and italics. The stop codon is shown in italics and underlined.

FIG. 20 depicts the amino acid sequence of LMNA (SEQ ID NO: 20).

FIGS. 21A-21B depict the nucleotide sequence of NTRK1 cDNA (NM_002529, SEQ ID NO: 21). The exon boundaries are shown in bold and underlined. The start of the first exon is shown by a single underline. Further exons (second, third, fourth) are indicated consecutively from 5' to 3' orientation by the underline of two consecutive nucleotides (as exemplified in FIGS. 3A-3B above). The start codon is shown in bold and italics. The stop codon is shown in italics and underlined.

FIG. 22 depicts the amino acid sequence of NTRK1 (SEQ ID NO: 22).

FIGS. 23A-23B depict the nucleotide sequence of RABGAP1L cDNA (NM_014857, SEQ ID NO: 23). The exon boundaries are shown in bold and underlined. The start of the first exon is shown by a single underline. Further exons (second, third, fourth) are indicated consecutively from 5' to 3' orientation by the underline of two consecutive nucleotides (as exemplified in FIGS. 3A-3B above). The start codon is shown in bold and italics. The stop codon is shown in italics and underlined.

FIG. 24 depicts the amino acid sequence of RABGAP1L (SEQ ID NO: 24).

FIGS. 25A-25E depict the nucleotide sequence of MPRIP cDNA (NM_015134, SEQ ID NO: 25). The exon boundaries are shown in bold and underlined. The start of the first exon is shown by a single underline. Further exons (second, third, fourth) are indicated consecutively from 5' to 3' orientation by the underline of two consecutive nucleotides (as exemplified in FIGS. 3A-3B above). The start codon is shown in bold and italics. The stop codon is shown in italics and underlined.

FIG. 26 depicts the amino acid sequence of MPRIP (SEQ ID NO: 26).

FIGS. 27A-27E depict the nucleotide sequence of ERBB4 cDNA (NM_005235, SEQ ID NO: 27). The exon boundaries are shown in bold and underlined. The start of the first exon is shown by a single underline. Further exons (second, third, fourth) are indicated consecutively from 5' to 3' orientation by the underline of two consecutive nucleotides (as exemplified in FIGS. 3A-3B above). The start codon is shown in bold and italics. The stop codon is shown in italics and underlined.

FIG. 28 depicts the amino acid sequence of ERBB4 (SEQ ID NO: 28).

FIGS. 29A-29B depict the nucleotide sequence of RET cDNA (NM_020630, SEQ ID NO: 29). The exon boundaries are shown in bold and underlined. The start of the first exon is shown by a single underline. Further exons (second, third, fourth) are indicated consecutively from 5' to 3' orientation by the underline of two consecutive nucleotides (as exemplified in FIGS. 3A-3B above). The start codon is shown in bold and italics. The stop codon is shown in italics and underlined.

FIG. 30 depicts the amino acid sequence of RET (SEQ ID NO: 30).

FIGS. 31A-31C depict the nucleotide sequence of FGFR1 cDNA (NM_015850, SEQ ID NO: 31). The exon boundaries are shown in bold and underlined. The start of the first exon is shown by a single underline. Further exons (second, third, fourth) are indicated consecutively from 5' to 3' orientation by the underline of two consecutive nucleotides (as exemplified in FIGS. 3A-3B above). The start codon is shown in bold and italics. The stop codon is shown in italics and underlined.

FIG. 32 depicts the amino acid sequence of FGFR1 (SEQ ID NO: 32).

FIGS. 33A-33B depict the nucleotide sequence of NTM cDNA (NM_016522, SEQ ID NO: 33). The exon boundaries are shown in bold and underlined. The start of the first exon is shown by a single underline. Further exons (second, third, fourth) are indicated consecutively from 5' to 3' orientation by the underline of two consecutive nucleotides (as exemplified in FIGS. 3A-3B above). The start codon is shown in bold and italics. The stop codon is shown in italics and underlined.

FIG. 34 depicts the amino acid sequence of NTM (SEQ ID NO: 34).

FIGS. 35A-35B depict the nucleotide sequence of TTC23 cDNA (NM_022905, SEQ ID NO: 35). The exon boundaries are shown in bold and underlined. The start of the first exon is shown by a single underline. Further exons (second, third, fourth) are indicated consecutively from 5' to 3' orientation by the underline of two consecutive nucleotides (as exemplified in FIGS. 3A-3B above). The start codon is shown in bold and italics. The stop codon is shown in italics and underlined.

FIG. 36 depicts the amino acid sequence of TTC23 (SEQ ID NO: 36).

FIGS. 37A-37E depict the nucleotide sequence of IGF1R cDNA (NM_000875, SEQ ID NO: 37). The exon boundaries are shown in bold and underlined. The start of the first exon is shown by a single underline. Further exons (second, third, fourth) are indicated consecutively from 5' to 3' orientation by the underline of two consecutive nucleotides (as exemplified in FIGS. 3A-3B above). The start codon is shown in bold and italics. The stop codon is shown in italics and underlined.

FIG. 38 depicts the amino acid sequence of IGF1R (SEQ ID NO: 38).

FIGS. 39A-39C depict the nucleotide sequence of DOT1L cDNA (NM_032482, SEQ ID NO: 39). The exon boundaries are shown in bold and underlined. The start of the first exon is shown by a single underline. Further exons (second, third, fourth) are indicated consecutively from 5' to 3' orientation by the underline of two consecutive nucleotides (as exemplified in FIGS. 3A-3B above). The start codon is shown in bold and italics. The stop codon is shown in italics and underlined.

FIG. 40 depicts the amino acid sequence of DOT1L (SEQ ID NO: 40).

FIGS. 41A-41D depict the nucleotide sequence of MYST3 (KAT6A) cDNA (NM_006766, SEQ ID NO: 41). The exon boundaries are shown in bold and underlined. The start of the first exon is shown by a single underline. Further exons (second, third, fourth) are indicated consecutively from 5' to 3' orientation by the underline of two consecutive nucleotides (as exemplified in FIGS. 3A-3B above). The start codon is shown in bold and italics. The stop codon is shown in italics and underlined.

FIG. 42 depicts the amino acid sequence of MYST3 (KAT6A) (SEQ ID NO: 42).

FIGS. 43A-43D depict the nucleotide sequence of SMAD4 cDNA (NM_005359, SEQ ID NO: 43). The exon boundaries are shown in bold and underlined. The start of the first exon is shown by a single underline. Further exons (second, third, fourth) are indicated consecutively from 5' to 3' orientation by the underline of two consecutive nucleotides (as exemplified in FIGS. 3A-3B above). The start codon is shown in bold and italics. The stop codon is shown in italics and underlined.

FIG. 44 depicts the amino acid sequence of SMAD4 (SEQ ID NO: 44).

FIGS. 45A-45D depict the nucleotide sequence of MYO5B cDNA (NM_001080467, SEQ ID NO: 45). The exon boundaries are shown in bold and underlined. The start of the first exon is shown by a single underline. Further exons (second, third, fourth) are indicated consecutively from 5' to 3' orientation by the underline of two consecutive nucleotides (as exemplified in FIGS. 3A-3B above). The start codon is shown in bold and italics. The stop codon is shown in italics and underlined.

FIG. 46 depicts the amino acid sequence of MYO5B (SEQ ID NO: 46).

FIGS. 47A-47C depict the nucleotide sequence of HMGXB3 cDNA (NM_014983, SEQ ID NO: 47). The exon boundaries are shown in bold and underlined. The start of the first exon is shown by a single underline. Further exons (second, third, fourth) are indicated consecutively from 5' to 3' orientation by the underline of two consecutive nucleotides (as exemplified in FIGS. 3A-3B above). The start codon is shown in bold and italics. The stop codon is shown in italics and underlined.

FIG. 48 depicts the amino acid sequence of HMGXB3 (SEQ ID NO: 48).

FIGS. 49A-49B depict the nucleotide sequence of FLT4 cDNA (NM_002020, SEQ ID NO: 49). The exon boundaries are shown in bold and underlined. The start of the first exon is shown by a single underline. Further exons (second, third, fourth) are indicated consecutively from 5' to 3' orientation by the underline of two consecutive nucleotides (as exemplified in FIGS. 3A-3B above). The start codon is shown in bold and italics. The stop codon is shown in italics and underlined.

FIG. 50 depicts the amino acid sequence of FLT4 (SEQ ID NO: 50).

FIGS. 51A-51G depict the nucleotide sequence of MLL cDNA (NM_005933, SEQ ID NO: 51). The exon boundaries are shown in bold and underlined. The start of the first exon is shown by a single underline. Further exons (second, third, fourth) are indicated consecutively from 5' to 3' orientation by the underline of two consecutive nucleotides (as exemplified in FIGS. 3A-3B above). The start codon is shown in bold and italics. The stop codon is shown in italics and underlined.

FIGS. 52A-52B depict the amino acid sequence of MLL (SEQ ID NO: 52).

FIGS. 53A-53C depict the nucleotide sequence of YAP1 cDNA (NM_006106, SEQ ID NO: 53). The exon boundaries are shown in bold and underlined. The start of the first exon is shown by a single underline. Further exons (second, third, fourth) are indicated consecutively from 5' to 3' orientation by the underline of two consecutive nucleotides (as exemplified in FIGS. 3A-3B above). The start codon is shown in bold and italics. The stop codon is shown in italics and underlined.

FIG. 54 depicts the amino acid sequence of YAP1 (SEQ ID NO: 54).

FIGS. 55A-55B depict the nucleotide sequence of TMPRSS2 cDNA (NM_001135099, SEQ ID NO: 55). The exon boundaries are shown in bold and underlined. The start of the first exon is shown by a single underline. Further exons (second, third, fourth) are indicated consecutively from 5' to 3' orientation by the underline of two consecutive nucleotides (as exemplified in FIGS. 3A-3B above). The start codon is shown in bold and italics. The stop codon is shown in italics and underlined.

FIG. 56 depicts the amino acid sequence of TMPRSS2 (SEQ ID NO: 56).

FIGS. 57A-57B depict the nucleotide sequence of MX1 cDNA (NM_001144925, SEQ ID NO: 57). The exon boundaries are shown in bold and underlined. The start of the first exon is shown by a single underline. Further exons (second, third, fourth) are indicated consecutively from 5' to 3' orientation by the underline of two consecutive nucleotides (as exemplified in FIGS. 3A-3B above). The start codon is shown in bold and italics. The stop codon is shown in italics and underlined.

FIG. 58 depicts the amino acid sequence of MX1 (SEQ ID NO: 58).

FIGS. 59A-59B depict the nucleotide sequence of MCFD2 cDNA (NM_001171508, SEQ ID NO: 59). The exon boundaries are shown in bold and underlined. The start of the first exon is shown by a single underline. Further exons (second, third, fourth) are indicated consecutively from 5' to 3' orientation by the underline of two consecutive nucleotides (as exemplified in FIGS. 3A-3B above). The start codon is shown in bold and italics. The stop codon is shown in italics and underlined.

FIG. 60 depicts the amino acid sequence of MCFD2 (SEQ ID NO: 60).

FIGS. 61A-61C depict the nucleotide sequence of ALK cDNA (NM_004304, SEQ ID NO: 61). The exon boundaries are shown in bold and underlined. The start of the first exon is shown by a single underline. Further exons (second, third, fourth) are indicated consecutively from 5' to 3' orientation by the underline of two consecutive nucleotides (as exemplified in FIGS. 3A-3B above). The start codon is shown in bold and italics. The stop codon is shown in italics and underlined.

FIG. 62 depicts the amino acid sequence of ALK (SEQ ID NO: 62).

FIGS. 63A-63B depict the nucleotide sequence of RANBP17 cDNA (NM_022897, SEQ ID NO: 63). T The exon boundaries are shown in bold and underlined. The start of the first exon is shown by a single underline. Further exons (second, third, fourth) are indicated consecutively from 5' to 3' orientation by the underline of two consecutive nucleotides (as exemplified in FIGS. 3A-3B above). The start codon is shown in bold and italics. The stop codon is shown in italics and underlined.

FIG. 64 depicts the amino acid sequence of RANBP17 (SEQ ID NO: 64).

FIGS. 65A-65C depict the nucleotide sequence of NUMA cDNA (NM_006185, SEQ ID NO: 65). The exon boundaries are shown in bold and underlined. The start of the first exon is shown by a single underline. Further exons (second, third, fourth) are indicated consecutively from 5' to 3' orientation by the underline of two consecutive nucleotides (as exemplified in FIGS. 3A-3B above). The start codon is shown in bold and italics. The stop codon is shown in italics and underlined.

FIG. 66 depicts the amino acid sequence of NUMA (SEQ ID NO: 66).

FIGS. 67A-67B depict the nucleotide (SEQ ID NO: 67) and amino acid (SEQ ID NO: 68) sequences of a TPM3-NTRK1 fusion. In this fusion, exon 7 of TPM3 is fused to exon 9 of NTRK1. The nucleotide and amino acid sequences of NTRK1 are underlined.

FIGS. 68A-68B depict the nucleotide sequence of TPM3 cDNA (NM_153649, SEQ ID NO: 69). The exon boundaries are shown in bold and underlined. For each boundary, the first underlined letter represents the nucleotide at the 3'-terminus of the upstream exon, and the second underlined letter represents the nucleotide at the 5'-terminus of the downstream exon. The start codon is shown in bold and italics. The stop codon is shown in italics and underlined.

FIG. 69 depicts the amino acid sequence of TPM3 (SEQ ID NO: 70).

FIGS. 70A-70C depict the nucleotide (SEQ ID NO: 71) and amino acid (SEQ ID NO: 72) sequences of an SNAPC4-NOTCH1 fusion. In this fusion, exon 1 of SNAPC4 is fused to exon 28 of NOTCH1. The nucleotide and amino acid sequences of NOTCH1 are underlined.

FIGS. 71A-71B depict the nucleotide sequence of SNAPC4 cDNA (NM_003086, SEQ ID NO: 73). The exon boundaries are shown in bold and underlined. For each boundary, the first underlined letter represents the nucleotide at the 3'-terminus of the upstream exon, and the second underlined letter represents the nucleotide at the 5'-terminus of the downstream exon. The start codon is shown in bold and italics. The stop codon is shown in italics and underlined.

FIG. 72 depicts the amino acid sequence of SNAPC4 (SEQ ID NO: 74).

FIGS. 73A-73D depict the nucleotide sequence of NOTCH1 cDNA (NM_017617, SEQ ID NO: 75). The exon boundaries are shown in bold and underlined. For each boundary, the first underlined letter represents the nucleotide at the 3'-terminus of the upstream exon, and the second underlined letter represents the nucleotide at the 5'-terminus of the downstream exon. The start codon is shown in bold and italics. The stop codon is shown in italics and underlined.

FIG. 74 depicts the amino acid sequence of NOTCH1 (SEQ ID NO: 76).

FIGS. 75A-75H depict the nucleotide (SEQ ID NO: 77) and amino acid (SEQ ID NO: 78) sequences of an TSC2-CREBBP fusion. In this fusion, exon 35 of TSC2 is fused to exon 24 of CREBBP. The nucleotide and amino acid sequences of CREBBP are underlined.

FIGS. 76A-76C depict the nucleotide sequence of TSC2 cDNA (NM_001077183, SEQ ID NO: 79). The exon boundaries are shown in bold and underlined. For each boundary, the first underlined letter represents the nucleotide at the 3'-terminus of the upstream exon, and the second underlined letter represents the nucleotide at the 5'-terminus of the downstream exon. The start codon is shown in bold and italics. The stop codon is shown in italics and underlined.

FIG. 77 depicts the amino acid sequence of TSC2 (SEQ ID NO: 80).

FIGS. 78A-78E depict the nucleotide sequence of CREBBP cDNA (NM_004380, SEQ ID NO: 81). The exon boundaries are shown in bold and underlined. For each boundary, the first underlined letter represents the nucleotide at the 3'-terminus of the upstream exon, and the second underlined letter represents the nucleotide at the 5'-terminus of the downstream exon. The start codon is shown in bold and italics. The stop codon is shown in italics and underlined.

FIG. 79 depicts the amino acid sequence of CREBBP (SEQ ID NO: 82).

FIGS. 80A-80K depict the nucleotide (SEQ ID NO: 83) and amino acid (SEQ ID NO: 84) sequences of an C5orf42-ERBB4 fusion. In this fusion, exon 40 of C5orf42 is fused to exon 11 of ERBB4. The nucleotide and amino acid sequences of ERBB4 are underlined.

FIGS. 81A-81E depict the nucleotide sequence of C5orf42 cDNA (NM_023073, SEQ ID NO: 85). The exon boundaries are shown in bold and underlined. For each boundary, the first underlined letter represents the nucleotide at the 3'-terminus of the upstream exon, and the second underlined letter represents the nucleotide at the 5'-terminus of the downstream exon. The start codon is shown in bold and italics. The stop codon is shown in italics and underlined.

FIGS. 82A-82B depict the amino acid sequence of C5orf42 (SEQ ID NO: 86).

FIGS. 83A-83C depict the nucleotide (SEQ ID NO: 87) and amino acid (SEQ ID NO: 88) sequences of a USP2-CBL fusion. In this fusion, exon 2 of USP2 is fused to exon 8 of CBL. The nucleotide and amino acid sequences of CBL are underlined.

FIGS. 84A-84B depict the nucleotide sequence of USP2 cDNA (NM_004205, SEQ ID NO: 89). The exon boundaries are shown in bold and underlined. For each boundary, the first underlined letter represents the nucleotide at the 3'-terminus of the upstream exon, and the second underlined letter represents the nucleotide at the 5'-terminus of the downstream exon. The start codon is shown in bold and italics. The stop codon is shown in italics and underlined.

FIG. 85 depicts the amino acid sequence of USP2 (SEQ ID NO: 90).

FIGS. 86A-86E depict the nucleotide sequence of CBL cDNA (NM_005188, SEQ ID NO: 91). The exon boundaries are shown in bold and underlined. For each boundary, the first underlined letter represents the nucleotide at the 3'-terminus of the upstream exon, and the second underlined letter represents the nucleotide at the 5'-terminus of the downstream exon. The start codon is shown in bold and italics. The stop codon is shown in italics and underlined.

FIG. 87 depicts the amino acid sequence of CBL (SEQ ID NO: 92).

FIG. 88A, FIG. 88B, and FIG. 88C depict the nucleotide (SEQ ID NO: 93) and amino acid (SEQ ID NO: 94) sequences of an STK32B-ALK fusion. In this fusion, exon 11 of STK32B is fused to exon 20 of ALK. The nucleotide and amino acid sequences of ALK are underlined. In FIG. 88D, FIG. 88E, and FIG. 88F, exon 11 of STK32B is fused to exon 21 of ALK (SEQ ID NO: 127 and 128, respectively).

FIGS. 89A-89B depict the nucleotide sequence of STK32B cDNA (NM_018401, SEQ ID NO: 95). The exon boundaries are shown in bold and underlined. For each boundary, the first underlined letter represents the nucleotide at the 3'-terminus of the upstream exon, and the second underlined letter represents the nucleotide at the 5'-terminus of the downstream exon. The start codon is shown in bold and italics. The stop codon is shown in italics and underlined.

FIG. 90 depicts the amino acid sequence of STK32B (SEQ ID NO: 96).

FIGS. 91A-91C depict the nucleotide (SEQ ID NO: 97) and amino acid (SEQ ID NO: 98) sequences of an FGFR2-TACC3 fusion. In this fusion, exon 16 of FGFR2 is fused to exon 11 of TACC3. The nucleotide and amino acid sequences of TACC3 are underlined.

FIGS. 92A-92B depict the nucleotide sequence of FGFR2 cDNA (NM_001144915, SEQ ID NO: 99). The exon boundaries are shown in bold and underlined. For each boundary, the first underlined letter represents the nucleotide at the 3'-terminus of the upstream exon, and the second underlined letter represents the nucleotide at the 5'-terminus of the downstream exon. The start codon is shown in bold and italics. The stop codon is shown in italics and underlined.

FIG. 93 depicts the amino acid sequence of FGFR2 (SEQ ID NO: 100).

FIGS. 94A-94D depict the nucleotide (SEQ ID NO: 101) and amino acid (SEQ ID NO: 102) sequences of an FGFR2-KIAA1598 fusion. In this fusion, exon 16 of FGFR2 is fused to exon 7 of KIAA1598. The nucleotide and amino acid sequences of KIAA1598 are underlined.

FIGS. 95A-95B depict the nucleotide sequence of KIAA1598 cDNA (NM_001127211, SEQ ID NO: 103). The exon boundaries are shown in bold and underlined. For each boundary, the first underlined letter represents the nucleotide at the 3'-terminus of the upstream exon, and the second underlined letter represents the nucleotide at the 5'-terminus of the downstream exon. The start codon is shown in bold and italics. The stop codon is shown in italics and underlined.

FIG. 96 depicts the amino acid sequence of KIAA1598 (SEQ ID NO: 104).

FIG. 97 depicts the nucleotide (SEQ ID NO: 105) and amino acid (SEQ ID NO: 106) sequences of a BICC1-FGFR2 fusion. In this fusion, exon 2 of BICC1 is fused to exon 17 of FGFR2. The nucleotide and amino acid sequences of FGFR2 are underlined.

FIGS. 98A-98B depict the nucleotide sequence of BICC1 cDNA (NM_001080512, SEQ ID NO: 107). The exon boundaries are shown in bold and underlined. For each boundary, the first underlined letter represents the nucleotide at the 3'-terminus of the upstream exon, and the second underlined letter represents the nucleotide at the 5'-terminus of the downstream exon. The start codon is shown in bold and italics. The stop codon is shown in italics and underlined.

FIG. 99 depicts the amino acid sequence of BICC1 (SEQ ID NO: 108).

FIG. 100 depict the nucleotide (SEQ ID NO: 109) and amino acid (SEQ ID NO: 110) sequences of an FGFR3-JAKMIP1 fusion. In this fusion, exon 17 of FGFR3 is fused to exon 4 of JAKMIP1. The nucleotide and amino acid sequences of JAKMIP1 are underlined. For FGFR3-JAKMIP1, the breakpoint of FGFR3 is right on exon 18 coding region. In one embodiment, a partial exon18 is skipped, the fusion transcript includes "FGFR3 (exon 1-17)-JAKMIP1 (exon 4-21)." The in-frame sequence reads: FGFR3 end with "TSTD" and JAKMIP1 start with "MDEI".

FIGS. 101A-101B depict the nucleotide sequence of JAKMIP1 cDNA (NM_000142, SEQ ID NO: 111). The exon boundaries are shown in bold and underlined. For each boundary, the first underlined letter represents the nucleotide at the 3'-terminus of the upstream exon, and the second underlined letter represents the nucleotide at the 5'-terminus of the downstream exon. The start codon is shown in bold and italics. The stop codon is shown in italics and underlined.

FIG. 102 depicts the amino acid sequence of JAKMIP1 (SEQ ID NO: 112).

FIGS. 103A-103G depict the nucleotide (SEQ ID NO: 113) and amino acid (SEQ ID NO: 114) sequences of an MASP2-MTOR fusion. In this fusion, exon 3 of MASP2 is fused to exon 9 of MTOR. The nucleotide and amino acid sequences of MTOR are underlined.

FIG. 104 depicts the nucleotide sequence of MASP2 cDNA (NM_006610, SEQ ID NO: 115). The exon boundaries are shown in bold and underlined. For each boundary, the first underlined letter represents the nucleotide at the 3'-terminus of the upstream exon, and the second underlined letter represents the nucleotide at the 5'-terminus of the downstream exon. The start codon is shown in bold and italics. The stop codon is shown in italics and underlined.

FIG. 105 depicts the amino acid sequence of MASP2 (SEQ ID NO: 116).

FIGS. 106A-106D depict the nucleotide sequence of MTOR cDNA (NM_004958, SEQ ID NO: 117). The exon boundaries are shown in bold and underlined. For each boundary, the first underlined letter represents the nucleotide at the 3'-terminus of the upstream exon, and the second underlined letter represents the nucleotide at the 5'-terminus of the downstream exon. The start codon is shown in bold and italics. The stop codon is shown in italics and underlined.

FIG. 107 depicts the amino acid sequence of MTOR (SEQ ID NO: 118).

FIGS. 108A-108C depict the nucleotide (SEQ ID NO: 119) and amino acid (SEQ ID NO: 120) sequences of an FGFR2-BICC1 fusion. In this fusion, exon 16 of FGFR2 is fused to exon 18 of BICC1. The nucleotide and amino acid sequences of BICC1 are underlined.

FIGS. 109A-109C depict the nucleotide (SEQ ID NO: 121) and amino acid (SEQ ID NO: 122) sequences of a CD74-ROS1 fusion. In this fusion, exon 6 of CD74 is fused to exon 33 of ROS1. The nucleotide and amino acid sequences of ROS1 are underlined.

FIG. 110 depicts the nucleotide sequence of CD74 cDNA (NM_004355, SEQ ID NO: 123). The exon boundaries are shown in bold and underlined. For each boundary, the first underlined letter represents the nucleotide at the 3'-terminus of the upstream exon, and the second underlined letter represents the nucleotide at the 5'-terminus of the downstream exon. The start codon is shown in bold and italics. The stop codon is shown in italics and underlined.

FIG. 111 depicts the amino acid sequence of CD74 (SEQ ID NO: 124).

FIGS. 112A-112C depict the nucleotide sequence of ROS1 cDNA (NM_002944, SEQ ID NO: 125). The exon boundaries are shown in bold and underlined. For each boundary, the first underlined letter represents the nucleotide at the 3'-terminus of the upstream exon, and the second underlined letter represents the nucleotide at the 5'-terminus of the downstream exon. The start codon is shown in bold and italics. The stop codon is shown in italics and underlined.

FIG. 113 depicts the amino acid sequence of ROS1 (SEQ ID NO: 126).

DETAILED DESCRIPTION

The invention is based, at least in part, on the discovery of novel fusion events, and their association with cancer.

Certain terms are first defined. Additional terms are defined throughout the specification.

As used herein, the articles "a" and "an" refer to one or to more than one (e.g., to at least one) of the grammatical object of the article.

The term "or" is used herein to mean, and is used interchangeably with, the term "and/or", unless context clearly indicates otherwise.

"About" and "approximately" shall generally mean an acceptable degree of error for the quantity measured given the nature or precision of the measurements. Exemplary degrees of error are within 20 percent (%), typically, within 10%, and more typically, within 5% of a given value or range of values.

"Acquire" or "acquiring" as the terms are used herein, refer to obtaining possession of a physical entity, or a value, e.g., a numerical value, by "directly acquiring" or "indirectly acquiring" the physical entity or value. "Directly acquiring" means performing a process (e.g., performing a synthetic or analytical method) to obtain the physical entity or value. "Indirectly acquiring" refers to receiving the physical entity or value from another party or source (e.g., a third party laboratory that directly acquired the physical entity or value). Directly acquiring a physical entity includes performing a process that includes a physical change in a physical substance, e.g., a starting material. Exemplary changes include making a physical entity from two or more starting materials, shearing or fragmenting a substance, separating or purifying a substance, combining two or more separate entities into a mixture, performing a chemical reaction that includes breaking or forming a covalent or non-covalent bond. Directly acquiring a value includes performing a process that includes a physical change in a sample or another substance, e.g., performing an analytical process which includes a physical change in a substance, e.g., a sample, analyte, or reagent (sometimes referred to herein as "physical analysis"), performing an analytical method, e.g., a method which includes one or more of the following: separating or purifying a substance, e.g., an analyte, or a fragment or other derivative thereof, from another substance; combining an analyte, or fragment or other derivative thereof, with another substance, e.g., a buffer, solvent, or reactant; or changing the structure of an analyte, or a fragment or other derivative thereof, e.g., by breaking or forming a covalent or non-covalent bond, between a first and a second atom of the analyte; or by changing the structure of a reagent, or a fragment or other derivative thereof, e.g., by breaking or forming a covalent or non-covalent bond, between a first and a second atom of the reagent.

"Acquiring a sequence" as the term is used herein, refers to obtaining possession of a nucleotide sequence or amino acid sequence, by "directly acquiring" or "indirectly acquiring" the sequence. "Directly acquiring a sequence" means performing a process (e.g., performing a synthetic or analytical method) to obtain the sequence, such as performing a sequencing method (e.g., a Next Generation Sequencing (NGS) method). "Indirectly acquiring a sequence" refers to receiving information or knowledge of, or receiving, the sequence from another party or source (e.g., a third party laboratory that directly acquired the sequence). The sequence acquired need not be a full sequence, e.g., sequencing of at least one nucleotide, or obtaining information or knowledge, that identifies a fusion molecule disclosed herein as being present in a subject constitutes acquiring a sequence.

Directly acquiring a sequence includes performing a process that includes a physical change in a physical substance, e.g., a starting material, such as a tissue sample, e.g., a biopsy, or an isolated nucleic acid (e.g., DNA or RNA) sample. Exemplary changes include making a physical entity from two or more starting materials, shearing or fragmenting a substance, such as a genomic DNA fragment; separating or purifying a substance (e.g., isolating a nucleic acid sample from a tissue); combining two or more separate entities into a mixture, performing a chemical reaction that includes breaking or forming a covalent or non-covalent bond. Directly acquiring a value includes performing a process that includes a physical change in a sample or another substance as described above.

"Acquiring a sample" as the term is used herein, refers to obtaining possession of a sample, e.g., a tissue sample or nucleic acid sample, by "directly acquiring" or "indirectly acquiring" the sample. "Directly acquiring a sample" means performing a process (e.g., performing a physical method such as a surgery or extraction) to obtain the sample. "Indirectly acquiring a sample" refers to receiving the sample from another party or source (e.g., a third party laboratory that directly acquired the sample). Directly acquiring a sample includes performing a process that includes a physical change in a physical substance, e.g., a starting material, such as a tissue, e.g., a tissue in a human patient or a tissue that has was previously isolated from a patient. Exemplary changes include making a physical entity from a starting material, dissecting or scraping a tissue; separating or purifying a substance (e.g., a sample tissue or a nucleic acid sample); combining two or more separate entities into a mixture; performing a chemical reaction that includes breaking or forming a covalent or non-covalent bond. Directly acquiring a sample includes performing a process that includes a physical change in a sample or another substance, e.g., as described above.

"Binding entity" means any molecule to which molecular tags can be directly or indirectly attached that is capable of specifically binding to an analyte. The binding entity can be an affinity tag on a nucleic acid sequence. In certain embodiments, the binding entity allows for separation of the nucleic acid from a mixture, such as an avidin molecule, or an antibody that binds to the hapten or an antigen-binding fragment thereof. Exemplary binding entities include, but are not limited to, a biotin molecule, a hapten, an antibody, an antibody binding fragment, a peptide, and a protein.

"Complementary" refers to sequence complementarity between regions of two nucleic acid strands or between two regions of the same nucleic acid strand. It is known that an adenine residue of a first nucleic acid region is capable of forming specific hydrogen bonds ("base pairing") with a residue of a second nucleic acid region which is antiparallel to the first-region if the residue is thymine or uracil. Similarly, it is known that a cytosine residue of a first nucleic acid strand is capable of base pairing with a residue of a second nucleic acid strand which is antiparallel to the first strand if the residue is guanine. A first region of a nucleic acid is complementary to a second region of the same or a different nucleic acid if, when the two regions are arranged in an antiparallel fashion, at least one nucleotide residue of the first region is capable of base pairing with a residue of the second region. In certain embodiments, the first region comprises a first portion and the second region comprises a second portion, whereby, when the first and second portions are arranged in an antiparallel fashion, at least about 50%, at least about 75%, at least about 90%, or at least about 95% of the nucleotide residues of the first portion are capable of base pairing with nucleotide residues in the second portion. In other embodiments, all nucleotide residues of the first portion are capable of base pairing with nucleotide residues in the second portion.

The term "cancer" or "tumor" is used interchangeably herein. These terms refer to the presence of cells possessing characteristics typical of cancer-causing cells, such as uncontrolled proliferation, immortality, metastatic potential, rapid growth and proliferation rate, and certain characteristic morphological features. Cancer cells are often in the form of a tumor, but such cells can exist alone within an animal, or can be a non-tumorigenic cancer cell, such as a leukemia cell. These terms include a solid tumor, a soft tissue tumor, or a metastatic lesion. As used herein, the term "cancer" includes premalignant, as well as malignant cancers. In certain embodiments, the cancer is a solid tumor, a soft tissue tumor, or a metastatic lesion.

The term "neoplasm" or "neoplastic" cell refers to an abnormal proliferative stage, e.g., a hyperproliferative stage, in a cell or tissue that can include a benign, pre-malignant, malignant (cancer) or metastatic stage.

Cancer is "inhibited" if at least one symptom of the cancer is alleviated, terminated, slowed, or prevented. As used herein, cancer is also "inhibited" if recurrence or metastasis of the cancer is reduced, slowed, delayed, or prevented.

"Chemotherapeutic agent" means a chemical substance, such as a cytotoxic or cytostatic agent, that is used to treat a condition, particularly cancer.

As used herein, "cancer therapy" and "cancer treatment" are synonymous terms.

As used herein, "chemotherapy" and "chemotherapeutic" and "chemotherapeutic agent" are synonymous terms.

The terms "homology" or "identity," as used interchangeably herein, refer to sequence similarity between two polynucleotide sequences or between two polypeptide sequences, with identity being a more strict comparison. The phrases "percent identity or homology" and "% identity or homology" refer to the percentage of sequence similarity found in a comparison of two or more polynucleotide sequences or two or more polypeptide sequences. "Sequence similarity" refers to the percent similarity in base pair sequence (as determined by any suitable method) between two or more polynucleotide sequences. Two or more sequences can be anywhere from 0-100% similar, or any integer value there between. Identity or similarity can be determined by comparing a position in each sequence that can be aligned for purposes of comparison. When a position in the compared sequence is occupied by the same nucleotide base or amino acid, then the molecules are identical at that position. A degree of similarity or identity between polynucleotide sequences is a function of the number of identical or matching nucleotides at positions shared by the polynucleotide sequences. A degree of identity of polypeptide sequences is a function of the number of identical amino acids at positions shared by the polypeptide sequences. A degree of homology or similarity of polypeptide sequences is a function of the number of amino acids at positions shared by the polypeptide sequences. The term "substantially identical," as used herein, refers to an identity or homology of at least 75%, at least 80%, at least 85%, at least 90%, 91%, 92%, 93%, 94%, 95%, 96%, 97%, 98%, 99%, or more.

"Likely to" or "increased likelihood," as used herein, refers to an increased probability that an item, object, thing or person will occur. Thus, in one example, a subject that is likely to respond to treatment with a kinase inhibitor, alone or in combination, has an increased probability of responding to treatment with the inhibitor alone or in combination, relative to a reference subject or group of subjects.

"Unlikely to" refers to a decreased probability that an event, item, object, thing or person will occur with respect to a reference. Thus, a subject that is unlikely to respond to treatment with a kinase inhibitor, alone or in combination, has a decreased probability of responding to treatment with a kinase inhibitor, alone or in combination, relative to a reference subject or group of subjects.

"Sequencing" a nucleic acid molecule requires determining the identity of at least 1 nucleotide in the molecule. In embodiments, the identity of less than all of the nucleotides in a molecule are determined. In other embodiments, the identity of a majority or all of the nucleotides in the molecule is determined.

"Next-generation sequencing or NGS or NG sequencing" as used herein, refers to any sequencing method that determines the nucleotide sequence of either individual nucleic acid molecules (e.g., in single molecule sequencing) or clonally expanded proxies for individual nucleic acid molecules in a highly parallel fashion (e.g., greater than $10^5$ molecules are sequenced simultaneously). In one embodiment, the relative abundance of the nucleic acid species in the library can be estimated by counting the relative number of occurrences of their cognate sequences in the data generated by the sequencing experiment. Next generation sequencing methods are known in the art, and are described, e.g., in Metzker, M. (2010) Nature Biotechnology Reviews 11:31-46, incorporated herein by reference. Next generation sequencing can detect a variant present in less than 5% of the nucleic acids in a sample.

"Sample," "tissue sample," "patient sample," "patient cell or tissue sample" or "specimen" each refers to a collection of similar cells obtained from a tissue of a subject or patient. The source of the tissue sample can be solid tissue as from a fresh, frozen and/or preserved organ, tissue sample, biopsy, or aspirate; blood or any blood constituents; bodily fluids such as cerebral spinal fluid, amniotic fluid, peritoneal fluid or interstitial fluid; or cells from any time in gestation or development of the subject. The tissue sample can contain compounds that are not naturally intermixed with the tissue in nature such as preservatives, anticoagulants, buffers, fixatives, nutrients, antibiotics or the like. In one embodiment, the sample is preserved as a frozen sample or as formaldehyde- or paraformaldehyde-fixed paraffin-embedded (FFPE) tissue preparation. For example, the sample can be embedded in a matrix, e.g., an FFPE block or a frozen sample.

A "tumor nucleic acid sample" as used herein, refers to nucleic acid molecules from a tumor or cancer sample. Typically, it is DNA, e.g., genomic DNA, or cDNA derived from RNA, from a tumor or cancer sample. In certain embodiments, the tumor nucleic acid sample is purified or isolated (e.g., it is removed from its natural state).

A "control" or "reference" "nucleic acid sample" as used herein, refers to nucleic acid molecules from a control or reference sample. Typically, it is DNA, e.g., genomic DNA, or cDNA derived from RNA, not containing the alteration or variation in the gene or gene product, e.g., not containing a fusion molecule described herein. In certain embodiments, the reference or control nucleic acid sample is a wild type or a non-mutated sequence. In certain embodiments, the reference nucleic acid sample is purified or isolated (e.g., it is removed from its natural state). In other embodiments, the reference nucleic acid sample is from a non-tumor sample, e.g., a blood control, a normal adjacent tumor (NAT), or any other non-cancerous sample from the same or a different subject.

"Adjacent to the interrogation position," as used herein, means that a site sufficiently close such that a detection reagent complementary with the site can be used to distinguish between a mutation, e.g., a mutation described herein, and a reference sequence, e.g., a non-mutant or wild-type sequence, in a target nucleic acid. Directly adjacent, as used herein, is where 2 nucleotides have no intervening nucleotides between them.

"Associated mutation," as used herein, refers to a mutation within a preselected distance, in terms of nucleotide or primary amino acid sequence, from a definitional mutation, e.g., a mutant as described herein, e.g., a translocation, breakpoint or fusion molecule described herein. In embodiments, the associated mutation is within n, wherein n is 2, 5, 10, 20, 30, 50, 100, or 200 nucleotides from the definitional mutation (n does not include the nucleotides defining the associated and definitional mutations). In embodiments, the associated mutation is a translocation mutation.

"Interrogation position," as used herein, comprises at least one nucleotide (or, in the case of polypeptides, an amino acid residue) which corresponds to a nucleotide (or amino acid residue) that is mutated in a mutation, including, e.g., in the case of a rearrangement, one or both of the nucleotides (or amino acid residues) flanking the breakpoint, or other residue which can be used to distinguish the mutation, of interest, e.g., a mutation being identified, or in a nucleic acid (or protein) being analyzed, e.g., sequenced, or recovered. By way of example, the interrogation position in the breakpoint shown in FIG. 1A, 1B, 1C, 1D, 1E, 1F, 1G, or 1H, includes one, two, or more nucleotide positions at the junction site.

A "reference sequence," as used herein, e.g., as a comparator for a mutant sequence, is a sequence which has a different nucleotide or amino acid at an interrogation position than does the mutant(s) being analyzed. In an embodiment, the reference sequence is wild-type for at least the interrogation position.

Headings, e.g., (a), (b), (i) etc, are presented merely for ease of reading the specification and claims. The use of headings in the specification or claims does not require the steps or elements be performed in alphabetical or numerical order or the order in which they are presented.

Various aspects featured in the invention are described in further detail below. Additional definitions are set out throughout the specification.

Isolated Nucleic Acid Molecules

One aspect featured in the invention pertains to isolated nucleic acid molecules that include a fusion molecule described herein, including nucleic acids which encode fusion fusion polypeptide or a portion of such a polypeptide. The nucleic acid molecules include those nucleic acid molecules which reside in genomic regions identified herein. As used herein, the term "nucleic acid molecule" includes DNA molecules (e.g., cDNA or genomic DNA) and RNA molecules (e.g., mRNA) and analogs of the DNA or RNA generated using nucleotide analogs. The nucleic acid molecule can be single-stranded or double-stranded; in certain embodiments the nucleic acid molecule is double-stranded DNA.

Isolated nucleic acid molecules also include nucleic acid molecules sufficient for use as hybridization probes or primers to identify nucleic acid molecules that correspond to a fusion molecule described herein, e.g., those suitable for use as PCR primers for the amplification or mutation of nucleic acid molecules.

An "isolated" nucleic acid molecule is one which is separated from other nucleic acid molecules which are present in the natural source of the nucleic acid molecule. In certain embodiments, an "isolated" nucleic acid molecule is free of sequences (such as protein-encoding sequences) which naturally flank the nucleic acid (i.e., sequences located at the 5' and 3' ends of the nucleic acid) in the genomic DNA of the organism from which the nucleic acid is derived. For example, in various embodiments, the isolated nucleic acid molecule can contain less than about 5 kB, less than about 4 kB, less than about 3 kB, less than about 2 kB, less than about 1 kB, less than about 0.5 kB or less than about 0.1 kB of nucleotide sequences which naturally flank the nucleic acid molecule in genomic DNA of the cell from which the nucleic acid is derived. Moreover, an "isolated" nucleic acid molecule, such as a cDNA molecule, can be substantially free of other cellular material or culture medium when produced by recombinant techniques, or substantially free of chemical precursors or other chemicals when chemically synthesized.

The language "substantially free of other cellular material or culture medium" includes preparations of nucleic acid molecule in which the molecule is separated from cellular components of the cells from which it is isolated or recombinantly produced. Thus, nucleic acid molecule that is substantially free of cellular material includes preparations of nucleic acid molecule having less than about 30%, less than about 20%, less than about 10%, or less than about 5% (by dry weight) of other cellular material or culture medium.

A fusion nucleic acid molecule can be isolated using standard molecular biology techniques and the sequence information in the database records described herein. Using all or a portion of such nucleic acid sequences, fusion nucleic acid molecules as described herein can be isolated using standard hybridization and cloning techniques (e.g., as described in Sambrook et al., ed., *Molecular Cloning: A Laboratory Manual,* 2nd ed., Cold Spring Harbor Laboratory Press, Cold Spring Harbor, N.Y., 1989).

A fusion nucleic acid molecule (e.g., fusion molecule described herein) can be amplified using cDNA, mRNA, or genomic DNA as a template and appropriate oligonucleotide primers according to standard PCR amplification techniques. The nucleic acid molecules so amplified can be cloned into an appropriate vector and characterized by DNA sequence analysis. Furthermore, oligonucleotides corresponding to all or a portion of a nucleic acid molecule featured in the invention can be prepared by standard synthetic techniques, e.g., using an automated DNA synthesizer.

In another embodiment, a fusion nucleic acid molecule (e.g., fusion molecule described herein) comprises a nucleic acid molecule which has a nucleotide sequence complementary to the nucleotide sequence of the fusion nucleic acid molecule or to the nucleotide sequence of a nucleic acid encoding a fusion protein. A nucleic acid molecule which is complementary to a given nucleotide sequence is one which is sufficiently complementary to the given nucleotide sequence that it can hybridize to the given nucleotide sequence thereby forming a stable duplex.

Moreover, a fusion nucleic acid molecule can comprise only a portion of a nucleic acid sequence, wherein the full length nucleic acid sequence or which encodes a fusion polypeptide. Such nucleic acid molecules can be used, for example, as a probe or primer. The probe/primer typically is used as one or more substantially purified oligonucleotides. The oligonucleotide typically comprises a region of nucleotide sequence that hybridizes under stringent conditions to at least about 7, at least about 15, at least about 25, at least about 50, at least about 75, at least about 100, at least about 125, at least about 150, at least about 175, at least about 200, at least about 250, at least about 300, at least about 350, at least about 400, at least about 500, at least about 600, at least about 700, at least about 800, at least about 900, at least about 1 kb, at least about 2 kb, at least about 3 kb, at least about 4 kb, at least about 5 kb, at least about 6 kb, at least about 7 kb, at least about 8 kb, at least about 9 kb, at least about 10 kb, at least about 15 kb, at least about 20 kb, at least about 25 kb, at least about 30 kb, at least about 35 kb, at least about 40 kb, at least about 45 kb, at least about 50 kb, at least about 60 kb, at least about 70 kb, at least about 80 kb, at least about 90 kb, at least about 100 kb, at least about 200 kb, at least about 300 kb, at least about 400 kb, at least about 500 kb, at least about 600 kb, at least about 700 kb, at least about 800 kb, at least about 900 kb, at least about 1 mb, at least about 2 mb, at least about 3 mb, at least about 4 mb, at least about 5 mb, at least about 6 mb, at least about 7 mb, at least about 8 mb, at least about 9 mb, at least about 10 mb or more consecutive nucleotides of a fusion nucleic acid described herein.

The invention further encompasses nucleic acid molecules that are substantially identical to the gene mutations and/or gene products described herein, such that they are at least 70%, at least 75%, at least 80%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5% or greater. The invention further encompasses nucleic acid molecules that are substantially identical to the gene mutations and/or gene products described herein, such that they are at least 70%, at least 75%, at least 80%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5% or greater.

In other embodiments, the invention further encompasses nucleic acid molecules that are substantially homologous to fusion gene mutations and/or gene products described herein, such that they differ by only or at least 1, at least 2, at least 3, at least 4, at least 5, at least 6, at least 7, at least 8, at least 9, at least 10, at least 11, at least 12, at least 13, at least 14, at least 15, at least 16, at least 17, at least 18, at least 19, at least 20, at least 30, at least 40, at least 50, at least 60, at least 70, at least 80, at least 90, at least 100, at least 200, at least 300, at least 400, at least 500, at least 600 nucleotides or any range in between.

In another embodiment, an isolated fusion nucleic acid molecule described herein is at least 7, at least 15, at least 20, at least 25, at least 30, at least 35, at least 40, at least 45, at least 50, at least 55, at least 60, at least 65, at least 70, at least 75, at least 80, at least 85, at least 90, at least 95, at least 100, at least 125, at least 150, at least 175, at least 200, at least 250, at least 300, at least 350, at least 400, at least 450, at least 550, at least 650, at least 700, at least 800, at least 900, at least 1000, at least 1200, at least 1400, at least 1600, at least 1800, at least 2000, at least 2200, at least 2400, at least 2600, at least 2800, at least 3000, or more nucleotides in length and hybridizes under stringent conditions to a fusion nucleic acid molecule or to a nucleic acid molecule encoding a protein corresponding to a marker featured in the invention.

As used herein, the term "hybridizes under stringent conditions" is intended to describe conditions for hybridization and washing under which nucleotide sequences at least 60%, at least 65%, at least 70%, at least 75%, at least 80%, or at least 85% identical to each other typically remain hybridized to each other. Such stringent conditions are known to those skilled in the art and can be found in sections 6.3.1-6.3.6 of *Current Protocols in Molecular Biology*, John Wiley & Sons, N.Y. (1989). Another, non-limiting example of stringent hybridization conditions are hybridization in 6× sodium chloride/sodium citrate (SSC) at about 45° C., followed by one or more washes in 0.2×SSC, 0.1% SDS at 50-65° C.

The invention also includes molecular beacon nucleic acid molecules having at least one region which is complementary to a fusion nucleic acid molecule described herein, such that the molecular beacon is useful for quantitating the presence of the nucleic acid molecule featured in the invention in a sample. A "molecular beacon" nucleic acid is a nucleic acid molecule comprising a pair of complementary regions and having a fluorophore and a fluorescent quencher associated therewith. The fluorophore and quencher are associated with different portions of the nucleic acid in such an orientation that when the complementary regions are annealed with one another, fluorescence of the fluorophore is quenched by the quencher. When the complementary regions of the nucleic acid molecules are not annealed with one another, fluorescence of the fluorophore is quenched to a lesser degree. Molecular beacon nucleic acid molecules are described, for example, in U.S. Pat. No. 5,876,930.

Probes

The invention also provides isolated nucleic acid molecules useful as probes. Such nucleic acid probes can be designed based on the sequence of a fusion molecule described herein.

Probes based on the sequence of a fusion nucleic acid molecule as described herein can be used to detect transcripts or genomic sequences corresponding to one or more markers featured in the invention. The probe comprises a label group attached thereto, e.g., a radioisotope, a fluorescent compound, an enzyme, or an enzyme co-factor. Such probes can be used as part of a test kit for identifying cells or tissues which express the fusion protein (e.g., a fusion described herein), such as by measuring levels of a nucleic acid molecule encoding the protein in a sample of cells from a subject, e.g., detecting mRNA levels or determining whether a gene encoding the protein has been mutated or deleted.

Probes featured in the invention include those that will specifically hybridize to a gene sequence described in the Examples, e.g., fusion molecule described herein. Typically these probes are 12 to 20, e.g., 17 to 20 nucleotides in length (longer for large insertions) and have the nucleotide sequence corresponding to the region of the mutations at their respective nucleotide locations on the gene sequence. Such molecules can be labeled according to any technique known in the art, such as with radiolabels, fluorescent labels, enzymatic labels, sequence tags, biotin, other ligands, etc. As used herein, a probe that "specifically hybridizes" to a fusion gene sequence will hybridize under high stringency conditions.

A probe will typically contain one or more of the specific mutations described herein. Typically, a nucleic acid probe will encompass only one mutation. Such molecules may be labeled and can be used as allele-specific probes to detect the mutation of interest.

In one aspect, the invention features a probe or probe set that specifically hybridizes to a nucleic acid comprising an inversion resulting in a fusion molecule described herein. In another aspect, the invention features a probe or probe set that specifically hybridizes to a nucleic acid comprising a deletions resulting in a fusion molecule described herein.

Isolated pairs of allele specific oligonucleotide probes are also provided, where the first probe of the pair specifically hybridizes to the mutant allele, and the second probe of the pair specifically hybridizes to the wildtype allele. For example, in one exemplary probe pair, one probe will recognize the fusion junction in the FGFR3-TACC3 fusion, and the other probe will recognize a sequence downstream or upstream of TACC3 or FGFR3, neither of which includes the fusion junction. These allele-specific probes are useful in detecting an FGFR3 somatic mutation in a tumor sample, e.g., lung adenocarcinoma sample. In a similar manner, probe pairs can be designed and produced for any of the fusion molecule described herein, and are useful in detecting an somatic mutation in a tumor sample.

Primers

The invention also provides isolated nucleic acid molecules useful as primers.

The term "primer" as used herein refers to a sequence comprising two or more deoxyribonucleotides or ribonucleotides, e.g., more than three, and more than eight, or at least 20 nucleotides of a gene described in the Example, where the sequence corresponds to a sequence flanking one of the mutations or a wild type sequence of a gene identified in the Example, e.g., any gene described herein involved in a fusion described herein. Primers may be used to initiate DNA synthesis via the PCR (polymerase chain reaction) or a sequencing method. Primers featured in the invention include the sequences recited and complementary sequences which would anneal to the opposite DNA strand of the sample target. Since both strands of DNA are complementary and mirror images of each other, the same segment of DNA will be amplified.

Primers can be used to sequence a nucleic acid, e.g., an isolated nucleic acid described herein, such as by an NGS method, or to amplify a gene described in the Example, such as by PCR. The primers can specifically hybridize, for example, to the ends of the exons or to the introns flanking the exons. The amplified segment can then be further analyzed for the presence of the mutation such as by a sequencing method. The primers are useful in directing amplification of a target polynucleotide prior to sequencing. In another aspect, the invention features a pair of oligonucleotide primers that amplify a region that contains or is adjacent to a fusion junction identified in the Example. Such primers are useful in directing amplification of a target region that includes a fusion junction identified in the Example, e.g., prior to sequencing. The primer typically contains 12 to 20, or 17 to 20, or more nucleotides, although a primer may contain fewer nucleotides.

A primer is typically single stranded, e.g., for use in sequencing or amplification methods, but may be double stranded. If double stranded, the primer may first be treated to separate its strands before being used to prepare extension products. A primer must be sufficiently long to prime the synthesis of extension products in the presence of the inducing agent for polymerization. The exact length of primer will depend on many factors, including applications (e.g., amplification method), temperature, buffer, and nucleotide composition. A primer typically contains 12-20 or more nucleotides, although a primer may contain fewer nucleotides.

Primers are typically designed to be "substantially" complementary to each strand of a genomic locus to be amplified. Thus, the primers must be sufficiently complementary to specifically hybridize with their respective strands under conditions which allow the agent for polymerization to perform. In other words, the primers should have sufficient complementarity with the 5' and 3' sequences flanking the mutation to hybridize therewith and permit amplification of the genomic locus.

The term "substantially complementary to" or "substantially the sequence" refers to sequences that hybridize to the sequences provided under stringent conditions and/or sequences having sufficient homology with a sequence comprising a fusion junction identified in the Example, or the wildtype counterpart sequence, such that the allele specific oligonucleotides hybridize to the sequence. In one embodiment, a sequence is substantially complementary to a fusion junction in an inversion event, e.g., to a fusion junction in any fusion molecule described herein. "Substantially the same" as it refers to oligonucleotide sequences also refers to the functional ability to hybridize or anneal with sufficient specificity to distinguish between the presence or absence of the mutation. This is measurable by the temperature of melting being sufficiently different to permit easy identification of whether the oligonucleotide is binding to the normal or mutant gene sequence identified in the Example.

In one aspect, the invention features a primer or primer set for amplifying a nucleic acid comprising an inversion resulting in a fusion described herein. In another aspect, the invention features a primer or primer set for amplifying a nucleic acid comprising a deletion resulting in fusion described herein.

Isolated pairs of allele specific oligonucleotide primer are also provided, where the first primer of the pair specifically hybridizes to the mutant allele, and the second primer of the pair specifically hybridizes to a sequence upstream or downstream of a mutation, or a fusion junction resulting from, e.g., an inversion, duplication, deletion, insertion or translocation. In one exemplary primer pair, one probe will recognize a FGFR3-TACC3 fusion, such as by hybridizing to a sequence at the fusion junction between the FGFR3 and TACC3 transcripts, and the other primer will recognize a sequence upstream or downstream of the fusion junction. These allele-specific primers are useful for amplifying a FGFR3-TACC3 fusion sequence from a tumor sample, e.g., a biopsy, e.g., a biopsy from a suspected lung cancer, e.g., lung adenocarcinoma.

In another exemplary primer pair, one primer can recognize an FGFR3-TACC3 translocation (e.g., the reciprocal of the FGFR3-TACC3 translocation), such as by hybridizing to a sequence at the fusion junction between the FGFR3 and TACC3 transcripts, and the other primer will recognize a sequence upstream or downstream of the fusion junction. These allele-specific primers are useful for amplifying a FGFR3-TACC3 fusion sequence from a tumor sample, e.g., a lung cancer sample or biopsy or lung biopsy sample.

Primers can be prepared using any suitable method, such as conventional phosphotriester and phosphodiester methods or automated embodiments thereof. In one such automated embodiment, diethylphosphoramidites are used as starting materials and may be synthesized as described by Beaucage, et al., Tetrahedron Letters, 22:1859-1862, (1981). One method for synthesizing oligonucleotides on a modified solid support is described in U.S. Pat. No. 4,458,066.

An oligonucleotide probe or primer that hybridizes to a mutant or wildtype allele is said to be the complement of the allele. As used herein, a probe exhibits "complete complementarity" when every nucleotide of the probe is complementary to the corresponding nucleotide of the allele. Two polynucleotides are said to be "minimally complementary" if they can hybridize to one another with sufficient stability to permit them to remain annealed to one another under at least conventional "low-stringency" conditions. Similarly, the polynucleotides are said to be "complementary" if they can hybridize to one another with sufficient stability to permit them to remain annealed to one another under conventional "high-stringency" conditions. Conventional stringency conditions are known to those skilled in the art and can be found, for example in *Molecular Cloning: A Laboratory Manual,* 3rd edition Volumes 1, 2, and 3. J. F. Sambrook, D. W. Russell, and N. Irwin, Cold Spring Harbor Laboratory Press, 2000.

Departures from complete complementarity are therefore permissible, as long as such departures do not completely preclude the capacity of a probe to hybridize to an allele. Thus, in order for a polynucleotide to serve as a primer or probe it need only be sufficiently complementary in sequence to be able to form a stable double-stranded structure under the particular solvent and salt concentrations employed. Appropriate stringency conditions which promote DNA hybridization are, for example, 6.0× sodium chloride/sodium citrate (SSC) at about 45° C., followed by a wash of 2.0×SSC at 50° C. Such conditions are known to those skilled in the art and can be found, for example in *Current Protocols in Molecular Biology,* John Wiley & Sons, N.Y. (1989). Salt concentration and temperature in the wash step can be adjusted to alter hybridization stringency. For example, conditions may vary from low stringency of about 2.0×SSC at 40° C. to moderately stringent conditions of about 2.0×SSC at 50° C. to high stringency conditions of about 0.2×SSC at 50° C.

Fusion Proteins and Antibodies

One aspect featured in the invention pertains to purified fusion polypeptides, and biologically active portions thereof. The fusion polypeptide can be any fusion molecule described herein. In one embodiment, the native fusion polypeptide can be isolated from cells or tissue sources by an appropriate purification scheme using standard protein purification techniques. In another embodiment, a fusion polypeptide is produced by recombinant DNA techniques. Alternative to recombinant expression, a fusion polypeptide described herein can be synthesized chemically using standard peptide synthesis techniques.

An "isolated" or "purified" protein or biologically active portion thereof is substantially free of cellular material or other contaminating proteins from the cell or tissue source from which the protein is derived, or substantially free of chemical precursors or other chemicals when chemically synthesized. The language "substantially free of cellular material" includes preparations of protein in which the protein is separated from cellular components of the cells from which it is isolated or recombinantly produced. Thus, protein that is substantially free of cellular material includes preparations of protein having less than about 30%, less than about 20%, less than about 10%, or less than about 5% (by dry weight) of heterologous protein (also referred to herein as a "contaminating protein"). When the protein or biologically active portion thereof is recombinantly produced, it can be substantially free of culture medium, i.e., culture medium represents less than about 20%, less than about 10%, or less than about 5% of the volume of the protein preparation. When the protein is produced by chemical synthesis, it can substantially be free of chemical precursors or other chemicals, i.e., it is separated from chemical precursors or other chemicals which are involved in the synthesis of the protein. Accordingly such preparations of the protein have less than about 30%, less than about 20%, less than about 10%, less than about 5% (by dry weight) of chemical precursors or compounds other than the polypeptide of interest.

Biologically active portions of a fusion polypeptide include polypeptides comprising amino acid sequences sufficiently identical to or derived from the amino acid sequence of the fusion protein, which include fewer amino acids than the full length protein, and exhibit at least one activity of the corresponding full-length protein, e.g., a kinase activity e.g., an FGFR3 kinase activity. A biologically active portion of a protein featured in the invention can be a polypeptide which is, for example, 10, 25, 50, 100 or more amino acids in length. Moreover, other biologically active portions, in which other regions of the protein are deleted, can be prepared by recombinant techniques and evaluated for one or more of the functional activities of the native form of a polypeptide.

In certain embodiments, the fusion polypeptide decribed herein has an amino acid sequence of a protein encoded by a nucleic acid molecule disclosed herein. Other useful proteins are substantially identical (e.g., at least 60, at least 65, at least 70, at least 75, at least 80, at least 85, at least 86, at least 87, at least 88, at least 89, at least 90, at least 91, at least 92, at least 93, at least 94, at least 95, at least 96, at least 97, at least 98, at least 99, at least 99.5% or greater) to one of these sequences and retain the functional activity of the protein of the corresponding full-length protein yet differ in amino acid sequence.

To determine the percent identity of two amino acid sequences or of two nucleic acids, the sequences are aligned for optimal comparison purposes (e.g., gaps can be introduced in the sequence of a first amino acid or nucleic acid sequence for optimal alignment with a second amino or nucleic acid sequence). The amino acid residues or nucleotides at corresponding amino acid positions or nucleotide positions are then compared. When a position in the first sequence is occupied by the same amino acid residue or nucleotide as the corresponding position in the second sequence, then the molecules are identical at that position.

The percent identity between the two sequences is a function of the number of identical positions shared by the sequences (i.e., % identity=# of identical positions/total # of positions (e.g., overlapping positions)×100). In one embodiment the two sequences are the same length.

The determination of percent identity between two sequences can be accomplished using a mathematical algorithm. Another, non-limiting example of a mathematical algorithm utilized for the comparison of two sequences is the algorithm of Karlin and Altschul (1990) *Proc. Natl. Acad. Sci. USA* 87:2264-2268, modified as in Karlin and Altschul (1993) *Proc. Natl. Acad. Sci. USA* 90:5873-5877. Such an algorithm is incorporated into the NBLAST and XBLAST programs of Altschul, et al. (1990) *J. Mol. Biol.* 215:403-410. BLAST nucleotide searches can be performed with the NBLAST program, score=100, wordlength=12 to obtain nucleotide sequences homologous to a nucleic acid molecules featured in the invention. BLAST protein searches can be performed with the XBLAST program, score=50, word length=3 to obtain amino acid sequences homologous to protein molecules featured in the invention. To obtain gapped alignments for comparison purposes, Gapped BLAST can be utilized as described in Altschul et al. (1997) *Nucleic Acids Res.* 25:3389-3402. Alternatively, PSI-Blast can be used to perform an iterated search which detects distant relationships between molecules. When utilizing BLAST, Gapped BLAST, and PSI-Blast programs, the default parameters of the respective programs (e.g., XBLAST and NBLAST) can be used. See http://www.ncbi.nlm.nih.gov. Another non-limiting example of a mathematical algorithm utilized for the comparison of sequences is the algorithm of Myers and Miller, (1988) *Comput Appl Biosci*, 4:11-7. Such an algorithm is incorporated into the ALIGN program (version 2.0) which is part of the GCG sequence alignment software package. When utilizing the ALIGN program for comparing amino acid sequences, a PAM120 weight residue table, a gap length penalty of 12, and a gap penalty of 4 can be used. Yet another useful algorithm for identifying regions of local sequence similarity and alignment is the FASTA algorithm as described in Pearson and Lipman (1988) *Proc. Natl. Acad. Sci. USA* 85:2'11'-2448. When using the FASTA algorithm for comparing nucleotide or amino acid sequences, a PAM120 weight residue table can, for example, be used with a k-tuple value of 2.

The percent identity between two sequences can be determined using techniques similar to those described above, with or without allowing gaps. In calculating percent identity, only exact matches are counted.

An isolated fusion polypeptide (e.g., a fusion described herein), or a fragment thereof, can be used as an immunogen to generate antibodies using standard techniques for polyclonal and monoclonal antibody preparation. The full-length fusion polypeptide can be used or, alternatively, the invention provides antigenic peptide fragments for use as immunogens. The antigenic peptide of a protein featured in the invention comprises at least 8 (or at least 10, at least 15, at least 20, or at least 30 or more) amino acid residues of the amino acid sequence of one of the polypeptides featured in the invention, and encompasses an epitope of the protein such that an antibody raised against the peptide forms a specific immune complex with a marker featured in the invention to which the protein corresponds. Exemplary epitopes encompassed by the antigenic peptide are regions that are located on the surface of the protein, e.g., hydrophilic regions. Hydrophobicity sequence analysis, hydrophilicity sequence analysis, or similar analyses can be used to identify hydrophilic regions.

An immunogen typically is used to prepare antibodies by immunizing a suitable (i.e., immunocompetent) subject such as a rabbit, goat, mouse, or other mammal or vertebrate. An appropriate immunogenic preparation can contain, for example, recombinantly-expressed or chemically-synthesized polypeptide. The preparation can further include an adjuvant, such as Freund's complete or incomplete adjuvant, or a similar immunostimulatory agent.

Accordingly, another aspect featured in the invention pertains to antibodies directed against a fusion polypeptide described herein. In one embodiment, the antibody molecule specifically binds to fusion molecule described herein, e.g., specifically binds to an epitope formed by the fusion. In embodiments the antibody can distinguish wild type genes that make up the fusion, from the fusion of the genes, e.g., the antibody can distinguish wild type genes, e.g., FGFR3 (or TACC3) from FGFR3-TACC3.

The terms "antibody" and "antibody molecule" as used interchangeably herein refer to immunoglobulin molecules and immunologically active portions of immunoglobulin molecules, i.e., molecules that contain an antigen binding site which specifically binds an antigen, such as a polypeptide featured in the invention. A molecule which specifically binds to a given polypeptide featured in the invention is a molecule which binds the polypeptide, but does not substantially bind other molecules in a sample, e.g., a biological sample, which naturally contains the polypeptide. Examples of immunologically active portions of immunoglobulin molecules include F(ab) and F(ab')2 fragments which can be generated by treating the antibody with an enzyme such as pepsin. The invention provides polyclonal and monoclonal antibodies. The term "monoclonal antibody" or "monoclonal antibody composition," as used herein, refers to a population of antibody molecules that contain only one species of an antigen binding site capable of immunoreacting with a particular epitope.

Polyclonal antibodies can be prepared as described above by immunizing a suitable subject with a fusion polypeptide as an immunogen. Antibody-producing cells can be obtained from the subject and used to prepare monoclonal antibodies by standard techniques, such as the hybridoma technique originally described by Kohler and Milstein (1975) *Nature* 256:495-497, the human B cell hybridoma technique (see Kozbor et al., 1983, *Immunol. Today* 4:72), the EBV-hybridoma technique (see Cole et al., pp. 77-96 In *Monoclonal Antibodies and Cancer Therapy*, Alan R. Liss, Inc., 1985) or trioma techniques. The technology for producing hybridomas is well known (see generally *Current Protocols in Immunology*, Coligan et al. ed., John Wiley & Sons, New York, 1994). Hybridoma cells producing a monoclonal antibody are detected by screening the hybridoma culture supernatants for antibodies that bind the polypeptide of interest, e.g., using a standard ELISA assay.

Alternative to preparing monoclonal antibody-secreting hybridomas, a monoclonal antibody can be identified and isolated by screening a recombinant combinatorial immunoglobulin library (e.g., an antibody phage display library) with the polypeptide of interest. Kits for generating and screening phage display libraries are commercially available (e.g., the Pharmacia *Recombinant Phage Antibody System*, Catalog No. 27-9400-01; and the Stratagene *SudZAP Phage Display Kit*, Catalog No. 240612). Additionally, examples of methods and reagents particularly amenable for use in generating and screening antibody display library can be found in, for example, U.S. Pat. No. 5,223,409; PCT Publication No. WO 92/18619; PCT Publication No. WO 91/17271; PCT Publication No. WO 92/20791; PCT Publication No. WO 92/15679; PCT Publication No. WO 93/01288; PCT Publication No. WO 92/01047; PCT Publication No. WO 92/09690; PCT Publication No. WO 90/02809; Fuchs et al. (1991) *Bio/Technology* 9:1370-1372; Hay et al. (1992) *Hum. Antibod. Hybridomas* 3:81-85; Huse et al. (1989) *Science* 246:1275-1281; Griffiths et al. (1993) *EMBO J.* 12:725-734.

Additionally, recombinant antibodies, such as chimeric and humanized monoclonal antibodies, comprising both human and non-human portions can be made using standard recombinant DNA techniques. Such chimeric and humanized monoclonal antibodies can be produced by recombinant DNA techniques known in the art, for example using methods described in PCT Publication No. WO 87/02671; European Patent Application 184,187; European Patent Application 171,496; European Patent Application 173,494; PCT Publication No. WO 86/01533; U.S. Pat. No. 4,816,567; European Patent Application 125,023; Better et al. (1988) *Science* 240:1041-1043; Liu et al. (1987) *Proc. Natl. Acad. Sci. USA* 84:3439-3443; Liu et al. (1987) *J. Immunol.* 139:3521-3526; Sun et al. (1987) *Proc. Natl. Acad. Sci. USA* 84:214-218; Nishimura et al. (1987) *Cancer Res.* 47:999-1005; Wood et al. (1985) *Nature* 314:446-449; and Shaw et al. (1988) *J. Natl. Cancer Inst.* 80:1553-1559; Morrison (1985) *Science* 229:1202-1207; Oi et al. (1986) *Bio/Techniques* 4:214; U.S. Pat. No. 5,225,539; Jones et al. (1986) *Nature* 321:552-525; Verhoeyan et al. (1988) *Science* 239: 1534; and Beidler et al. (1988) *J. Immunol.* 141:4053-4060.

Completely human antibodies can be produced using transgenic mice which are incapable of expressing endogenous immunoglobulin heavy and light chains genes, but which can express human heavy and light chain genes. For an overview of this technology for producing human antibodies, see Lonberg and Huszar (1995) *Int. Rev. Immunol.* 13:65-93). For a detailed discussion of this technology for producing human antibodies and human monoclonal antibodies and protocols for producing such antibodies, see, e.g., U.S. Pat. Nos. 5,625,126; 5,633,425; 5,569,825; 5,661, 016; and 5,545,806. In addition, companies such as Abgenix, Inc. (Freemont, Calif.), can be engaged to provide human antibodies directed against a selected antigen using technology similar to that described above.

An antibody directed against a fusion polypeptide described herein (e.g., a monoclonal antibody) can be used to isolate the polypeptide by standard techniques, such as affinity chromatography or immunoprecipitation. Moreover, such an antibody can be used to detect the marker (e.g., in a cellular lysate or cell supernatant) in order to evaluate the level and pattern of expression of the marker. Detection can be facilitated by coupling the antibody to a detectable substance. Examples of detectable substances include, but are not limited to, various enzymes, prosthetic groups, fluorescent materials, luminescent materials, bioluminescent materials, and radioactive materials. Examples of suitable enzymes include, but are not limited to, horseradish peroxidase, alkaline phosphatase, β-galactosidase, or acetylcholinesterase; examples of suitable prosthetic group complexes include, but are not limited to, streptavidin/biotin and avidin/biotin; examples of suitable fluorescent materials include, but are not limited to, umbelliferone, fluorescein, fluorescein isothiocyanate, rhodamine, dichlorotriazinylamine fluorescein, dansyl chloride or phycoerythrin; an example of a luminescent material includes, but is not limited to, luminol; examples of bioluminescent materials include, but are not limited to, luciferase, luciferin, and aequorin, and examples of suitable radioactive materials include, but are not limited to, $^{125}I$, $^{131}I$, $^{35}S$ or $^3H$.

An antibody directed against a fusion polypeptide described herein, can also be used diagnostically to monitor protein levels in tissues or body fluids (e.g., in a tumor cell-containing body fluid) as part of a clinical testing procedure, e.g., to, for example, determine the efficacy of a given treatment regimen.

Antigens and Vaccines

Embodiments featured in the invention include preparations, e.g., antigenic preparations, of the entire fusion or a fragment thereof, e.g., a fragment capable of raising antibodies specific to the fusion protein, e.g., a fusion junction containing fragment (collectively referred to herein as a "fusion-specific polypeptides" or FSP). The preparation can include an adjuvant or other component.

An FSP can be used as an antigen or vaccine. For example, an FSP can be used as an antigen to immunize an animal, e.g., a rodent, e.g., a mouse or rat, rabbit, horse, goat, dog, or non-human primate, to obtain antibodies, e.g., fusion protein specific antibodies. In an embodiment a fusion specific antibody molecule is an antibody molecule described herein, e.g., a polyclonal. In other embodiments a fusion specific antibody molecule is monospecific, e.g., monoclonal, human, humanized, chimeric or other monospecific antibody molecule. An anti-fusion protein specific antibody molecule can be used to treat a subject having a cancer, e.g., a cancer described herein.

Embodiments featured include vaccine preparations that comprise an FSP capable of stimulating an immune response in a subject, e.g., by raising, in the subject, antibodies specific to the fusion protein. The vaccine preparation can include other components, e.g., an adjuvant. The vaccine preparations can be used to treat a subject having cancer, e.g., a cancer described herein.

Rearrangement Based Cancer Vaccines

Embodiments featured in the invention include preparations of a fusion polypeptide described herein. The fusion polypeptide can be derived from, but is not limited to, any fusion molecule described herein.

A fusion junction polypeptide can be used as an antigen or vaccine, for the treatment of a disease, e.g., a cancer, e.g., a cancer described herein. For example, antigen presenting cells (APCs) derived from a patient with a disease, e.g., cancer, e.g., a cancer described herein; can be incubated with a fusion junction polypeptide, wherein the disease from which the patient's APCs are derived is known, has been determined, or is suspected of expressing the fusion molecule from which the fusion junction polypeptide is derived. In certain embodiments, the APCs are also incubated with one or more cytokines. In certain embodiments, the cytokine induces maturation of the APCs. In certain embodiments, the cytokine is one or more of GMCSF, TNF-alpha, IL-4, IL-2, IL-6, IL-7, IL-13, IL-15, HGF. In certain embodiments, the cytokine is GMCSF. The APCs are incubated with the fusion polypeptide under conditions which allow the APCs to uptake or endocytose the fusion polypeptide, and process the polypeptide for presentation on a cell surface molecule, e.g., major histocompatibility class MHC class I molecules. The cell culture conditions are known to one of skill in the art. The APCs can then be infused back into the same patient from whom the cells were derived.

In certain embodiments the APCs are purified prior to incubation with a fusion polypeptide. In certain embodiments, the APCs are dendritic cells. In certain embodiments, the APCs include one or more of dendritic cells, macrophages, and B cells. In certain embodiments, the APCs are incubated with one, two, three, four, or more fusion polypeptides.

In certain embodiments, the disclosure includes preparations of or a vaccine preparation of mature APCs which have been incubated with a fusion polypeptide decribed herein.

In certain embodiments, the method includes determining or acquiring a determination of whether a patient expresses a fusion molecule described herein. In certain embodiments, the method includes selecting a fusion polypeptide based on the determination of whether a patient expresses a fusion molecule described herein. In some embodiments, the method further comprises the incubation of APCs derived from the patient with the selected fusion polypeptide. In some embodiments, the method further comprises the infusion of the APCs back into the patient from which they were derived.

Expression Vectors, Host Cells and Recombinant Cells

In another aspect, the invention includes vectors (e.g., expression vectors), containing a nucleic acid encoding a fusion polypeptide described herein. As used herein, the term "vector" refers to a nucleic acid molecule capable of transporting another nucleic acid to which it has been linked and can include a plasmid, cosmid or viral vector. The vector can be capable of autonomous replication or it can integrate into a host DNA. Viral vectors include, e.g., replication defective retroviruses, adenoviruses and adeno-associated viruses.

A vector can include a fusion nucleic acid in a form suitable for expression of the nucleic acid in a host cell. Preferably the recombinant expression vector includes one or more regulatory sequences operatively linked to the nucleic acid sequence to be expressed. The term "regulatory sequence" includes promoters, enhancers and other expression control elements (e.g., polyadenylation signals). Regulatory sequences include those which direct constitutive expression of a nucleotide sequence, as well as tissue-specific regulatory and/or inducible sequences. The design of the expression vector can depend on such factors as the choice of the host cell to be transformed, the level of expression of protein desired, and the like. The expression vectors can be introduced into host cells to thereby produce a fusion polypeptide, including fusion proteins or polypeptides encoded by nucleic acids as described herein, mutant forms thereof, and the like).

The term "recombinant host cell" (or simply "host cell" or "recombinant cell"), as used herein, is intended to refer to a cell into which a recombinant expression vector has been introduced. It should be understood that such terms are intended to refer not only to the particular subject cell, but to the progeny of such a cell. Because certain modifications may occur in succeeding generations due to either mutation or environmental influences, such progeny may not, in fact, be identical to the parent cell, but are still included within the scope of the term "host cell" as used herein.

The recombinant expression vectors can be designed for expression of a fusion polypeptide (e.g., a fusion described herein) in prokaryotic or eukaryotic cells. For example, polypeptides featured in the invention can be expressed in *E. coli*, insect cells (e.g., using baculovirus expression vectors), yeast cells or mammalian cells. Suitable host cells are discussed further in Goeddel, (1990) *Gene Expression Technology: Methods in Enzymology* 185, Academic Press, San Diego, Calif. Alternatively, the recombinant expression vector can be transcribed and translated in vitro, for example using T7 promoter regulatory sequences and T7 polymerase.

Expression of proteins in prokaryotes is most often carried out in *E. coli* with vectors containing constitutive or inducible promoters directing the expression of either fusion or non-fusion proteins. Fusion vectors add a number of amino acids to a protein encoded therein, usually to the amino terminus of the recombinant protein. Such fusion vectors typically serve three purposes: 1) to increase expression of recombinant protein; 2) to increase the solubility of the recombinant protein; and 3) to aid in the purification of the recombinant protein by acting as a ligand in affinity purification. Often, a proteolytic cleavage site is introduced at the junction of the fusion moiety and the recombinant protein to enable separation of the recombinant protein from the fusion moiety subsequent to purification of the fusion protein. Such enzymes, and their cognate recognition sequences, include Factor Xa, thrombin and enterokinase. Typical fusion expression vectors include pGEX (Pharmacia Biotech Inc; Smith, D. B. and Johnson, K. S. (1988) *Gene* 67:31-40), pMAL (New England Biolabs, Beverly, Mass.) and pRIT5 (Pharmacia, Piscataway, N.J.) which fuse glutathione S-transferase (GST), maltose E binding protein, or protein A, respectively, to the target recombinant protein.

Purified fusion polypeptides described herein can be used in activity assays (e.g., direct assays or competitive assays described in detail below), or to generate antibodies specific for fusion polypeptides described herein.

To maximize recombinant protein expression in *E. coli* is to express the protein in a host bacteria with an impaired capacity to proteolytically cleave the recombinant protein (Gottesman, S., (1990) *Gene Expression Technology: Methods in Enzymology* 185, Academic Press, San Diego, Calif. 119-128). Another strategy is to alter the nucleic acid sequence of the nucleic acid to be inserted into an expression vector so that the individual codons for each amino acid are those preferentially utilized in *E. coli* (Wada et al., (1992) *Nucleic Acids Res.* 20:2111-2118). Such alteration of nucleic acid sequences can be carried out by standard DNA synthesis techniques.

The fusion polypeptide expression vector can be a yeast expression vector, a vector for expression in insect cells, e.g., a baculovirus expression vector or a vector suitable for expression in mammalian cells.

When used in mammalian cells, the expression vector's control functions can be provided by viral regulatory elements. For example, commonly used promoters are derived from polyoma, Adenovirus 2, cytomegalovirus and Simian Virus 40.

In another embodiment, the promoter is an inducible promoter, e.g., a promoter regulated by a steroid hormone, by a polypeptide hormone (e.g., by means of a signal transduction pathway), or by a heterologous polypeptide (e.g., the tetracycline-inducible systems, "Tet-On" and "Tet-Off"; see, e.g., Clontech Inc., CA, Gossen and Bujard (1992) *Proc. Natl. Acad. Sci. USA* 89:5547, and Paillard (1989) *Human Gene Therapy* 9:983).

In another embodiment, the recombinant mammalian expression vector is capable of directing expression of the nucleic acid preferentially in a particular cell type (e.g., tissue-specific regulatory elements are used to express the nucleic acid). Non-limiting examples of suitable tissue-specific promoters include the albumin promoter (liver-specific; Pinkert et al. (1987) *Genes Dev.* 1:268-277), lymphoid-specific promoters (Calame and Eaton (1988) *Adv. Immunol.* 43:235-275), in particular promoters of T cell receptors (Winoto and Baltimore (1989) *EMBO J.* 8:729-733) and immunoglobulins (Banerji et al. (1983) *Cell* 33:729-740; Queen and Baltimore (1983) *Cell* 33:741-748), neuron-specific promoters (e.g., the neurofilament promoter; Byrne and Ruddle (1989) *Proc. Nall. Acad. Sci. USA* 86:5473-5477), pancreas-specific promoters (Edlund et al. (1985) *Science* 230:912-916), and mammary gland-specific promoters (e.g., milk whey promoter; U.S. Pat. No. 4,873,316 and European Application Publication No. 264,166). Developmentally-regulated promoters are also encompassed, for example, the murine hox promoters (Kessel and Gruss (1990) *Science* 249:374-379) and the □-fetoprotein promoter (Campes and Tilghman (1989) *Genes Dev.* 3:537-546).

The invention further provides a recombinant expression vector comprising a DNA molecule featured in the invention cloned into the expression vector in an antisense orientation. Regulatory sequences (e.g., viral promoters and/or enhancers) operatively linked to a nucleic acid cloned in the antisense orientation can be chosen which direct the constitutive, tissue specific or cell type specific expression of antisense RNA in a variety of cell types. The antisense expression vector can be in the form of a recombinant plasmid, phagemid or attenuated virus.

Another aspect the invention provides a host cell which includes a nucleic acid molecule described herein, e.g., a fusion nucleic acid molecule described herein within a recombinant expression vector or a fusion nucleic acid molecule described herein containing sequences which allow it to homologous recombination into a specific site of the host cell's genome.

A host cell can be any prokaryotic or eukaryotic cell. For example, a fusion polypeptide can be expressed in bacterial cells (such as *E. coli*), insect cells, yeast or mammalian cells (such as Chinese hamster ovary cells (CHO) or COS cells, e.g., COS-7 cells, CV-1 origin SV40 cells; Gluzman (1981) *Cell* 23:175-182). Other suitable host cells are known to those skilled in the art.

Vector DNA can be introduced into host cells via conventional transformation or transfection techniques. As used herein, the terms "transformation" and "transfection" are intended to refer to a variety of art-recognized techniques for introducing foreign nucleic acid (e.g., DNA) into a host cell, including calcium phosphate or calcium chloride co-precipitation, DEAE-dextran-mediated transfection, lipofection, or electroporation.

A host cell can be used to produce (e.g., express) a fusion polypeptide (e.g., a fusion molecule described herein). Accordingly, the invention further provides methods for producing a fusion polypeptide using the host cells. In one embodiment, the method includes culturing the host cell (into which a recombinant expression vector encoding a polypeptide has been introduced) in a suitable medium such that the fusion polypeptide is produced. In another embodiment, the method further includes isolating a fusion polypeptide from the medium or the host cell.

In another aspect, the invention features, a cell or purified preparation of cells which include a fusion molecule described herein transgene, or which otherwise misexpress the fusion. For example, a cell or purified preparation of cells which include a FGFR3-TACC3 fusion transgene, or which otherwise misexpress FGFR3-TACC3 fusion.

The cell preparation can consist of human or non-human cells, e.g., rodent cells, e.g., mouse or rat cells, rabbit cells, or pig cells. In embodiments, the cell or cells include a fusion transgene, e.g., a heterologous form of a fusion described herein, e.g., a gene derived from humans (in the case of a non-human cell) or a fusion transgene, e.g., a heterologous form of a fusion described herein. The fusion transgene can be misexpressed, e.g., overexpressed or underexpressed. In other preferred embodiments, the cell or cells include a gene that mis-expresses an endogenous fusion, e.g., a gene the expression of which is disrupted, e.g., a knockout. Such cells can serve as a model for studying disorders that are related to mutated or mis-expressed fusion alleles (e.g., cancers) or for use in drug screening, as described herein.

Therapeutic Methods

Alternatively, or in combination with the methods described herein, the invention features a method of treating a neoplasm, a cancer or a tumor harboring a fusion moelcule described herein. The methods include administering an anti-cancer agent, e.g., a kinase inhibitor, alone or in combination, e.g., in combination with other chemotherapeutic agents or procedures, in an amount sufficient to reduce or inhibit the tumor cell growth, and/or treat or prevent the cancer(s), in the subject.

"Treat," "treatment," and other forms of this word refer to the administration of a kinase inhibitor, alone or in combination with a second agent to impede growth of a cancer, to cause a cancer to shrink by weight or volume, to extend the expected survival time of the subject and or time to progression of the tumor or the like. In those subjects, treatment can include, but is not limited to, inhibiting tumor growth, reducing tumor mass, reducing size or number of metastatic lesions, inhibiting the development of new metastatic lesions, prolonged survival, prolonged progression-free survival, prolonged time to progression, and/or enhanced quality of life.

As used herein, unless otherwise specified, the terms "prevent," "preventing" and "prevention" contemplate an action that occurs before a subject begins to suffer from the re-growth of the cancer and/or which inhibits or reduces the severity of the cancer.

As used herein, and unless otherwise specified, a "therapeutically effective amount" of a compound is an amount sufficient to provide a therapeutic benefit in the treatment or management of the cancer, or to delay or minimize one or more symptoms associated with the cancer. A therapeutically effective amount of a compound means an amount of therapeutic agent, alone or in combination with other therapeutic agents, which provides a therapeutic benefit in the treatment or management of the cancer. The term "therapeutically effective amount" can encompass an amount that improves overall therapy, reduces or avoids symptoms or causes of the cancer, or enhances the therapeutic efficacy of another therapeutic agent.

As used herein, and unless otherwise specified, a "prophylactically effective amount" of a compound is an amount sufficient to prevent re-growth of the cancer, or one or more symptoms associated with the cancer, or prevent its recurrence. A prophylactically effective amount of a compound means an amount of the compound, alone or in combination with other therapeutic agents, which provides a prophylactic benefit in the prevention of the cancer. The term "prophylactically effective amount" can encompass an amount that improves overall prophylaxis or enhances the prophylactic efficacy of another prophylactic agent.

As used herein, the term "patient" or "subject" refers to an animal, typically a human (i.e., a male or female of any age group, e.g., a pediatric patient (e.g, infant, child, adolescent) or adult patient (e.g., young adult, middle-aged adult or senior adult) or other mammal, such as a primate (e.g., cynomolgus monkey, rhesus monkey); commercially relevant mammals such as cattle, pigs, horses, sheep, goats, cats, and/or dogs; and/or birds, including commercially relevant birds such as chickens, ducks, geese, and/or turkeys, that will be or has been the object of treatment, observation, and/or experiment. When the term is used in conjunction with administration of a compound or drug, then the patient has been the object of treatment, observation, and/or administration of the compound or drug.

In certain embodiments, the cancer includes, but is not limited to, a solid tumor, a soft tissue tumor, and a metastatic lesion (e.g., a cancer as described herein). In one embodiment, the cancer is chosen from lung adenocarcinoma, cervical adenocarcinoma, uterus endometrial adenocarcinoma, glioblastoma, melanoma, spindle cell sarcoma, ameloblastic fibroscarcoma, adenocarcinoma, cholangiocarcinoma, urothelial (transitional cell) carcinoma, ovarian epithelial carcinoma, colorectal adenocarcinoma, breast carcinoma, prostate carcinoma, or pancreas ductal adenocarcinoma. In one embodiment, the cancer is chosen from a lung cancer, a pancreatic cancer, melanoma, a colorectal cancer, an esophageal-gastric cancer, a thyroid cancer, or an adenocarcinoma. In other embodiment, the lung cancer is chosen from one or more of the following: non-small cell lung cancer (NSCLC), small cell lung cancer (SCLC), squamous cell carcinoma (SCC), adenocarcinoma of the lung, bronchogenic carcinoma, or a combination thereof. In one embodiment, the lung cancer is NSCLC or SCC.

In other embodiments, the cancer is chosen from lung cancer, thyroid cancer, colorectal cancer, adenocarcinoma, melanoma, B cell cancer, breast cancer, bronchus cancer, cancer of the oral cavity or pharynx, cancer of hematological tissues, cervical cancer, colon cancer, esophageal cancer, esophageal-gastric cancer, gastric cancer, kidney cancer, liver cancer, multiple myeloma, ovarian cancer, pancreatic cancer, prostate cancer, salivary gland cancer, small bowel or appendix cancer, stomach cancer, testicular cancer, urinary bladder cancer, uterine or endometrial cancer, inflammatory myofibroblastic tumors, gastrointestinal stromal tumor (GIST), and the like.

In other embodiments, the cancer is a brain cancer, e.g., a brain astrocytoma, brain glioblastoma. In other embodiments, the cancer is a cervical cancer, e.g., a cervical carcinoma, a cervical adenocarcinoma, a cervical suqamous cell carcinoma. In other embodiments the caner is a kidney cancer, e.g., a kidney carcinoma, a kidney urothelial carcinoma. In other embodiments, the cancer is a bladder cancer, e.g., a bladder urothelial carcinoma, a bladder urothelial (transitional cell carcinoma). In other embodiments the cancer is a pancreatic cancer, e.g., a pancreatic ductal carcinoma. In other embodiments, the cancer is a skin cancer, e.g., a melanoma. In other embodiments, the cancer is an endometrial cancer, e.g., an endometrial adenocarcinoma. In other embodiments, the cancer is a cholangiocsarcoma, e.g., a liver cholangiosarcoma. In other embodiments, the cancer is a fibrosarcoma, e.g., an ameloblastic fibrosarcoma. In other embodiments, the cancer is a bile duct adenocarcinoma. In other embodiments, the caner is a cholangiocarcinoma. In other embodiments, the cancer is a breast cancer, e.g., a breast carcinoma, a breast inflammatory carcinoma, In other embodiments, the cancer is a leimyosarcoma, e.g., a soft tissue leiomyosarcoma, e.g., a uteral leiomyosarcoma, small intestine leiomysarcoma. In other embodiments, the cancer is a thyroid cancer, e.g., a thyroid anaplastic carcinoma.

In certain embodiments, the neoplasm or neoplastic cell is a benign, pre-malignant, malignant (cancer) or metastasis.

In one embodiment, the anti-cancer agent is a kinase inhibitor. For example, the kinase inhibitor is a multi-kinase inhibitor or a specific inhibitor. Exemplary kinase inhibitors include, but are not limited to, axitinib (AG013736), bosutinib (SKI-606), cediranib (RECENTIN™, AZD2171), dasatinib (SPRYCEL®, BMS-354825), erlotinib (TARCEVA®), gefitinib (IRESSA®), imatinib (Gleevec®, CGP57148B, STI-571), lapatinib (TYKERB®, TYVERB®), lestaurtinib (CEP-701), neratinib (HKI-272), nilotinib (TASIGNA®), semaxanib (semaxinib, SU5416), sunitinib (SUTENT®, SU11248), toceranib (PALLADIA®), vandetanib, vatalanib (PTK787, PTK/ZK), sorafenib (NEXAVAR®), ENMD-2076, PCI-32765, AC220, dovitinib lactate (TKI258, CHIR-258), BIBW 2992 (TOVOK™), SGX523, PF-04217903, PF-02341066, PF-299804, BMS-777607, ABT-869, MP470, BIBF 1120 (VARGATEF®), AP24534, JNJ-26483327, MGCD265, DCC-2036, BMS-690154, CEP-11981, tivozanib (AV-951), OSI-930, MM-121, XL-184, XL-647, and XL228.

In one embodiment, the kinase inhibitor is a FGFR3 inhibitor including, but not limited to, TKI258 (dovitinib); AP24534 (ponatinib); AZD4547; FP-1039 (GSK3052230) (HGS1036); XL9999; or BGJ398 (NVP-BGJ398).

In one embodiment, the kinase inhibitor is an BRAF inhibitor including, but not limited to, Vemurafenib (PLX4032, RG7204, R05185426), Sorafenib Tosylate (Bay 43-9006, Nexavar), PLX4720, GDC-0879, RAF265 (CHIR-265), MLN2480 (BIIB-024), PF-04880594, GW5074, CEP-32496, Dabrafenib (GSK2118436), AZ628, SB590885, Raf265 derivative, Regorafenib (BAY 73-4506, FluoroSorafenib), DP-4978, DP-2514, DP-3346, ARQ736, XL281, RG7256, LGX818, PLX3603, trematinib, and/or ZM 336372.

In one embodiment, the kinase inhibitor is a RAF1 inhibitor including, but not limited to, sorafenib (nexavar); PLX-4720; or regorafenib (BAY 73-4506).

In one embodiment, the kinase inhibitor is a RET inhibitor including, but not limited to, pyrazolo-pyrimidines, e.g., PP1 and PP2; indocarbazole derivatives, e.g., CEP-701 and CEP-751; 2-indolinone, e.g., RPI-1; and quinazoline, e.g., ZD6474; or TG101209.

In one embodiment, the kinase inhibitor is a NTRK1 inhibitor including, but not limited to, danusertib (PHA-739358); PHA-848125; CEP-2563; K252a; KRC-108; lestaurtinib (CEP-701); AZ-23; indenopyrrolocarboazole 12a; oxindole 3; isothiazole 5n; thiazole 20 h. In certain embodiments, the inhibitor is an HSP90 inhibitor, In certain embodiments, the HSP90 inhibtior is 17-DMAG.

In one embodiment, the kinase inhibitor is an IGF1R inhibitor including, but not limited to, NVP-ADW742; BMS-754807; or AG-1024.

In one embodiment, the anti-cancer agent is a methyltrasnferase inhibitor. For example, the methyltrasnferase inhibitor is a multi-methyltrasnferase inhibitor or a DOT1L-specific inhibitor. In one embodiment, the methyltrasnferase inhibitor is a DOT1L inhibitor including, but not limited to, EPZ004777; or EPZ-5676; SGC0946.

In one embodiment, the kinase inhibitor is a FLT4 inhibitor including, but not limited to, BIBF1120 (Vargatef); KRN 633; Brivanib alaninate (BMS-582664); Telatinib (BAY 57-9352); E7080 (Lenvatinib); Trivozanib (AV-951), XL999; AL2846; Motesanib; AAL-993; Axitinib; Foretinib; MGCD-265; SAR131675; Sorafenib; Pazopanib; Regorafenib (BAY 73-4506); Sunitinib; Vandetanib; and/or IMC-3C5.

In one embodiment, the kinase inhibitor is an ALK inhibitor including, but not limited to, Crizotinib (PF-2341066; 1066); LDK378; TAE684 (NVP-TAE684); CH5424802 (AF802, R05424802); GSK1838705A; ASP-3026; CEP-37440, CEP-28122, CEP-108050; AP26113 or AZD-3463. Additional examples of ALK kinase inhibitors are described in examples 3-39 of WO 2005016894 by Garcia-Echeverria C, et al.

In one embodiment, the kinase inhibitor is an ERBB4 inhibitor including, but not limited to, AST-1306; or dacamitinib (PF299804).

In one embodiment the anti-cancer agent is a NOTCH inhibitor. In one embodiment, the anti-cancer agent is a NOTCH1 inhibitor. In one embodiment the NOCTH inhibitor includes but is not limited to, a pan NOTCH inhibitor, a NOTCH1 inhibitor compound, an anti-NOTCH1 antibody, an anti-NOTCH1 negative regulatory region antibody, or a gamma-secretase inhibitor (GSI). In other embodiments, the NOTCH1 inhibitor is chosen from: BMS-906024, PF-03084014, and/or MK-0752.

In one embodiment, the anti-cancer agent is a TSC2 activator or stabilizer. In certain embodiments, the TSC2 activator or stabilizer can include, but not limited to, 14-3-3 beta.

In one embodiment, the kinase inhibitor is an FGFR2 inhibitor including, but not limited to, BIBF1120 (Vargatef); Panatinib (AP24534); AZD4547; BGJ398 (NVP-BGJ398); or Brivanib alaninate (BMS-582664).

In one embodiment, the anti-cancer agent is a kinase inhibitor. In one embodiment, the anti-cancer agent is a ROS1 inhibitor, e.g., Ganetespib; Crizotinib; TAE684; a dual ALK and ROS1 inhibitor.

In one embodiment, the kinase inhibitor is an ERBB2 inhibitor including, but not limited to, lestaurtinib (CEP-701); AZ-23; indenopyrrolocarboazole 12a; oxindole 3; isothiazole 5n; thiazole 20 h.

In one embodiment, the kinase inhibitor is an MTOR inhibitor including, but not limited to, BEZ235 (NVP-BEZ235); Everolimus (RAD001); Rapamycin (Sirolimus, AY-22989, WY-090217); AZD8055; Temsirolimus (CCI-779, Torisel); PI-103; Ku-0063794; Deforolimus (Ridaforolimus, AP23573, MK-8669); PP242; XL765; GSK1059615; WYE-354; OSI-027; GDC-0980 (RG7422); GSK2126458; PF-05212384 (PKI-587); PF-04691502; Palomid 529 (P529); PP-121; WYE-125132; WYE-687; NVP-BGT226; WAY-600; AZD2014; CH5132799; INK 128; or Torin1.

In one embodiment, the anti-cancer agent is a CBL inhibitor, e.g., XL-184 free base (Cabozantinib); R406; Dovitinib Dilactic acid (TKI258 Dilactic acid); Quizartinib (AC220); Tandutinib (MLN518); Amuvatinib (MP-470); ENMD-2076; KW 2449; TG101209; or Dovitinib (TKI-258).

Kinase Inhibitors

In one embodiment, the anti-cancer agent is a kinase inhibitor. Exemplary kinase inhibitors include, but are not limited to, axitinib (AG013736), bosutinib (SKI-606), cediranib (RECENTIN™, AZD2171), dasatinib (SPRYCEL®, BMS-354825), erlotinib (TARCEVA®), gefitinib (IRESSA®), imatinib (Gleevec®, CGP57148B, STI-571), lapatinib (TYKERB®, TYVERB®), lestaurtinib (CEP-701), neratinib (HKI-272), nilotinib (TASIGNA®), semaxanib (semaxinib, SU5416), sunitinib (SUTENT®, SU11248), toceranib (PALLADIA®), vandetanib, vatalanib (PTK787, PTK/ZK), sorafenib (NEXAVAR®), ENMD-2076, PCI-32765, AC220, dovitinib lactate (TKI258, CHIR-258), BIBW 2992 (TOVOK™), SGX523, PF-04217903, PF-02341066, PF-299804, BMS-777607, ABT-869, MP470, BIBF 1120 (VARGATEF®), AP24534, JNJ-26483327, MGCD265, DCC-2036, BMS-690154, CEP-11981, tivozanib (AV-951), OSI-930, MM-121, XL-184, XL-647, and XL228.

In some embodiments, the kinase inhibitor is Axitinib. Axitinib is a multi-target inhibitor of VEGFR1, VEGFR2, VEGFR3, PDGFRβ and c-Kit with IC50 of 0.1 nM, 0.2 nM, 0.1-0.3 nM, 1.6 nM and 1.7 nM, respectively. Axitinib has the following structure:

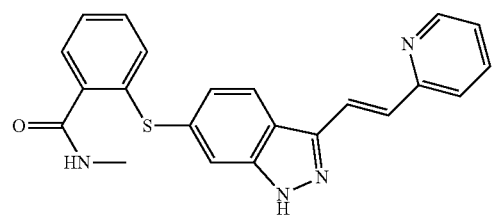

Axitinib Chemical Structure
Molecular Weight: 386.47.

In some embodiments, the kinase inhibitor is Bosutinib (SKI-606). Bosutinib (SKI-606) is a novel, dual Src/Abl inhibitor with IC50 of 1.2 nM and 1 nM, respectively. Bosutinib (SKI-606) has the chemical name 4-(2,4-dichloro-5-methoxyphenylamino)-6-methoxy-7-(3-(4-methylpiperazin-1-yl)propoxy)quinoline-3-carbonitrile; and has the following structure:

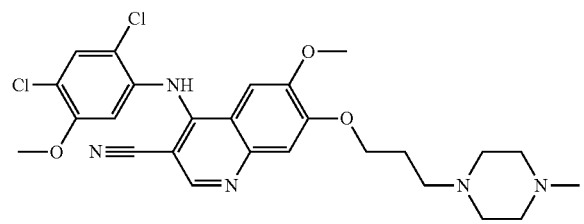

Bosutinib Chemical Structure
Molecular Weight: 530.45.

In some embodiments, the kinase inhibitor is Cediranib. Cediranib (AZD2171) is a highly potent VEGFR (KDR) inhibitor with IC50 of <1 nM, also inhibits Flt1/4 with IC50 of 5 nM/<3 nM, similar activity against c-Kit and PDGFRβ, 36-, 110-fold and >1000-fold selective more for VEGFR than PDGFR-α, CSF-1R and Flt3. Cediranib has the chemical name 4-(4-fluoro-2-methyl-1H-indol-5-yloxy)-6-methoxy-7-(3-(pyrrolidin-1-yl)propoxy)quinazoline; and has the following structure:

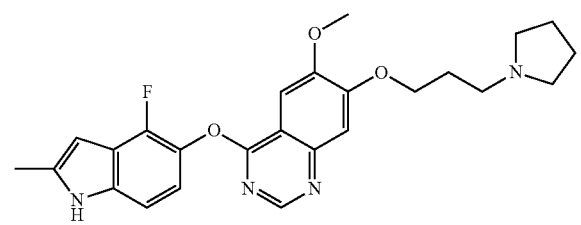

Cediranib Chemical Structure
Molecular Weight: 450.51.

In some embodiments, the kinase inhibitor is Dasatinib. Dasatinib is a novel, potent and multi-targeted inhibitor that targets Abl, Src and c-Kit, with IC50 of <1 nM, 0.5 nM and 79 nM, respectively. Dasatinib has the chemical name N-(2-chloro-6-methylphenyl)-2-(6-(4-(2-hydroxyethyl)piperazin-1-yl)-2-methylpyrimidin-4-ylamino)thiazole-5-carboxamide; and has the following structure:

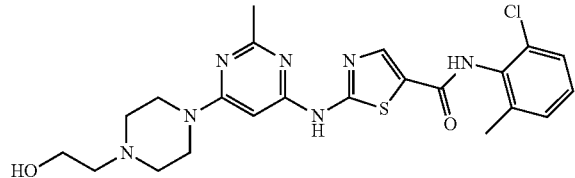

Dasatinib Chemical Structure
Molecular Weight: 488.01.

In some embodiments, the kinase inhibitor is Erlotinib. Erlotinib HCl (OSI-744) is an EGFR inhibitor with IC50 of 2 nM, >1000-fold more sensitive for EGFR than human c-Src or v-Abl. Erlotinib has the chemical name N-(3-ethynylphenyl)-6,7-bis(2-methoxyethoxy)quinazolin-4-amine hydrochloride; and has the following structure:

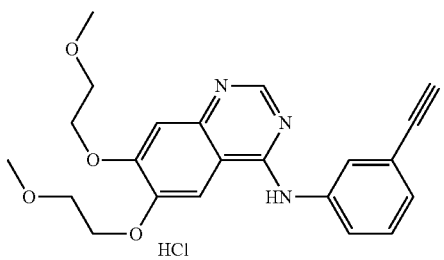

Erlotinib Chemical Structure
Molecular Weight: 429.90.

In some embodiments, the kinase inhibitor is Gefitinib. Gefitinib (ZD-1839) is an EGFR inhibitor for Tyr1173, Tyr992, Tyr1173 and Tyr992 in the NR6wtEGFR and NR6W cells with IC50 of 37 nM, 37 nM, 26 nM and 57 nM, respectively. Gefitinib has the chemical name N-(3-chloro-4-fluorophenyl)-7-methoxy-6-(3-morpholinopropoxy)quinazolin-4-amine; and has the following structure:

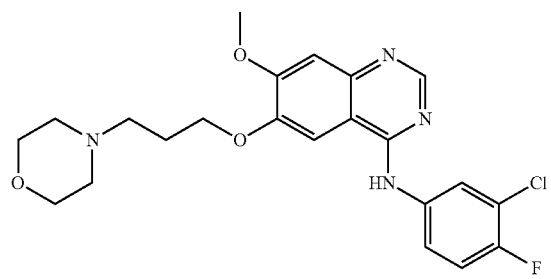

Gefitinib Chemical Structure
Molecular Weight: 446.90.

In some embodiments, the kinase inhibitor is Imatinib. Imatinib is a multi-target inhibitor of v-Abl, c-Kit and PDGFR with IC50 of 0.6 µM, 0.1 µM and 0.1 µM, respectively. Imatinib has the following structure:

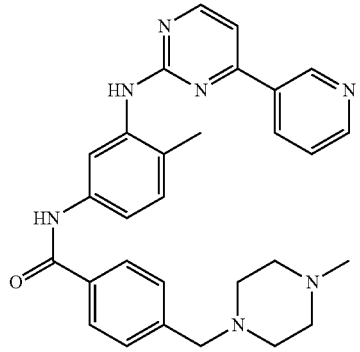

Imatinib Chemical Structure
Molecular Weight: 493.6.

In certain embodiments the kinase inhibitor is lestaurtinib. Lestaurtinib is a otent JAK2, FLT3 and TrkA inhibitor ($IC_{50}$ values are 0.9, 3 and <25 nM respectively) that prevents STATS phosphorylation ($IC_{50}$=20-30 nM). Exhibits antiproliferative activity in vitro (IC50=30-100 nM in HEL92.1.7 cells) and is effective against myeloproliferative disorders in vivo. Lestaurtinib has the chemical name: (9S,10S,12R)-2,3,9,10,11,12-Hexahydro-10-hydroxy-10-(hydroxymethyl)-9-methyl-9,12-epoxy-1H-diindolo[1,2,3-fg:3', 2', 1'-kl]pyrrolo[3,4-i][1, 6]benzodiazocin-1-one; and has the following structure:

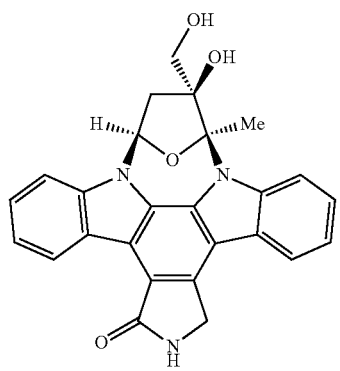

Lestaurtinib Chemical Structure
Molecular Weight: 439.46.

In some embodiments, the kinase inhibitor is Sunitinib. Sunitinib Malate is a multi-targeted RTK inhibitor targeting VEGFR2 (Flk-1) and PDGFRβ with IC50 of 80 nM and 2 nM, and also inhibits c-Kit. Sunitinib has the chemical name (Z)—N-(2-(diethylamino)ethyl)-5-((5-fluoro-2-oxoindolin-3-ylidene)methyl)-2,4-dimethyl-1H-pyrrole-3-carboxamide, (S)-2-hydroxysuccinic acid; and has the following structure:

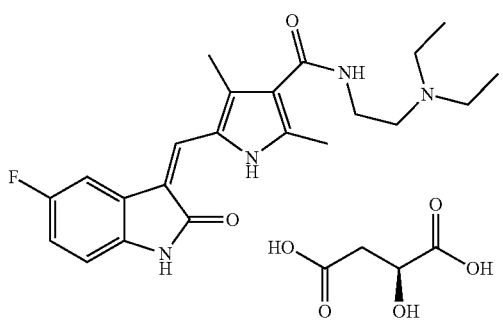

Sunitinib Chemical Structure
Molecular Weight: 532.56.

In certain embodiments the kinase inhibitor is ZD6474. Vandetanib (ZD6474) is an orally-bioavailable, ATP-competitive, quinazoline-based inhibitor of VEGFR2 that has been shown to inhibit both VEGF-induced signalling in endothelial cells and tumor-induced angiogenesis. [1] Vandetanib inhibits VEGFR2, VEGFR3, EGFR, and RET at IC50s of 40 nM, 110 nM, 500 nM, and 130 nM, respectively. It has been found to inhibit cell proliferation of VEGFR-stimulated cells (IC50 60 nM) and EGFR-stimulated HUVEC proliferation (IC50 170 nM). ZD6474 has the chemical name: N-(4-bromo-2-fluorophenyl)-6-methoxy-7-((1-methylpiperidin-4-yl)methoxy)quinazolin-4-amine; and has the following structure:

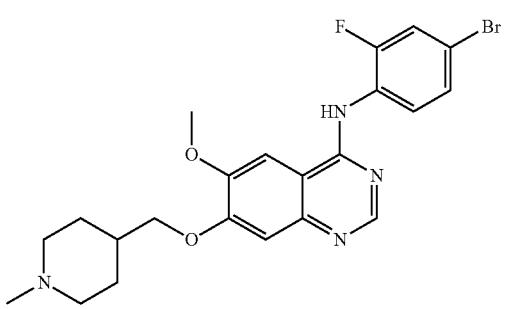

ZD6474 Chemical Structure
Molecular Weight: 475.35.

In some embodiments, the kinase inhibitor is Sorafenib Tosylate (also known as Bay 43-9006, Nexavar). In one embodiment, Sorafenib has the chemical name: 2-Pyridinecarboxamide, 4-[4-[[[[4-chloro-3-(trifluoromethyl)phenyl]amino]carbonyl]amino]phenoxy]-N-methyl-, 4-methylbenzenesulfonate (1:1); and has the following structure:

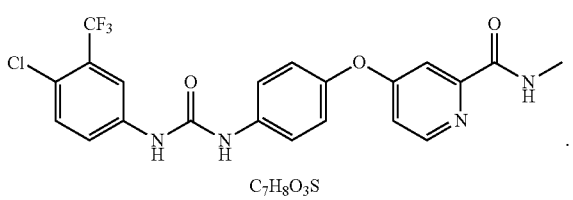

In some embodiments, the kinase inhibitor is Lapatinib. Lapatinib, used in the form of Lapatinib Ditosylate, is a potent EGFR and ErbB2 inhibitor with IC50 of 10.8 and 9.2 nM, respectively. Lapatinib has the chemical name N-(4-(3-fluorobenzyloxy)-3-chlorophenyl)-6-(5-((2-(methylsulfonyflethylamino)methyl)furan-2-yl)quinazolin-4-amine,di4-methylbenzenesulfonate; and has the following structure:

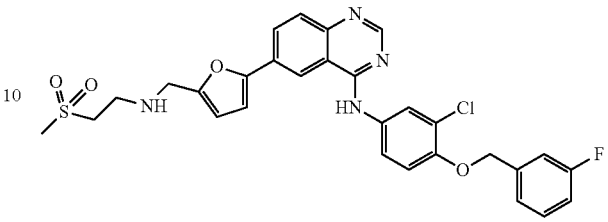

Lapatinib Chemical Structure
Molecular Weight: 581.06.

In some embodiments, the kinase inhibitor is Neratinib. Neratinib (HKI-272) is a highly selective HER2 and EGFR inhibitor with IC50 of 59 nM and 92 nM; weakly inhibits KDR and Src, no significant inhibition to Akt, CDK1/2/4, IKK-2, MK-2, PDK1, c-Raf and c-Met. Neratinib has the chemical name (E)-N-(4-(3-chloro-4-(pyridin-2-ylmethoxy)phenylamino)-3-cyano-7-ethoxyquinolin-6-yl)-4-(dimethylamino)but-2-enamide; and has the following structure:

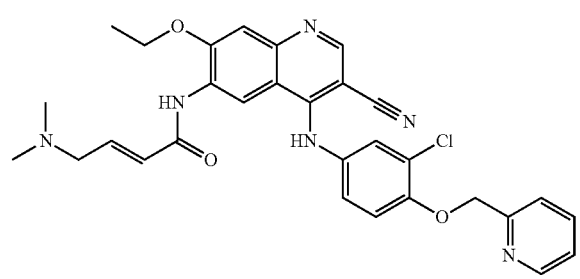

Neratinib Chemical Structure
Molecular Weight: 557.04.

In some embodiments, the kinase inhibitor is Nilotinib. Nilotinib (AMN-107) is a Bcr-Abl inhibitor with IC50 less than 30 nM. Nilotinib has the chemical name 4-methyl-N-(3-(4-methyl-1H-imidazol-1-yl)-5-(trifluoromethyl)phenyl)-3-(4-(pyridin-3-yl)pyrimidin-2-ylamino)benzamide; and has the following structure:

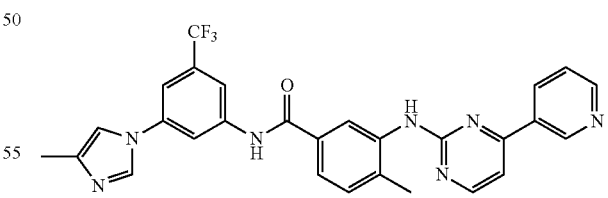

Nilotinib Chemical Structure
Molecular Weight: 529.52.

In some embodiments, the kinase inhibitor is Semaxanib. Semaxanib (SU5416) is a potent and selective VEGFR (Flk-1/KDR) inhibitor with IC50 of 1.23 μM, 20-fold more selective for VEGFR than PDGFRβ, lack of activity against EGFR, InsR and FGFR. Semaxanib has the chemical name 2H-Indol-2-one, 3-[(3,5-dimethyl-1H-pyrrol-2-yl)methylene]-1,3-dihydro-, (3Z)—; and has the following structure:

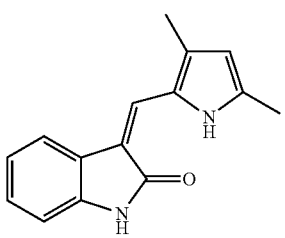

Semaxanib Chemical Structure
Molecular Weight: 238.28.

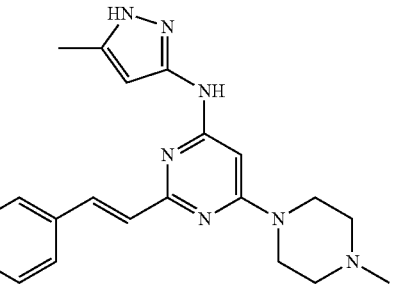

ENMD-2076 Chemical Structure
Molecular Weight: 375.47.

In some embodiments, the kinase inhibitor is Vatalanib. Vatalanib (PTK787) is an inhibitor of VEGFR2/KDR with IC50 of 37 nM, less potent against VEGFR1/Flt-1, 18-fold against VEGFR3/Flt-4. Vatalanib has the chemical name N-(4-chlorophenyl)-4-(pyridin-4-ylmethyl)phthalazin-1-amine dihydrochloride; and has the following structure:

In some embodiments, the kinase inhibitor is PCI-32765 (Ibrutinib). PCI-32765 (Ibrutinib) is a potent and highly selective Btk inhibitor with IC50 of 0.5 nM, modestly potent to Bmx, CSK, FGR, BRK, HCK, less potent to EGFR, Yes, ErbB2, JAK3, etc. PCI-32765 (Ibrutinib) has the chemical name (R)-1-(3-(4-amino-3-(4-phenoxyphenyl)-1H-pyrazolo[3,4-d]pyrimidin-1-yl)piperidin-1-yl)prop-2-en-1-one; and has the following structure:

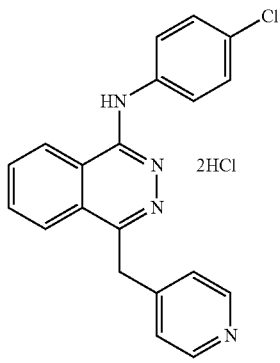

Vatalanib Chemical Structure
Molecular Weight: 419.73.

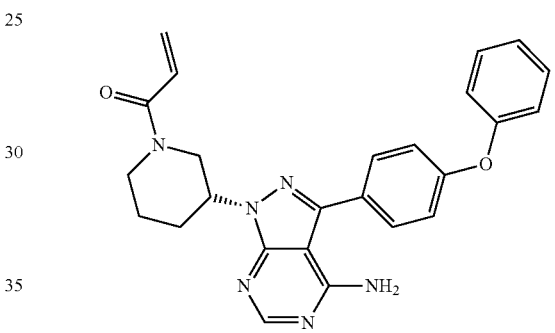

Ibrutinib Chemical Structure
Molecular Weight: 440.5.

In certain embodiments the kinase inhibitor is ENMD-2076. ENMD-2076 has selective activity against Aurora A and VEGFR (Flt3) with IC50 of 14 nM and 1.86 nM, 25-fold selective for Aurora A than over Aurora B and less potent to VEGFR2/KDR and VEGFR3, FGFR1 and FGFR2 and PDGFRα. ENMD-2076 has the chemical name (E)-N-(5-methyl-1H-pyrazol-3-yl)-6-(4-methylpiperazin-1-yl)-2-styrylpyrimidin-4-amine; and has the following structure:

In certain embodiments the kinase inhibitor is Quizartinib. Quizartinib (AC220) is a small molecule receptor tyrosine kinase inhibitor that is currently under development for the treatment of acute myeloid leukaemia. Its molecular target is FLT3, also known as CD135 which is a proto-oncogene. Quizartinib has the chemical name 1-(5-(tert-Butyl)isoxazol-3-yl)-3-(4-(7-(2-morpholinoethoxy)benzo[d]imidazo[2,1-b]thiazol-2-yl)phenyl)urea; and has the following structure:

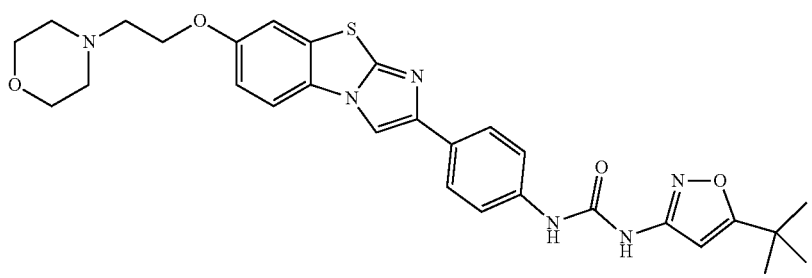

Quizartinib Chemical Structure
Molecular Weight: 560.67.

In some embodiments, the kinase inhibitor is dovitinib dilactic acid (TKI258 dilactic acid). Dovitinib dilactic acid is a multitargeted RTK inhibitor, mostly for class III (FLT3/c-Kit) with IC50 of 1 nM/2 nM, also potent to class IV (FGFR1/3) and class V (VEGFR1-4) RTKs with IC50 from 8-13 nM, less potent to InsR, EGFR, c-Met, EphA2, Tie2, IGFR1 and HER2. Dovitinib dilactic acid has the chemical name: Propanoic acid, 2-hydroxy-, compd. with 4-amino-5-fluoro-3-[6-(4-methyl-1-piperazinyl)-1H-benzimidazol-2-yl]-2(1H)-quinolinone; and has the following structure:

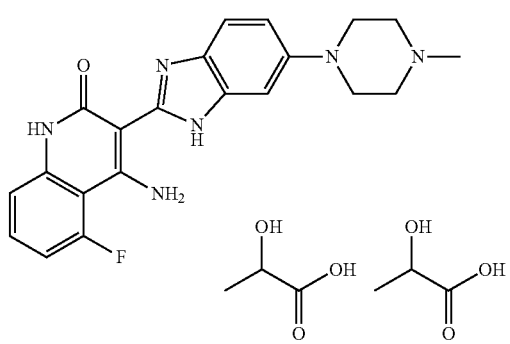

Dovitinib Dilactic Acid Chemical Structure
Molecular Weight: 572.59.

In some embodiments, the kinase inhibitor is Afatinib (BIBW2992). Afatinib (BIBW2992) irreversibly inhibits EGFR/HER2 including EGFR (wt), EGFR (L858R), EGFR (L858R/T790M) and HER2 with IC50 of 0.5 nM, 0.4 nM, 10 nM and 14 nM, respectively; 100-fold more active against Gefitinib-resistant L858R-T790M EGFR mutant. Afatinib (BIBW2992) has the chemical name (S,E)-N-(4-(3-chloro-4-fluorophenylamino)-7-(tetrahydrofuran-3-yloxy)quinazolin-6-yl)-4-(dimethylamino)but-2-enamide; and has the following structure:

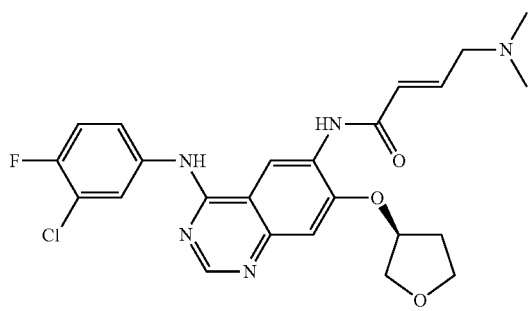

Afatinib Chemical Structure
Molecular Weight: 485.94

In some embodiments, the kinase inhibitor is SGX523. SGX-523 is a selective Met inhibitor with IC50 of 4 nM, no activity to BRAFV599E, c-Raf, Abl and p38a. SGX523 has the chemical name 6-(6-(1-methyl-1H-pyrazol-4-yl)-[1,2,4]triazolo[4,3-b]pyridazin-3-ylthio)quinoline; and has the following structure:

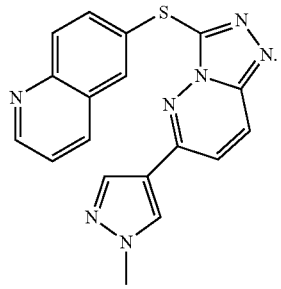

SGX523 Chemical Structure
Molecular Weight: 359.41

In some embodiments, the kinase inhibitor is PF-04217903. PF-04217903 is a selective ATP-competitive c-Met inhibitor with IC50 of 4.8 nM, susceptible to oncogenic mutations (no activity to Y1230C mutant). PF-04217903 has the chemical name 2-(4-(3-(quinolin-6-ylmethyl)-3H-[1,2,3]triazolo[4,5-b]pyrazin-5-yl)-1H-pyrazol-1-yl)ethanol; and has the following structure:

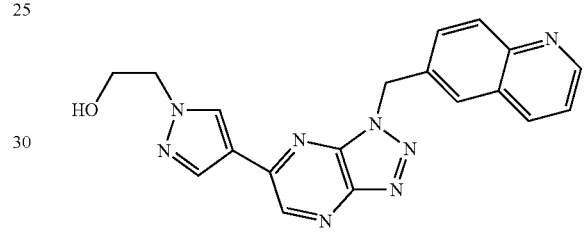

PF-04217903 Chemical Structure
Molecular Weight: 372.38

In certain embodiments the kinase inhibitor is dacamitinib. Dacomitinib is an orally bioavailable, highly selective, second-generation small-molecule inhibitor of the pan-epidermal growth factor receptor (EGFR) family of tyrosine kinases (ErbB family) with potential antineoplastic activity. Dacomitinib specifically and irreversibly binds to and inhibits human EGFR subtypes, resulting in inhibition of proliferation and induction of apoptosis in EGFR-expressing tumor cells. EGFRs play major roles in tumor cell proliferation and tumor vascularization, and are often overexpressed or mutated in various tumor cell types. Dacamitinib has the chemical name (E)-N-(4-((3-chloro-4-fluorophenyl)amino)-7-methoxyquinazolin-6-yl)-4-(piperidin-1-yl)but-2-enamide; and has the following structure:

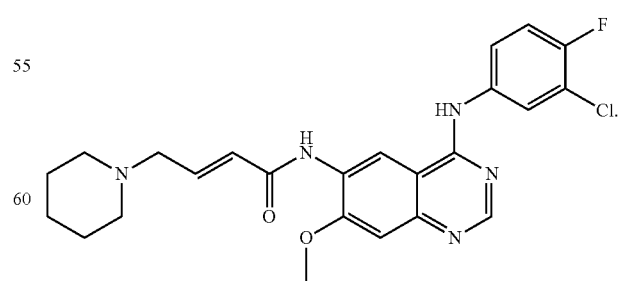

Dacamitinib Chemical Structure
Molecular Weight: 469.939

In some embodiments, the kinase inhibitor is BMS-777607. BMS-777607 is a Met-related inhibitor for c-Met, Axl, Ron and Tyro3 with IC50 of 3.9 nM, 1.1 nM, 1.8 nM and 4.3 nM, 40-fold more selective for Met-related targets versus Lck, VEGFR-2, and TrkA/B, and more than 500-fold greater selectivity versus all other receptor and non receptor kinases. BMS-777607 has the chemical name N-(4-(2-amino-3-chloropyridin-4-yloxy)-3-fluorophenyl)-4-ethoxy-1-(4-fluorophenyl)-2-oxo-1,2-dihydropyridine-3-carboxamide; and has the following structure:

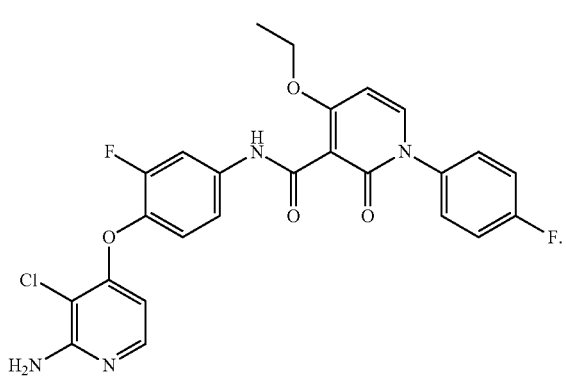

BMS-777607 Chemical Structure
Molecular Weight: 512.89

In some embodiments, the kinase inhibitor is Linifanib (ABT-869). Linifanib (ABT-869) is a novel, potent ATP-competitive VEGFR/PDGFR inhibitor for KDR, CSF-1R, Flt-1/3 and PDGFRP with IC50 of 4 nM, 3 nM, 3 nM/4 nM and 66 nM respectively, mostly effective in mutant kinase-dependent cancer cells (i.e. FLT3). Linifanib (ABT-869) has the chemical name 1-(4-(3-amino-1H-indazol-4-yl)phenyl)-3-(2-fluoro-5-methylphenyl)urea; and has the following structure:

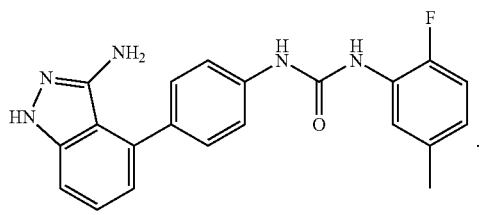

Linifanib Chemical Structure
Molecular Weight: 375.41

In some embodiments, the kinase inhibitor is Amuvatinib (MP-470). Amuvatinib (MP-470) is a potent and multi-targeted inhibitor of c-Kit, PDGFRα and Flt3 with IC50 of 10 nM, 40 nM and 81 nM, respectively. Amuvatinib (MP-470) has the following structure:

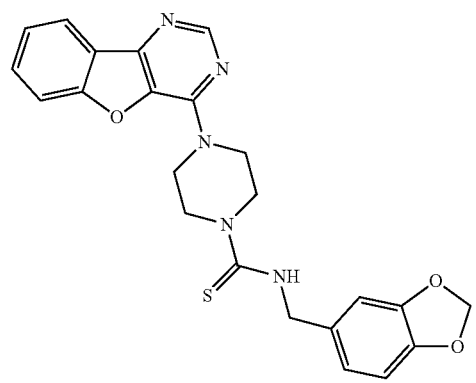

Amuvatinib Chemical Structure
Molecular Weight: 447.51

In some embodiments, the kinase inhibitor is BIBF1120 (Nintedanib). Nintedanib is a potent triple angiokinase inhibitor for VEGFR1/2/3, FGFR1/2/3 and PDGFRα/3 with IC50 of 34 nM/13 nM/13 nM, 69 nM/37 nM/108 nM and 59 nM/65 nM. BIBF1120 has the chemical name: (Z)-methyl 3-((4-(N-methyl-2-(4-methylpiperazin-1-yl)acetamido)phenylamino)(phenyl)methylene)-2-oxoindoline-6-carboxylate; and has the following structure:

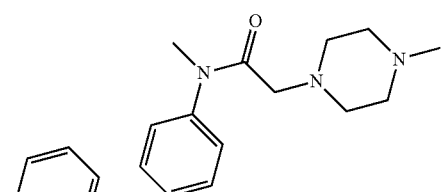

Nintedanib Chemical Structure
Molecular Weight: 539.62

In some embodiments, the kinase inhibitor is ponatinib (AP24534). Ponatinib is a novel, potent multi-target inhibitor of Abl, PDGFRα, VEGFR2, FGFR1 and Src with IC50 of 0.37 nM, 1.1 nM, 1.5 nM, 2.2 nM and 5.4 nM, respectively. Ponatinib has the chemical name: 3-(2-(imidazo[1,2-b]pyridazin-3-yl)ethynyl)-4-methyl-N-(4-((4-methylpiperazin-1-yl)methyl)-3-(trifluoromethyl)phenyl)benzamide; and has the following structure:

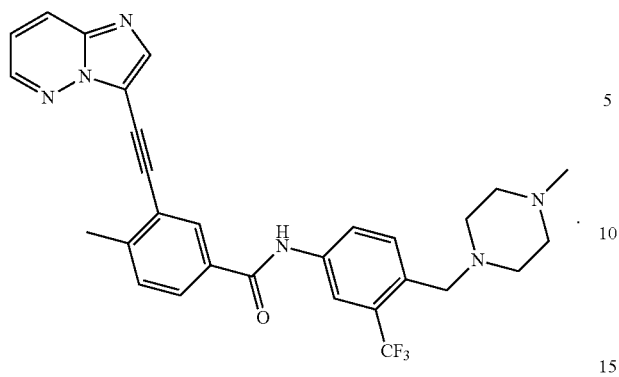

Ponatinib Chemical Structure
Molecular Weight: 532.56

In some embodiments, the kinase inhibitor is DCC-2036 (Rebastinib). DCC-2036 is a conformational control Bcr-Abl inhibitor for Abl1 (WT) and Abl1 (T315I) with IC50 of 0.8 nM and 4 nM, also inhibits SRC, LYN, FGR, HCK, KDR, FLT3, and Tie-2, and low activity to seen towards c-Kit. DCC-2036 (Rebastinib) has the chemical name 1-(3-tert-butyl-1-(quinolin-6-yl)-1H-pyrazol-5-yl)-3-(2-fluoro-4-(2-(methylcarbamoyl)pyridin-4-yloxy)phenyl)urea; and has the following structure:

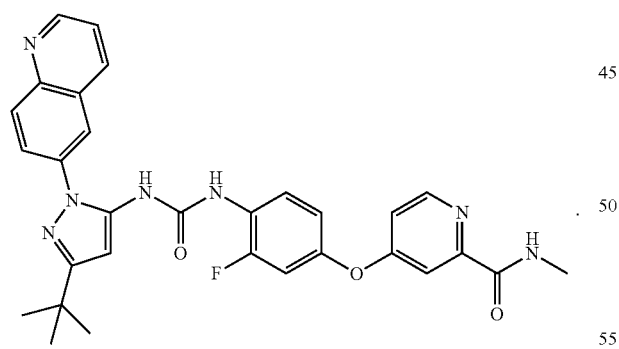

Rebastinib Chemical Structure
Molecular Weight: 553.59

In some embodiments, the kinase inhibitor is Daclatasvir (BMS-790052). BMS-790052 is a highly selective inhibitor of HCV NS5A with EC50 of 9-50 μM, for a broad range of HCV replicon genotypes and the JFH-1 genotype 2a infectious virus in cell culture. Daclatasvir (BMS-790052) has the chemical name Carbamic acid, N,N'-[[1,1'-biphenyl]-4,4'-diylbis[1H-imidazole-5,2-diyl-(2S)-2,1-pyrrolidinediyl[(1S)-1-(1-methylethyl)-2-oxo-2,1-ethanediyl]]]bis-, C,C'-dimethyl ester; and has the following structure:

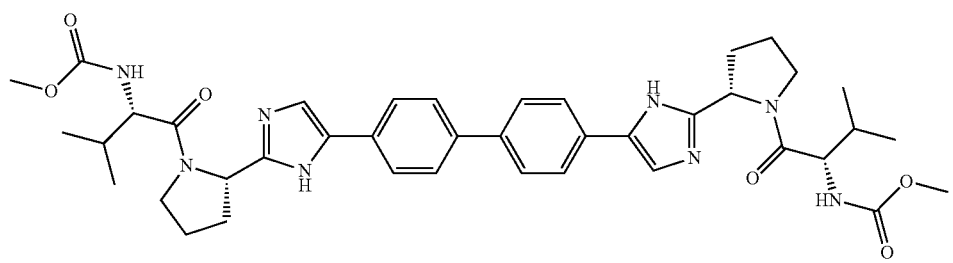

Daclatasvir Chemical Structure
Molecular Weight: 738.88

In some embodiments, the kinase inhibitor is CEP-11981. CEP-11981 is an orally bioavailable inhibitor of vascular endothelial growth factor receptor (VEGFR) and Tie2 receptor tyrosine kinases with potential antiangiogenic and antineoplastic activities. CEP-11981 has the chemical name 13-isobutyl-4-methyl-10-(pyrimidin-2-ylamino)-4,7,8,13-tetrahydro-1H-indazolo[5,4-a]pyrrolo[3,4-c]carbazol-6 (2H)-one; and has the following structure:

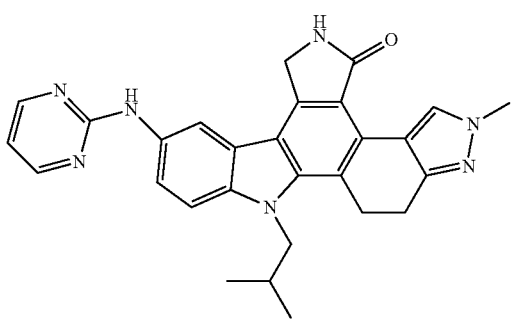

CEP-11981 Chemical Structure
Molecular Weight: 477.227

In some embodiments, the kinase inhibitor is Tivozanib (AV-951). Tivozanib (AV-951) is a potent and selective VEGFR inhibitor for VEGFR1/2/3 with IC50 of 0.21 nM/0.16 nM/0.24 nM, and also inhibits PDGFR and c-Kit, low activity observed against FGFR-1, Flt3, c-Met EGFR and IGF-1R. Tivozanib (AV-951) has the chemical name 1-(2-chloro-4-(6,7-dimethoxyquinolin-4-yloxy)phenyl)-3-(5-methylisoxazol-3-yl)urea; and has the following structure:

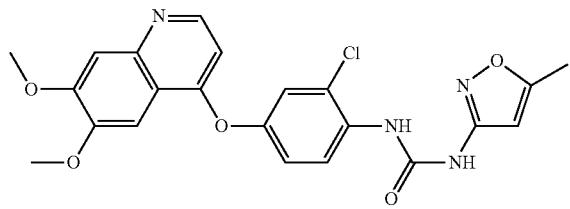

Tivozanib Chemical Structure
Molecular Weight: 454.86

In some embodiments, the kinase inhibitor is OSI-930. OSI-930 is a potent inhibitor of Kit, KDR and CSF-1R with IC50 of 80 nM, 9 nM and 15 nM, respectively; also potent to Flt-1, c-Raf and Lck and low activity against PDGFRα/β, Flt-3 and Abl. OSI-930 has the following structure:

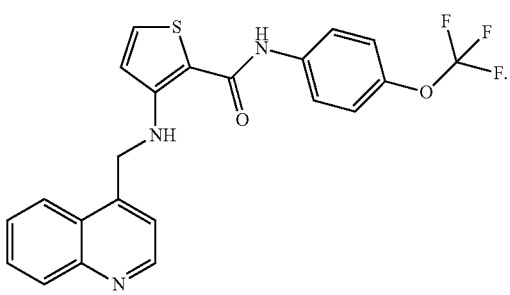

OSI-930 Chemical Structure
Molecular Weight: 443.44

In certain embodiments the kinase inhibitor is Cabozantinib. Cabozantinib is a small molecule inhibitor of the tyrosine kinases c-Met and VEGFR2, and has been shown to reduce tumor growth, metastasis, and angiogenesis. Cabozantinib has the chemical name N-(4-((6,7-Dimethoxyquinolin-4-yl)oxy)phenyl)-N-(4-fluorophenyl)cyclopropane-1,1-dicarboxamide; and has the following structure:

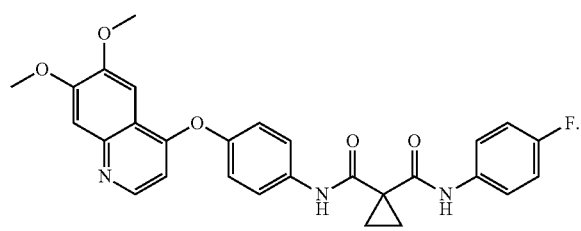

Cabozantinib Chemical Structure
Molecular Weight: 501.51

In some embodiments, the kinase inhibitor is XL-647. XL647 is an orally bioavailable small-molecule receptor tyrosine kinase (RTK) inhibitor with potential antineoplastic activity. XL647 binds to and inhibits several tyrosine receptor kinases that play major roles in tumor cell proliferation and tumor vascularization, including epidermal growth factor receptor (EGFR; ERBB1), epidermal growth factor receptor 2 (HER2; ERBB2), vascular endothelial growth factor receptor (VEGFR), and ephrin B4 (EphB4). This may result in the inhibition of tumor growth and angiogenesis, and tumor regression. XL-647 has the chemical name N-(3,4-dichloro-2-fluorophenyl)-6-methoxy-7-(((3aR,6aS)-2-methyloctahydrocyclopenta[c]pyrrol-5-yl)methoxy)quinazolin-4-amine; and has the following structure:

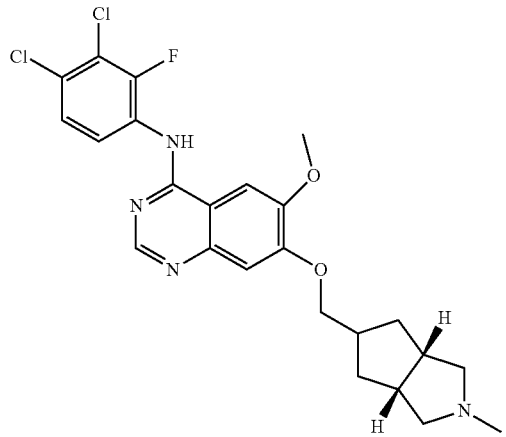

XL-647 Chemical Structure
Molecular Weight: 491.385.

In some embodiments, the kinase inhibitor is XL288. XL288 has the following structure:

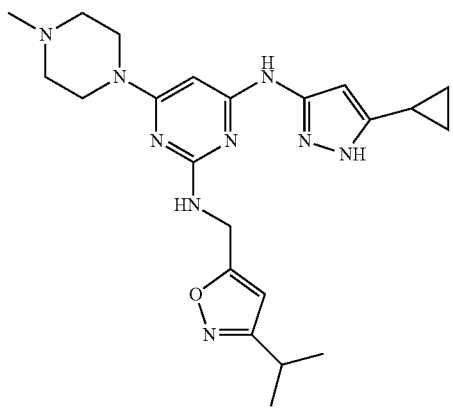

Chemical Structure
Molecular Weight: 437.54.

MEK Inhibitors

In some embodiments, the agent is a MEK inhibitor. A MEK inhibitor can include an agent that inhibits MEK1 and/or MEK2. In some embodiments, the MEK inhibitor is chosen from: ARRY-162 (MEK162), Trametinib (GSK1120212), Selumetinib (AZD6244, ARRY142886), XL518 (GDC-0973), CI-1040 (PD184352), PD035901, U0126-EtOH, PD198306, PD98059, BIX 02189, TAK-733, Honokiol, AZD8330 (ARRY-424704), PD318088, BIX 02188, AS703026 (Pimasertib), RG7167, E6201; MSC2015103, MSC1936369, WX554 and/or SL327.

In one embodiment, the inhibitor MEK is ARRY-162 (MEK162). ARRY-162 is a potent, orally bioavailable and non-ATP competitive inhibitor of MEK1/2 (IC50=12 nM) and cellular pERK (IC50=11 nM). It shows ex vivo inhibition of cytokine production such as IL-1, TNF and IL-6 in clinical trials. ARRY-162 has the chemical name: 5-((4-bromo-2-fluorophenyl)amino)-4-fluoro-N-(2-hydroxy-ethoxy)-1-methyl-1H-benzo[d]imidazole-6-carboxamide; and has the following structure:

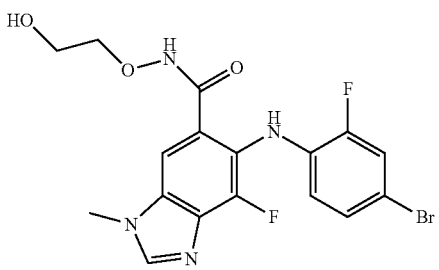

ARRY-162 Chemical Structure
Molecular Weight: 441.22681.

In one embodiment, the MEK inhibitor is Trametinib (GSK1120212). Trametinib is a highly specific and potent MEK1/2 inhibitor with IC50 of 0.92 nM/1.8 Nm. Trametinib does not inhibit the kinase activities of c-Raf, B-Raf, ERK1/2. Trametinib has the chemical name: N-(3-(3-Cyclopropyl-5-[(2-fluoro-4-iodophenyl)amino]-6,8-dimethyl-2,4,7-tri-oxo-3,4,6,7-tetrahydropyrido[4,3-d]pyrimidin-1(2H)-yl) phenylacetamide; and has the following structure:

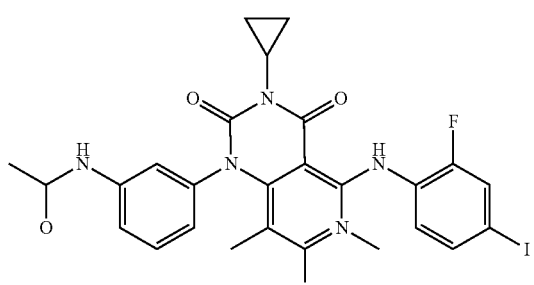

Trametinib Chemical Structure
Molecular Weight: 615.39.

In one embodiment, the MEK inhibitor is Selumetinib (AZD6244, ARRY142886). Selumetinib is a potent, highly selective MEK1 inhibitor with IC50 of 14 nM, also inhibits ERK1/2 phosphorylation with IC50 of 10 nM. Selumetinib has the chemical name: 6-(4-bromo-2-chloroanilino)-7-fluoro-N-(2-hydroxyethoxy)-3-methylbenzimidazole-5-carboxamide; and has the following structure:

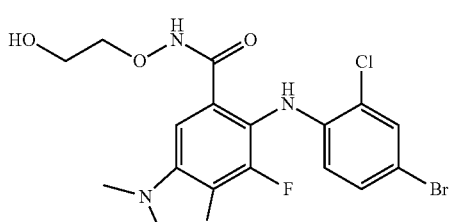

Selumetinib Chemical Structure
Molecular Weight: 457.68.

In one embodiment, the MEK inhibitor is XL518 (GDC-0973). XL518 a potent, selective, orally bioavailable inhibitor of MEK1. XL518has the chemical name: [3,4-difluoro-2-[(2-fluoro-4-iodophenyl)amino]phenyl][3-hydroxy-3-[(2S)-2-piperidinyl]-1-azetidinyl]methanone; and has the following structure:

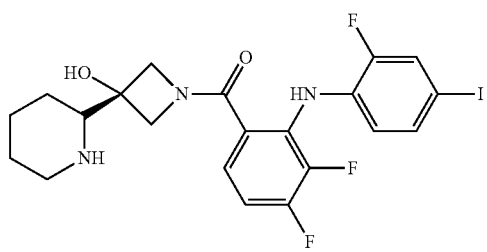

XL518 Chemical Structure
Molecular Weight: 531.31.

In one embodiment, the MEK inhibitor is CI-1040 (PD184352). CI-1040 is an ATP non-competitive MEK1/2 inhibitor with IC50 of about 17 nM, 100-fold more selective for MEK1/2 than MEK5. CI-1040 has the chemical name: 2-(2-chloro-4-iodophenylamino)-N-(cyclopropylmethoxy)-3,4-difluorobenzamide; and has the following structure:

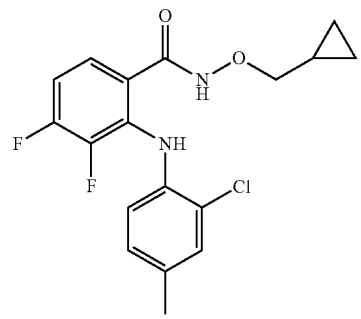

CI-1040 Chemical Structure
Molecular Weight: 478.67.

In one embodiment, the MEK inhibitor is PD035901. PD0325901 is selective and non ATP-competitive MEK inhibitor with IC50 of about 0.33 nM, roughly 500-fold more potent than CI-1040 on phosphorylation of ERK1 and ERK2. PD035901 has the chemical name: (R)—N-(2,3-dihydroxypropoxy)-3,4-difluoro-2-(2-fluoro-4-iodophe-nylamino)benzamide; and has the following structure:

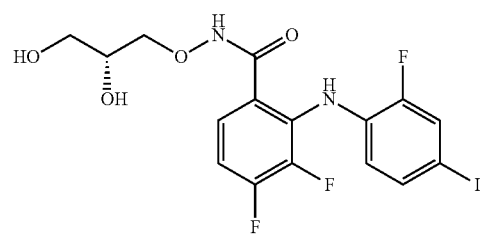

PD035901 Chemical Structure
Molecular Weight: 482.19.

In one embodiment, the MEK inhibitor is U0126-EtOH. U0126-EtOH is a highly selective inhibitor of MEK1/2 with IC50 of about 0.07 µM/0.06 µM, 100-fold higher affinity for ΔN3-S218E/S222D MEK than PD098059. PD098059 has the chemical name: (2Z,3Z)-2,3-bis(amino(2-aminophenyl-thio)methylene)succinonitrile, ethanol; and has the following structure:

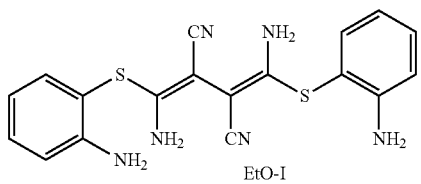

U0126-EtOH Chemical Structure
Molecular Weight: 426.56.

In one embodiment, the MEK inhibitor is PD198306. PD198306 is a cell-permeable and highly selective MEK inhibitor with IC50 of 8 nM. PD198306 has the chemical name: Benzamide, N-(cyclopropylmethoxy)-3,4,5-trifluoro-2-[(4-iodo-2-methylphenyl)amino]-; and has the following structure:

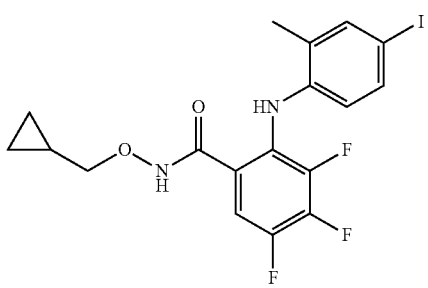

PD198306 Chemical Structure
Molecular Weight: 476.23.

In one embodiment, the MEK inhibitor is PD98059. PD98059 is a non-ATP competitive MEK inhibitor with IC50 of 2 µM, specifically inhibits MEK-1-mediated activation of MAPK. PD98059 does not directly inhibit ERK1 or ERK2. PD98059 has the chemical name: 2-(2-amino-3-methoxyphenyl)-4H-chromen-4-one; and has the following structure:

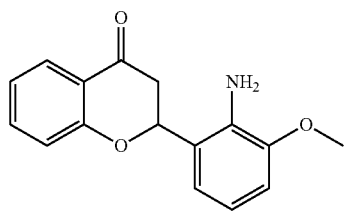

PD98059 Chemical Structure
Molecular Weight: 267.28.

In one embodiment, the MEK inhibitor is BIX 02189. BIX 02189 is a selective inhibitor of MEK5 with IC50 of 1.5 nM, also inhibits ERK5 catalytic activity with IC50 of 810 nM. BIX 02189 does not inhibit closely related kinases MEK1, MEK2, ERK2, and JNK2. BIX 02189 has the chemical name: (Z)-3-((3-((dimethylamino)methyl)phenylamino) (phenyl)methylene)-N,N-dimethyl-2-oxoindoline-6-carboxamide; and has the following structure:

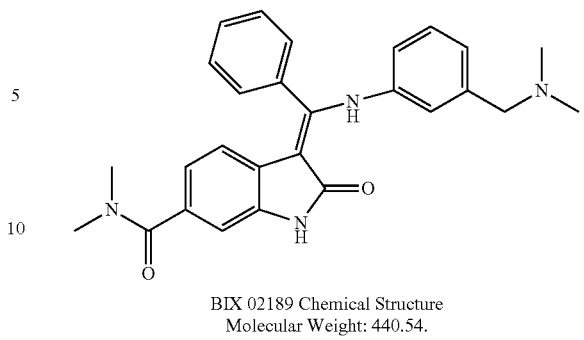

BIX 02189 Chemical Structure
Molecular Weight: 440.54.

In one embodiment, the MEK inhibitor is TAK-733. TAK-733 is a potent and selective MEK allosteric site inhibitor for MEK1 with IC50 of about 3.2 nM. TAK-733 is inactive to Abl1, AKT3, c-RAF, CamK1, CDK2, c-Met. TAK-733 has the chemical name: (R)-3-(2,3-dihydroxypropyl)-6-fluoro-5-(2-fluoro-4-iodophenylamino)-8-methylpyrido[2,3-d]pyrimidine-4,7(3H,8H)-dione; and has the following structure:

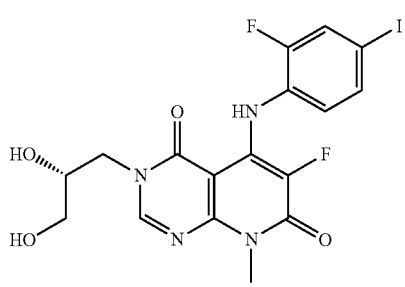

TAK-733 Chemical Structure
Molecular Weight: 267.28.

In one embodiment, the MEK inhibitor is Honokiol. Honokiol is the active principle of magnolia extract that inhibits Akt-phosphorylation and promotes ERK1/2phosphorylation. Honokiol has the chemical name: 2-(4-hydroxy-3-prop-2-enyl-phenyl)-4-prop-2-enyl-phenol; and has the following structure:

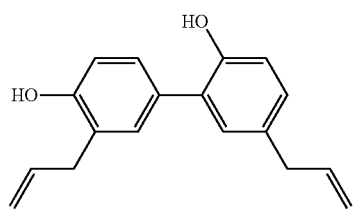

Honokiol Chemical Structure
Molecular Weight: 266.334.

In one embodiment, the MEK inhibitor is AZD8330 (ARRY-424704). AZD8330 is a novel, selective, non-ATP competitive MEK 1/2 inhibitor with IC50 of about 7 nM. AZD8330 has the chemical name: 2-(2-fluoro-4-iodophenylamino)-N-(2-hydroxyethoxy)-1,5-dimethyl-6-oxo-1,6-dihydropyridine-3-carboxamide; and has the following structure:

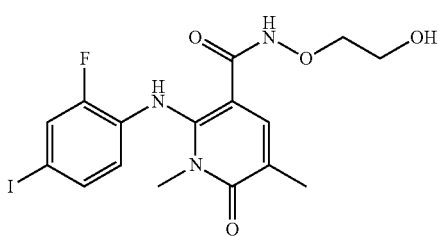

AZD8330 Chemical Structure
Molecular Weight: 461.23.

In one embodiment, the MEK inhibitor is PD318088. PD318088 is a non-ATP competitive allosteric MEK1/2 inhibitor. PD318088 has the chemical name: 5-bromo-N-(2,3-dihydroxypropoxy)-3,4-difluoro-2-(2-fluoro-4-iodophenylamino)benzamide; and has the following structure:

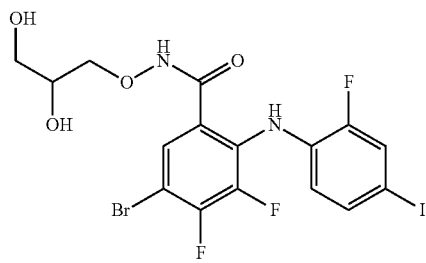

PD318088 Chemical Structure
Molecular Weight: 561.09.

In some embodiments, the MEK inhibitor is BIX 02188. BIX02188 is a selective inhibitor of MEK5 with IC50 of about 4.3 nM, also inhibits ERK5 catalytic activity with IC50 of 810 nM. BIX 02188 does not significantly inhibit closely related kinases MEK1, MEK2, ERK2, and JNK2. BIX02188 has the chemical name: (Z)-3-((3-((dimethylamino)methyl)phenylamino) (phenyl)methylene)-2-oxoindoline-6-carboxamide; and has the following structure:

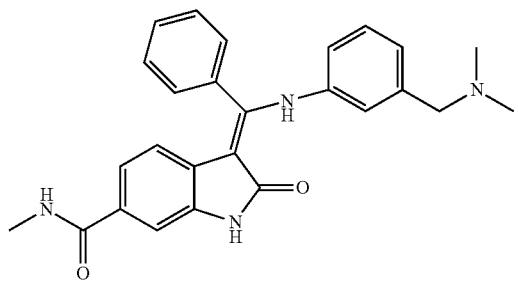

BIX02188 Chemical Structure
Molecular Weight: 426.51.

In one embodiment, the MEK inhibitor is AS703026 (Pimasertib). AS-703026 is a highly selective, potent, ATP non-competitive allosteric inhibitor of MEK1/2 with IC50 of about 0.005-2 μM in MM cell lines. AS703026 has the chemical name: (S)—N-(2,3-dihydroxypropyl)-3-(2-fluoro-4-iodophenylamino)isonicotinamide; and has the following structure:

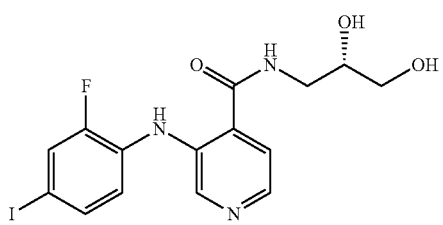

AS703026 Chemical Structure
Molecular Weight: 431.20.

In one embodiment, the MEK inhibitor is SL327. SL327 is a selective inhibitor for MEK1/2 with IC50 of about 0.18 μM/0.22 μM. SL327 has no activity towards Erk1, MKK3, MKK4, c-JUN, PKC, PKA, or CamKII. SL327 is capable of transport through the blood-brain barrier. SL327 has the chemical name: (Z)-3-amino-3-(4-aminophenylthio)-2-(2-(trifluoromethyl)phenyl)acrylonitrile; and has the following structure:

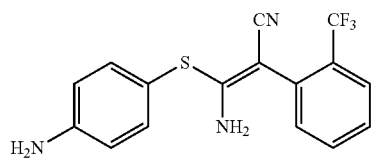

SL327 Chemical Structure
Molecular Weight: 335.35.

In one embodiment, the MEK inhibitor is RG7167. RG7167 is a potent, orally bioavailable, highly selective MEK inhibitor. It potently inhibits the MAPK signaling pathway activation and tumor cell growth.

In one embodiment, the MEK inhibitor is E6201. E6201 is a synthetic, fungal metabolite analogue inhibitor of mitogen-activated protein kinase kinase 1 (MEK-1) and mitogen-activated protein kinase kinase kinase 1 (MEKK-1) with potential antipsoriatic and antineoplastic activities. MEK-1/MEKK-1 inhibitor E6201 specifically binds to and inhibits the activities of MEK-1 and MEKK-1, which may result in the inhibition of tumor cell proliferation. MEK-1 and MEKK-1 are key components in the RAS/RAF/MEK/MAPK signaling pathway, which regulates cell proliferation and is frequently activated in human cancers. E6201 has the chemical name: (R3S,4R,5Z,8S,9S,11E)-14-(ethylamino)-8,9,16-trihydroxy-3,4-dimethyl-3,4,9,19-tetrahydro-1H-2-benzoxacyclotetradecine-1,7(8H)-dionel; and has the following structure:

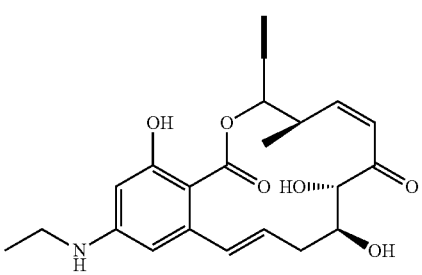

E6201 Chemical Structure
Molecular Weight: 389.44.

In one embodiment, the MEK inhibitor is MSC2015103. MSC2015103 is an orally bioavailable, selective, and highly potent small molecule inhibitor of MEK1/2.

In one embodiment, the MEK inhibitor is WX-554. WX-554 is an orally available small molecule mitogen-activated protein kinase kinase (MAP2K, MAPK/ERK kinase, or MEK) inhibitor, with potential antineoplastic activity.

BRAF Inhibitors

In one embodiment, the agent is a BRAF inhibitor. In certain embodiments, the BRAF inhibitor is chosen from: Vemurafenib (PLX4032, RG7204, R05185426), Sorafenib Tosylate (Bay 43-9006, Nexavar), PLX4720, GDC-0879, RAF265 (CHIR-265), MLN2480 (BIIB-024), PF-04880594, GW5074, CEP-32496, Dabrafenib (GSK2118436), AZ628, SB590885, Raf265 derivative, Regorafenib (BAY 73-4506, Fluoro-Sorafenib), DP-4978, DP-2514, DP-3346, ARQ736, XL281, RG7256, LGX818, PLX3603, trematinib, and/or ZM 336372.

In some embodiments, the BRAF inhibitor is Vemurafenib (also known as PLX4032, RG7204, R05185426). In one embodiment, Vemurafenib has the chemical name: N-(3-{[5-(4-chlorophenyl)-1H-pyrrolo[2,3-b]pyridin-3-yl]carbonyl}-2,4-difluorophenyl)propane-1-sulfonamide; and has the following structure:

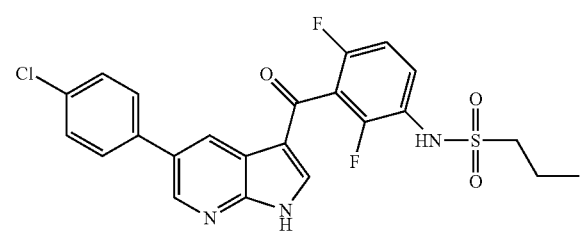 [SMILES: CCCS(=O)(=O)Nc1ccc(F)c(C(=O)c2c[nH]c3ncc(-c4ccc(Cl)cc4)cc23)c1F]

In some embodiments, the BRAF inhibitor is Sorafenib Tosylate (also known as Bay 43-9006, Nexavar). In one embodiment, Sorafenib has the chemical name: 2-Pyridinecarboxamide, 4-[4-[[[[4-chloro-3-(trifluoromethyl)phenyl]amino]carbonyl]amino]phenoxy]-N-methyl-, 4-methylbenzenesulfonate (1:1); and has the following structure:

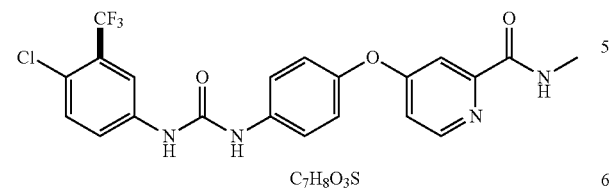

In some embodiments, the BRAF inhibitor is PLX4720. In one embodiment, PLX4720 has the chemical name: N-(3-(5-chloro-1H-pyrrolo[2,3-b]pyridine-3-carbonyl)-2,4-difluorophenyl)propane-1-sulfonamide; and has the following structure:

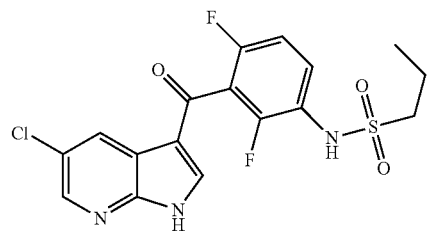 [SMILES: CCCS(=O)(=O)Nc1ccc(F)c(C(=O)c2c[nH]c3ncc(Cl)cc23)c1F]

In some embodiments, the BRAF inhibitor is GDC-0879. In one embodiment, GDC-0879 has the chemical name: (E)-5-(1-(2-hydroxyethyl)-3-(pyridin-4-yl)-1H-pyrazol-4-yl)-2,3-dihydroinden-1-one oxime; and has the following structure:

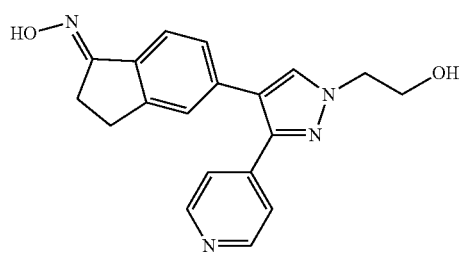 [SMILES: OCCn1cc(-c2ccc3c(c2)CC/C3=N\O)c(-c2ccncc2)n1]

In some embodiments, the BRAF inhibitor is RAF265 (CHJR-265). In one embodiment, RAF265 has the chemical name: 1-methyl-5-(2-(5-(trifluoromethyl)-1H-imidazol-2-yl)pyridin-4-yloxy)-N-(4-(trifluoromethyl)phenyl)-1H-benzo[d]imidazol-2-amine; and has the following structure:

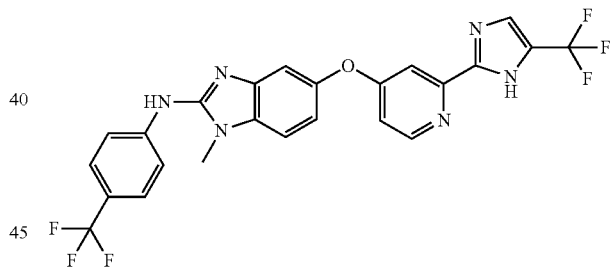

In some embodiments, the BRAF inhibitor is Raf265 derivative. In one embodiment, Raf265 derivative has the following structure:

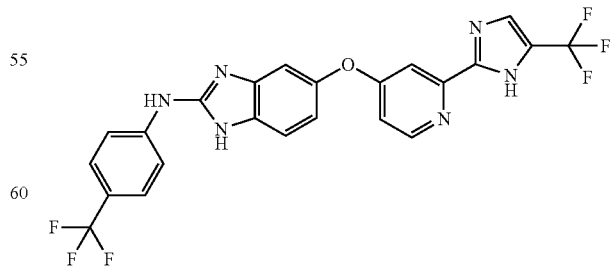

In some embodiments, the BRAF inhibitor is MLN2480 (BIIB-024). In one embodiment, MLN2480 is a pan-Raf inhibitor; has the chemical name: 4-Pyrimidinecarboxamide, 6-amino-5-chloro-N-[(1R)-1-[5-[[[5-chloro-4-(trifluoromethyl)-2-pyridinyl]amino]carbonyl]-2-thiazolyl]methyl]-; and has the following structure:

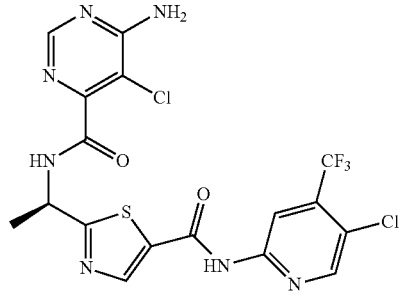 [SMILES: C[C@@H](NC(=O)c1ncnc(N)c1Cl)c1ncc(C(=O)Nc2cc(C(F)(F)F)c(Cl)cn2)s1]

In some embodiments, the BRAF inhibitor is PF-04880594. In one embodiment, PF-04880594 has the chemical name: Propanenitrile, 3-[[4-[1-(2,2-difluoroethyl)-3-(1H-pyrrolo[2,3-b]pyridin-5-yl)-1H-pyrazol-4-yl]-2-pyrimidinyl]amino]-; and has the following structure:

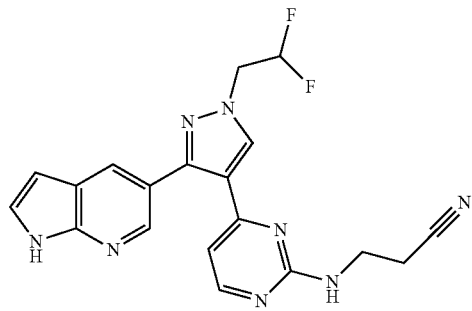 [SMILES: N#CCCNc1nccc(-c2cn(CC(F)F)nc2-c2cnc3[nH]ccc3c2)n1]

In some embodiments, the BRAF inhibitor is GW5074. In one embodiment, GW5074 has the chemical name: 2H-Indol-2-one, 3-[(3,5-dibromo-4-hydroxyphenyl)methylene]-1,3-dihydro-5-iodo-; and has the following structure:

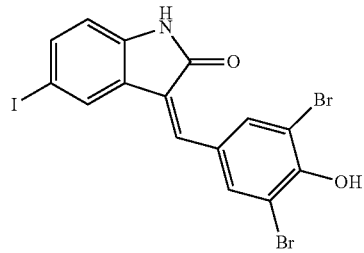 [SMILES: O=C1Nc2ccc(I)cc2/C1=C/c1cc(Br)c(O)c(Br)c1]

In some embodiments, the BRAF inhibitor is CEP-32496. In one embodiment, CEP-32496 has the chemical name: Urea, N-[3-[(6,7-dimethoxy-4-quinazolinyl)oxy]phenyl]-N'-[5-(2,2,2-trifluoro-1,1-dimethylethyl)-3-isoxazolyl]-; and has the following structure:

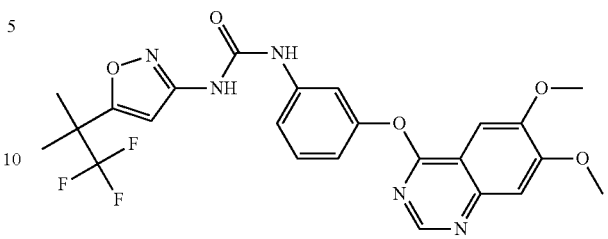

In some embodiments, the BRAF inhibitor is Dabrafenib (GSK2118436). In one embodiment, Dabrafenib has the chemical name: N-(3-(5-(2-aminopyrimidin-4-yl)-2-tert-butylthiazol-4-yl)-2-fluorophenyl)-2,6-difluorobenzenesulfonamide; and has the following structure:

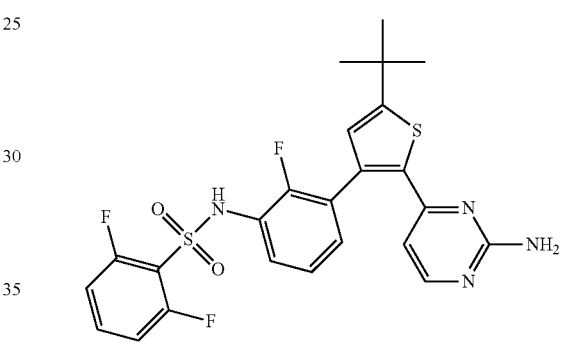

In some embodiments, the BRAF inhibitor is AZ628. In one embodiment, AZ628 has the chemical name: 3-(2-cyanopropan-2-yl)-N-(4-methyl-3-(3-methyl-4-oxo-3,4-dihydroquinazolin-6-ylamino)phenyl)benzamide; and has the following structure:

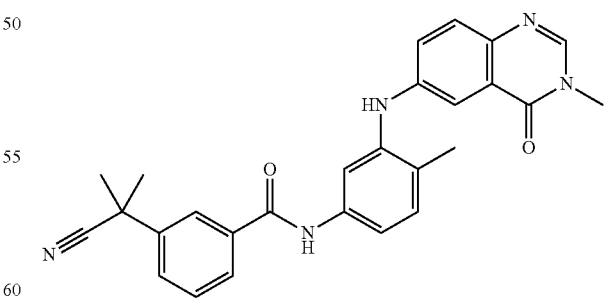

In some embodiments, the BRAF inhibitor is SB590885. In one embodiment, SB590885 has the chemical name: (E)-5-(2-(4-(2-(dimethylamino)ethoxy)phenyl)-4-(pyridin-4-yl)-1H-imidazol-5-yl)-2,3-dihydroinden-1-one oxime; and has the following structure:

401

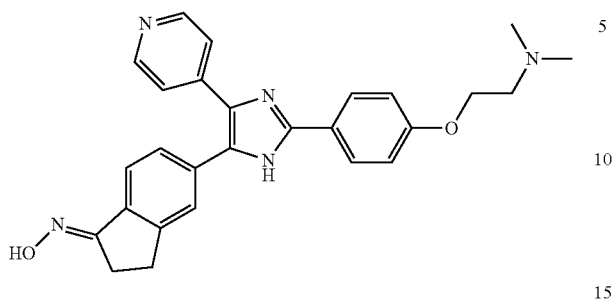

In some embodiments, the BRAF inhibitor is Regorafenib (also known as BAY 73-4506, Fluoro-Sorafenib). In one embodiment, Regorafenib has the chemical name: 1-(4-chloro-3-(trifluoromethyl)phenyl)-3-(2-fluoro-4-(2-(methylcarbamoyl)pyridin-4-yloxy)phenyl)urea; and has the following structure:

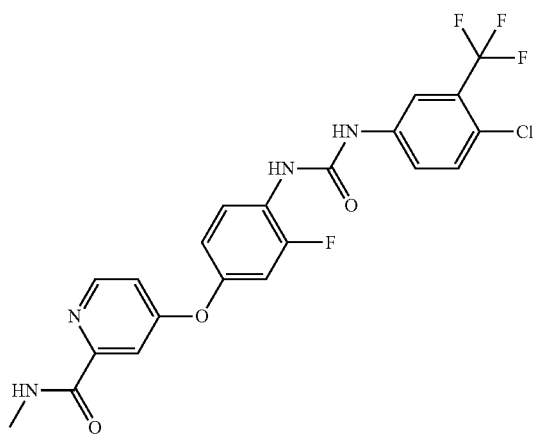 [SMILES: CNC(=O)c1cc(Oc2ccc(NC(=O)Nc3ccc(Cl)c(C(F)(F)F)c3)c(F)c2)ccn1]

In some embodiments, the BRAF inhibitor is ZM 336372. In one embodiment, ZM 336372 has the chemical name: Benzamide, 3-(dimethylamino)-N-[3-[(4-hydroxybenzoy) amino]-4-methylphenyl]-; and has the following structure:

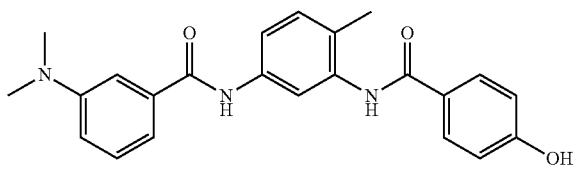 [SMILES: Cc1ccc(NC(=O)c2cccc(N(C)C)c2)cc1NC(=O)c1ccc(O)cc1]

In some embodiments, the BRAF inhibitor is LGX818. In one embodiment, LGX818 has the following chemical name Methyl[(2S)-1-{[4-(3-{5-chloro-2-fluoro-3-[(methylsulfonyl)amino]phenyl}-1-isopropyl-1H-pyrazol-4-yl)-2-pyrimidinyl]amino}-2-propanyl]carbamate; and the following structure:

402

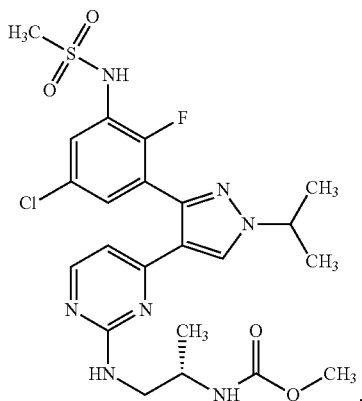

FGFR1 Inhibitors

In other embodiments, the agent is a FGFR1 inhibitor. In other embodiments, the FGFR1 inhibitor is chosen from: ponatinib (AP24534), BIBF1120 (Nintedanib), PD173074, danusertib (PHA-739358), dovitinib dilactic acid (TKI258 dilactic acid), TSU-68 (SU6668), brivanib (BMS-540215), tyrphostin AG 1296 (AG 1296), AZD4547, MK-2461, BGJ398 (NVP-BGJ398), dovitinib (TKI258, CHIR258), pazopanib (votrient), regorafenib (BAY 73-4506 and/or brivanib alaninate (BMS-582664).

In some embodiments, the FGFR1 inhibitor is ponatinib (AP24534). Ponatinib is a novel, potent multi-target inhibitor of Abl, PDGFRα, VEGFR2, FGFR1 and Src with IC50 of 0.37 nM, 1.1 nM, 1.5 nM, 2.2 nM and 5.4 nM, respectively. Ponatinib has the chemical name: 3-(2-(imidazo[1,2-b]pyridazin-3-yl)ethynyl)-4-methyl-N-(4-((4-methylpiperazin-1-yl)methyl)-3-(trifluoromethyl)phenyl)benzamide; and has the following structure:

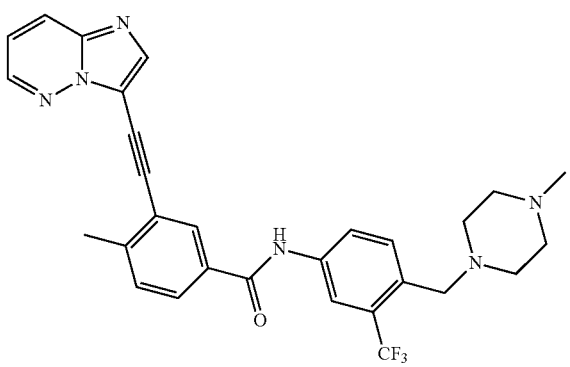

Ponatinib Chemical Structure
Molecular Weight: 532.56.

In some embodiments, the FGFR1 inhibitor is BIBF1120 (Nintedanib). Nintedanib is a potent triple angiokinase inhibitor for VEGFR1/2/3, FGFR1/2/3 and PDGFRα/P with IC50 of 34 nM/13 nM/13 nM, 69 nM/37 nM/108 nM and 59 nM/65 nM. BIBF1120 has the chemical name: (Z)-methyl 3-((4-(N-methyl-2-(4-methylpiperazin-1-yl)acetamido)phenylamino)(phenyl)methylene)-2-oxoindoline-6-carboxylate; and has the following structure:

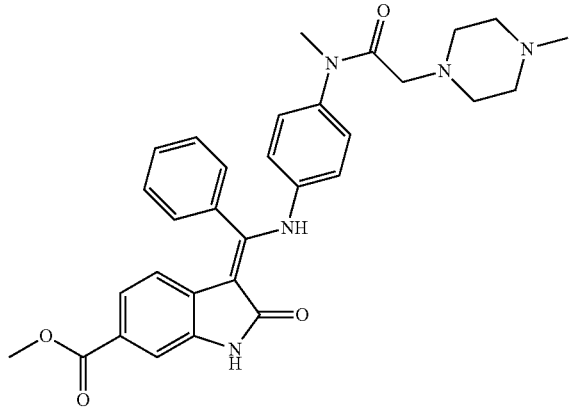

Nintedanib Chemical Structure
Molecular Weight: 539.62.

In some embodiments, the FGFR1 inhibitor is PD173074. PD173074 is a potent FGFR1 inhibitor with IC50 of ~25 nM and also inhibits VEGFR2 with IC50 of 100-200 nM, ~1000-fold selective for FGFR1 than PDGFR and c-Src. PD173074 has the chemical name: 1-tert-butyl-3-(2-(4-(diethylamino)butylamino)-6-(3,5-dimethoxyphenyl)pyrido[2,3-d]pyrimidin-7-yl)urea; and has the following structure:

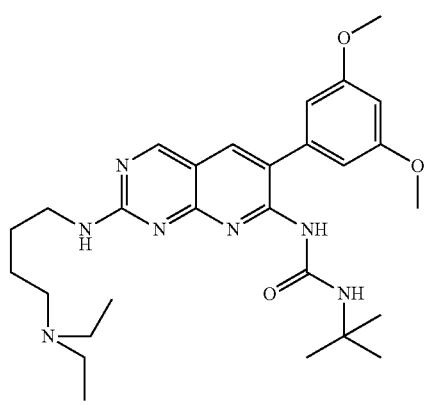

PD173074 Chemical Structure
Molecular Weight: 523.67.

In some embodiments, the FGFR1 inhibitor is danusertib (PHA-739358). Danusertib is an Aurora kinase inhibitor for Aurora A/B/C with IC50 of 13 nM/79 nM/61 nM, modestly potent to Abl, TrkA, c-RET and FGFR1, and less potent to Lck, VEGFR2/3, c-Kit, and CDK2. Danusertib has the chemical name: (R)—N-(5-(2-methoxy-2-phenylacetyl)-1,4,5,6-tetrahydropyrrolo[3,4-c]pyrazol-3-yl)-4-(4-methylpiperazin-1-yl)benzamide; and has the following structure:

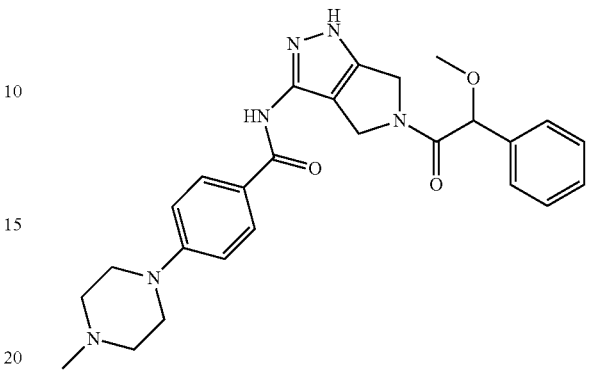

Danusertib Chemical Structure
Molecular Weight: 474.55.

In some embodiments, the FGFR1 inhibitor is dovitinib dilactic acid (TKI258 dilactic acid). Dovitinib dilactic acid is a multitargeted RTK inhibitor, mostly for class III (FLT3/c-Kit) with IC50 of 1 nM/2 nM, also potent to class IV (FGFR1/3) and class V (VEGFR1-4) RTKs with IC50 from 8-13 nM, less potent to InsR, EGFR, c-Met, EphA2, Tie2, IGFR1 and HER2. Dovitinib dilactic acid has the chemical name: Propanoic acid, 2-hydroxy-, compd. with 4-amino-5-fluoro-3-[6-(4-methyl-1-piperazinyl)-1H-benzimidazol-2-yl]-2(1H)-quinolinone; and has the following structure:

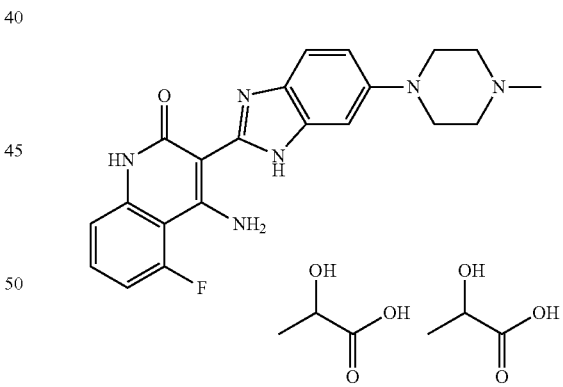

Dovitinib Dilactic Acid Chemical Structure
Molecular Weight: 572.59.

In some embodiments, the FGFR1 inhibitor is TSU-68 (SU6668). SU6668 has greatest potency against PDGFR autophosphorylation with K, of 8 nM, but also strongly inhibits Flk-1 and FGFR1 trans-phosphorylation, little activity against IGF-1R, Met, Src, Lck, Zap70, Abl and CDK2; and does not inhibit EGFR. SU6668 has the chemical name: (Z)-3-(2,4-dimethyl-5-((2-oxoindolin-3-ylidene)methyl)-1H-pyrrol-3-yl)propanoic acid; and has the following structure:

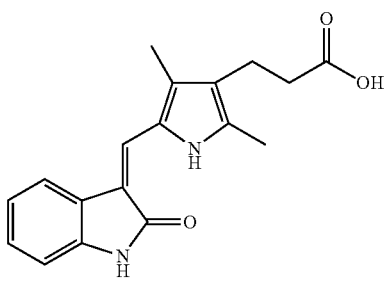

SU6668 Chemical Structure
Molecular Weight: 310.35.

In some embodiments, the FGFR1 inhibitor is brivanib (BMS-540215). Brivanib is an ATP-competitive inhibitor against VEGFR2 with IC50 of 25 nM, moderate potency against VEGFR-1 and FGFR-1, but >240-fold against PDGFR-β. Brivanib has the chemical name: (R)-1-(4-(4-fluoro-2-methyl-1H-indol-5-yloxy)-5-methylpyrrolo[1,2-f][1,2,4]triazin-6-yloxy)propan-2-ol; and has the following structure:

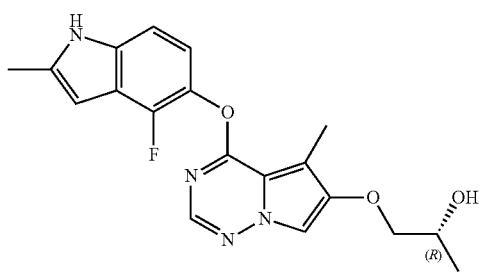

Brivanib Chemical Structure
Molecular Weight: 370.38.

In some embodiments, the FGFR1 inhibitor is tyrphostin AG 1296 (AG 1296). Tyrphostin AG 1296 (AG 1296) is an inhibitor of PDGFR with IC50 of 0.3-0.5 μM, no activity to EGFR. Tyrphostin AG 1296 has the chemical name: Quinoxaline, 6,7-dimethoxy-2-phenyl-; and has the following structure:

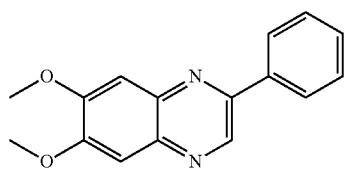

Tyrphostin AG 1296 Chemical Structure
Molecular Weight: 266.29.

In some embodiments, the FGFR1 inhibitor is AZD4547. AZD4547 is a novel selective FGFR inhibitor targeting FGFR1/2/3 with IC50 of 0.2 nM/2.5 nM/1.8 nM, weaker activity against FGFR4, VEGFR2(KDR), and little activity observed against IGFR, CDK2, and p38. AZD4547 has the chemical name: N-(5-(3,5-dimethoxyphenethyl)-1H-pyrazol-3-yl)-4-((3S,5R)-3,5-dimethylpiperazin-1-yl)benzamide; and has the following structure:

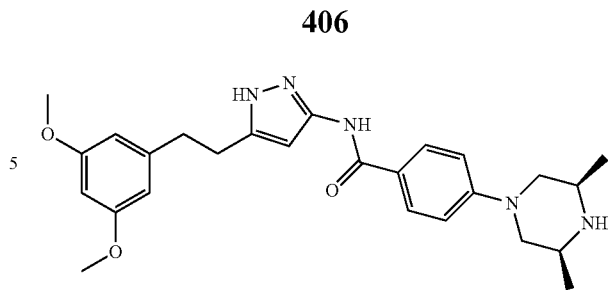

AZD4547 Chemical Structure
Molecular Weight: 463.57.

In some embodiments, the FGFR1 inhibitor is MK-2461. MK-2461 is a potent, multi-targeted inhibitor for c-Met (WT/mutants) with IC50 of 0.4-2.5 nM, less potent to Ron, Flt1; 8- to 30-fold greater selectivity of c-Met targets versus FGFR1, FGFR2, FGFR3, PDGFRβ, KDR, Flt3, Flt4, TrkA, and TrkB. MK-2461 has the chemical name: N-((2R)-1,4-Dioxan-2-ylmethyl)-N-methyl-N'-[3-(1-methyl-1H-pyrazol-4-yl)-5-oxo-5H-benzo[4,5]cyclohepta[1,2-b]pyridin-7-yl]sulfamide; and has the following structure:

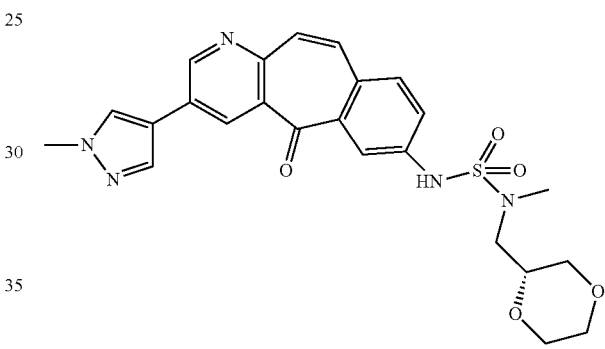

MK-2461 Chemical Structure
Molecular Weight: 495.55.

In some embodiments, the FGFR1 inhibitor is BGJ398 (NVP-BGJ398). BGJ398 is a potent and selective FGFR inhibitor for FGFR1/2/3 with IC50 of 0.9 nM/1.4 nM/1 nM, >40-fold selective for FGFR versus FGFR4 and VEGFR2, and little activity to Abl, Fyn, Kit, Lck, Lyn and Yes. BGJ398 has the chemical name: 3-(2,6-dichloro-3,5-dimethoxyphenyl)-1-(6-(4-(4-ethylpiperazin-1-yl)phenylamino)pyrimidin-4-yl)-1-methylurea; and has the following structure:

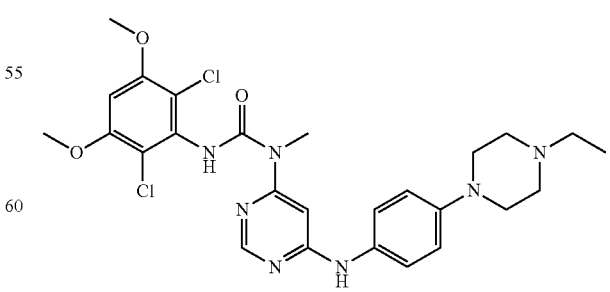

BGJ398 Chemical Structure
Molecular Weight: 560.48.

In some embodiments, the FGFR1 inhibitor is dovitinib (TKI258, CHIR258). Dovitinib (TKI258, CHIR258) is a multitargeted RTK inhibitor, mostly for class III (FLT3/c-Kit) with IC50 of 1 nM/2 nM, also potent to class IV (FGFR1/3) and class V (VEGFR1-4) RTKs with IC50 from 8-13 nM, less potent to InsR, EGFR, c-Met, EphA2, Tie2, IGF-1R and HER2.

Dovitinib has the chemical name: 1-amino-5-fluoro-3-(6-(4-methylpiperazin-1-yl)-1H-benzo[d]imidazol-2-yl)quinolin-2(1H)-one; and has the following structure:

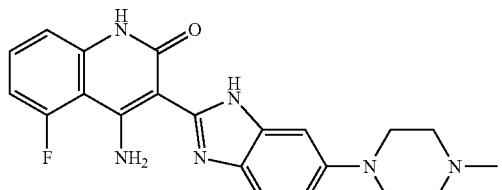

Dovitinib Chemical Structure
Molecular Weight: 392.43

In some embodiments, the FGFR1 inhibitor is brivanib alaninate (BMS-582664). Brivanib alaninate (BMS-582664) is the prodrug of BMS-540215, an ATP-competitive inhibitor against VEGFR2 with IC50 of 25 nM. Brivanib alaninate has the chemical name: (S)—((R)-1-(4-(4-fluoro-2-methyl-1H-indol-5-yloxy)-5-methylpyrrolo[1,2-f][1,2,4]triazin-6-yloxy)propan-2-yl) 2-aminopropanoate; and has the following structure:

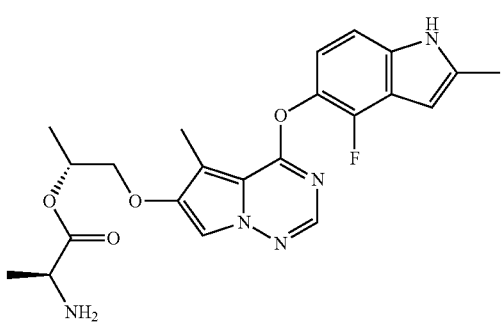

Brivanib Alaninate Chemical Structure
Molecular Weight: 441.46.

In some embodiments, the FGFR1 inhibitor is regorafenib. Regorafenib (BAY 73-4506) is a multi-target inhibitor for VEGFR1, VEGFR2, VEGFR3, PDGFRβ, Kit, RET and Raf-1 with IC50 of 13 nM/4.2 nM/46 nM, 22 nM, 7 nM, 1.5 nM and 2.5 nM, respectively. Regorafenib has the chemical name: 1-(4-chloro-3-(trifluoromethyl)phenyl)-3-(2-fluoro-4-(2-(methylcarbamoyl)pyridin-4-yloxy)phenyl) urea; and has the following structure:

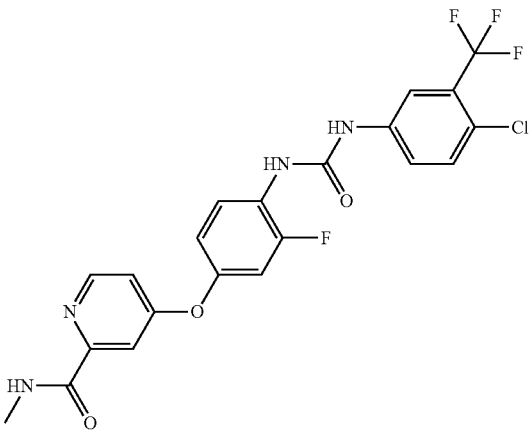

Regorafenib Chemical Structure
Molecular Weight: 482.82.

In some embodiments, the FGFR1 inhibitor is pazopanib. Pazopanib is a tyrosine kinase inhibitor (TKI). Pazopanib has the chemical name: 5-[[4-[(2,3-dimethyl-2H-indazol-6yl)methylamino]-2-pyrimidinyl]amino]-2-methylbenzenesulfonamide monohydrochloride; and has the following structure:

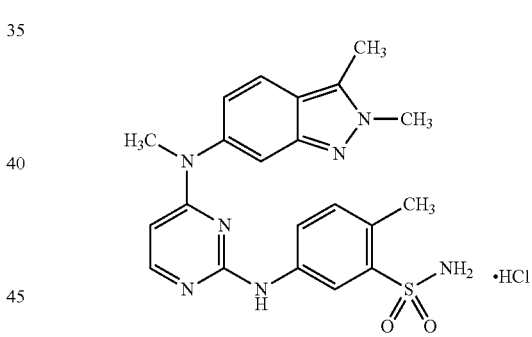

Pazopanib Chemical Structure
Molecular Weight: 473.99.

FGFR2 Inhibitors

In other embodiments, the agent is a FGFR2 inhibitor. In other embodiments, the FGFR1 inhibitor is chosen from: ponatinib (AP24534), BIBF1120 (Nintedanib), PD173074, danusertib (PHA-739358), dovitinib dilactic acid (TKI258 dilactic acid), TSU-68 (SU6668), brivanib (BMS-540215), tyrphostin AG 1296 (AG 1296), AZD4547, MK-2461, BGJ398 (NVP-BGJ398), dovitinib (TKI258, CHIR258), pazopanib (votrient), regorafenib (BAY 73-4506 and/or brivanib alaninate (BMS-582664).

In some embodiments, the FGFR2 inhibitor is ponatinib (AP24534). Ponatinib is a novel, potent multi-target inhibitor of Abl, PDGFRα, VEGFR2, FGFR1 and Src with IC50 of 0.37 nM, 1.1 nM, 1.5 nM, 2.2 nM and 5.4 nM, respectively. Ponatinib has the chemical name: 3-(2-(imidazo[1,2-b]pyridazin-3-yl)ethynyl)-4-methyl-N-(4-((4-methylpiperazin-1-yl)methyl)-3-(trifluoromethyl)phenyl)benzamide; and has the following structure:

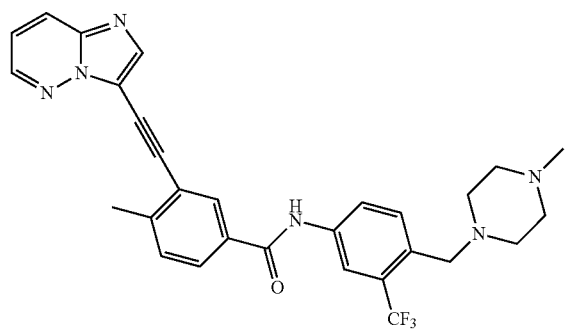

Ponatinib Chemical Structure
Molecular Weight: 532.56.

In some embodiments, the FGFR2 inhibitor is BIBF1120 (Nintedanib). Nintedanib is a potent triple angiokinase inhibitor for VEGFR1/2/3, FGFR1/2/3 and PDGFRα/β with IC50 of 34 nM/13 nM/13 nM, 69 nM/37 nM/108 nM and 59 nM/65 nM. BIBF1120 has the chemical name: (Z)-methyl 3-((4-(N-methyl-2-(4-methylpiperazin-1-yl)acetamido)phenylamino)(phenyl)methylene)-2-oxoindoline-6-carboxylate; and has the following structure:

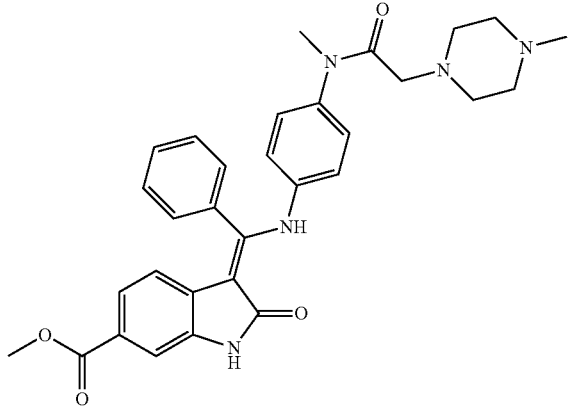

Nintedanib Chemical Structure
Molecular Weight: 539.62.

In some embodiments, the FGFR2 inhibitor is PD173074. PD173074 is a potent FGFR1 inhibitor with IC50 of ~25 nM and also inhibits VEGFR2 with IC50 of 100-200 nM, ~1000-fold selective for FGFR1 than PDGFR and c-Src. PD173074 has the chemical name: 1-tert-butyl-3-(2-(4-(diethylamino)butylamino)-6-(3,5-dimethoxyphenyl)pyrido[2,3-d]pyrimidin-7-yl)urea; and has the following structure:

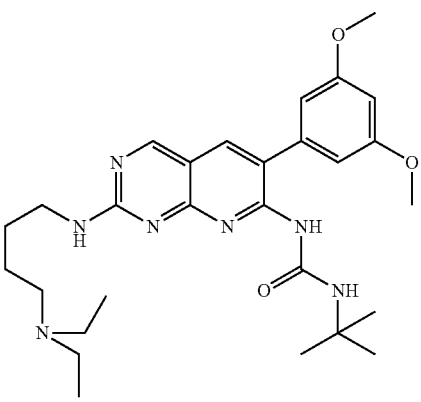

PD173074 Chemical Structure
Molecular Weight: 523.67.

In some embodiments, the FGFR2 inhibitor is danusertib (PHA-739358). Danusertib is an Aurora kinase inhibitor for Aurora A/B/C with IC50 of 13 nM/79 nM/61 nM, modestly potent to Abl, TrkA, c-RET and FGFR1, and less potent to Lck, VEGFR2/3, c-Kit, and CDK2. Danusertib has the chemical name: (R)—N-(5-(2-methoxy-2-phenylacetyl)-1,4,5,6-tetrahydropyrrolo[3,4-c]pyrazol-3-yl)-4-(4-methylpiperazin-1-yl)benzamide; and has the following structure:

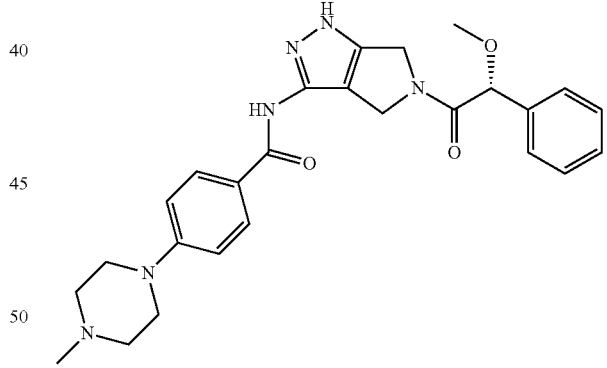

Danusertib Chemical Structure
Molecular Weight: 474.55.

In some embodiments, the FGFR2 inhibitor is dovitinib dilactic acid (TKI258 dilactic acid). Dovitinib dilactic acid is a multitargeted RTK inhibitor, mostly for class III (FLT3/c-Kit) with IC50 of 1 nM/2 nM, also potent to class IV (FGFR1/3) and class V (VEGFR1-4) RTKs with IC50 from 8-13 nM, less potent to InsR, EGFR, c-Met, EphA2, Tie2, IGFR1 and HER2. Dovitinib dilactic acid has the chemical name: Propanoic acid, 2-hydroxy-, compd. with 4-amino-5-fluoro-3-[6-(4-methyl-1-piperazinyl)-1H-benzimidazol-2-yl]-2(1H)-quinolinone; and has the following structure:

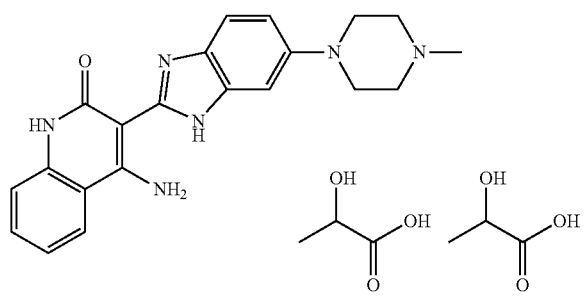

Dovitinib Dilactic Acid Chemical Structure
Molecular Weight: 572.59.

In some embodiments, the FGFR2 inhibitor is TSU-68 (SU6668). SU6668 has greatest potency against PDGFR autophosphorylation with K, of 8 nM, but also strongly inhibits Flk-1 and FGFR1 trans-phosphorylation, little activity against IGF-1R, Met, Src, Lck, Zap70, Abl and CDK2; and does not inhibit EGFR. SU6668 has the chemical name: (Z)-3-(2,4-dimethyl-5-((2-oxoindolin-3-ylidene)methyl)-1H-pyrrol-3-yl)propanoic acid; and has the following structure:

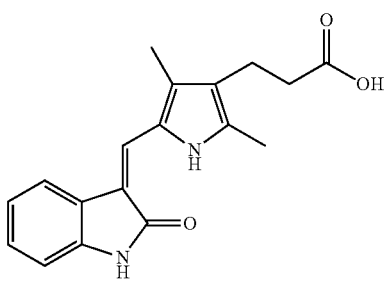

SU6668 Chemical Structure
Molecular Weight: 310.35.

In some embodiments, the FGFR2 inhibitor is brivanib (BMS-540215). Brivanib is an ATP-competitive inhibitor against VEGFR2 with IC50 of 25 nM, moderate potency against VEGFR-1 and FGFR-1, but >240-fold against PDGFR-β. Brivanib has the chemical name: (R)-1-(4-(4-fluoro-2-methyl-1H-indol-5-yloxy)-5-methylpyrrolo[1,2-f][1,2,4]triazin-6-yloxy)propan-2-ol; and has the following structure:

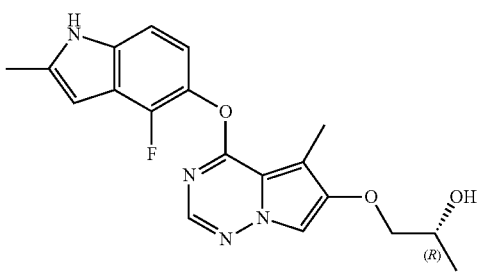

Brivanib Chemical Structure
Molecular Weight: 370.38.

In some embodiments, the FGFR2 inhibitor is tyrphostin AG 1296 (AG 1296). Tyrphostin AG 1296 (AG 1296) is an inhibitor of PDGFR with IC50 of 0.3-0.5 µM, no activity to EGFR. Tyrphostin AG 1296 has the chemical name: Quinoxaline, 6,7-dimethoxy-2-phenyl-; and has the following structure:

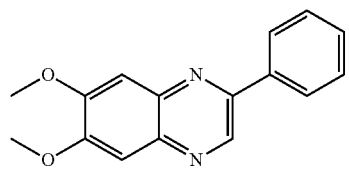

Tyrphostin AG 1296 Chemical Structure
Molecular Weight: 266.29.

In some embodiments, the FGFR1 inhibitor is AZD4547. AZD4547 is a novel selective FGFR inhibitor targeting FGFR1/2/3 with IC50 of 0.2 nM/2.5 nM/1.8 nM, weaker activity against FGFR4, VEGFR2(KDR), and little activity observed against IGFR, CDK2, and p38. AZD4547 has the chemical name: N-(5-(3,5-dimethoxyphenethyl)-1H-pyrazol-3-yl)-4-((3S,5R)-3,5-dimethylpiperazin-1-yl)benzamide; and has the following structure:

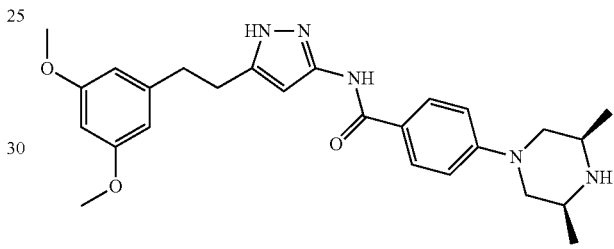

AZD4547 Chemical Structure
Molecular Weight: 463.57.

In some embodiments, the FGFR2 inhibitor is MK-2461. MK-2461 is a potent, multi-targeted inhibitor for c-Met (WT/mutants) with IC50 of 0.4-2.5 nM, less potent to Ron, Flt1; 8- to 30-fold greater selectivity of c-Met targets versus FGFR1, FGFR2, FGFR3, PDGFRβ, KDR, Flt3, Flt4, TrkA, and TrkB. MK-2461 has the chemical name: N-((2R)-1,4-Dioxan-2-ylmethyl)-N-methyl-N'-[3-(1-methyl-1H-pyrazol-4-yl)-5-oxo-5H-benzo[4,5]cyclohepta[1,2-b]pyridin-7-yl]sulfamide; and has the following structure:

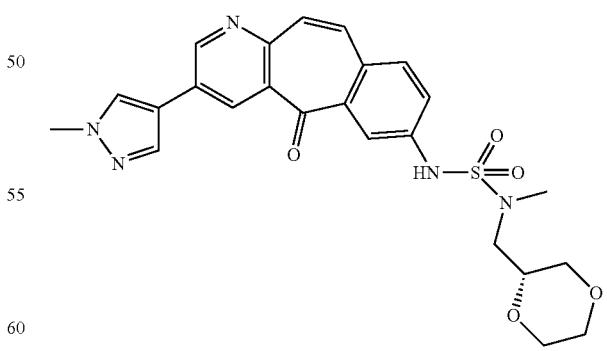

MK-2461 Chemical Structure
Molecular Weight: 495.55.

In some embodiments, the FGFR2 inhibitor is BGJ398 (NVP-BGJ398). BGJ398 is a potent and selective FGFR inhibitor for FGFR1/2/3 with IC50 of 0.9 nM/1.4 nM/1 nM, >40-fold selective for FGFR versus FGFR4 and VEGFR2, and little activity to Abl, Fyn, Kit, Lck, Lyn and Yes. BGJ398 has the chemical name: 3-(2,6-dichloro-3,5-dimethoxyphenyl)-1-(6-(4-(4-ethylpiperazin-1-yl)phenylamino)pyrimidin-4-yl)-1-methylurea; and has the following structure:

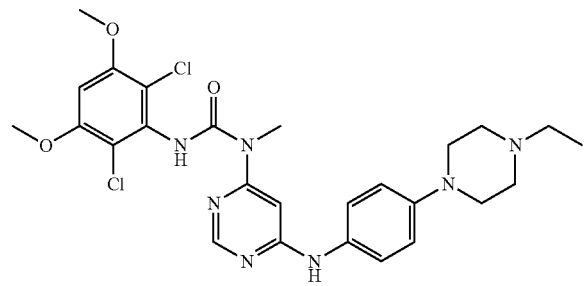

BGJ398 Chemical Structure
Molecular Weight: 560.48.

In some embodiments, the FGFR2 inhibitor is dovitinib (TKI258, CHIR258). Dovitinib (TKI258, CHIR258) is a multitargeted RTK inhibitor, mostly for class III (FLT3/c-Kit) with IC50 of 1 nM/2 nM, also potent to class IV (FGFR1/3) and class V (VEGFR1-4) RTKs with IC50 from 8-13 nM, less potent to InsR, EGFR, c-Met, EphA2, Tie2, IGF-1R and HER2. Dovitinib has the chemical name: 1-amino-5-fluoro-3-(6-(4-methylpiperazin-1-yl)-1H-benzo[d]imidazol-2-yl)quinolin-2(1H)-one; and has the following structure:

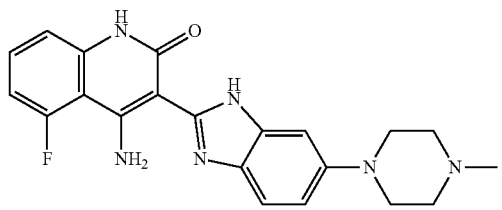

Dovitinib Chemical Structure
Molecular Weight: 392.43

In some embodiments, the FGFR2 inhibitor is brivanib alaninate (BMS-582664). Brivanib alaninate (BMS-582664) is the prodrug of BMS-540215, an ATP-competitive inhibitor against VEGFR2 with IC50 of 25 nM. Brivanib alaninate has the chemical name: (S)—((R)-1-(4-(4-fluoro-2-methyl-1H-indol-5-yloxy)-5-methylpyrrolo[1,2-f][1,2,4]triazin-6-yloxy)propan-2-yl) 2-aminopropanoate; and has the following structure:

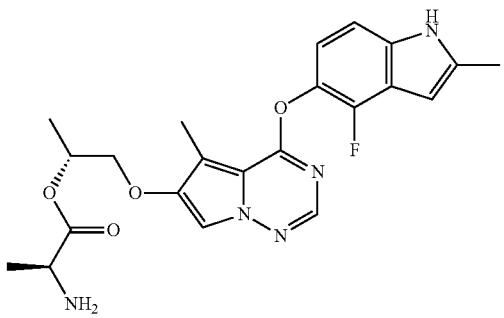

Brivanib Alaninate Chemical Structure
Molecular Weight: 441.46.

In some embodiments, the FGFR2 inhibitor is regorafenib. Regorafenib (BAY 73-4506) is a multi-target inhibitor for VEGFR1, VEGFR2, VEGFR3, PDGFRP, Kit, RET and Raf-1 with IC50 of 13 nM/4.2 nM/46 nM, 22 nM, 7 nM, 1.5 nM and 2.5 nM, respectively. Regorafenib has the chemical name: 1-(4-chloro-3-(trifluoromethyl)phenyl)-3-(2-fluoro-4-(2-(methylcarbamoyl)pyridin-4-yloxy)phenyl)urea; and has the following structure:

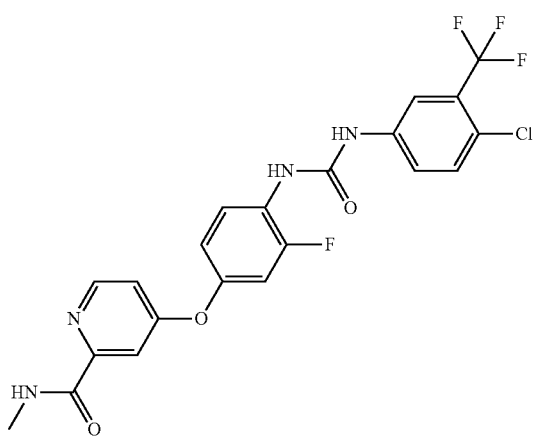

Regorafenib Chemical Structure
Molecular Weight: 482.82.

In some embodiments, the FGFR2 inhibitor is pazopanib. Pazopanib is a tyrosine kinase inhibitor (TKI). Pazopanib has the chemical name: 5-[[4-[(2,3-dimethyl-2H-indazol-6yl)methylamino]-2-pyrimidinyl]amino]-2-methylbenzenesulfonamide monohydrochloride; and has the following structure:

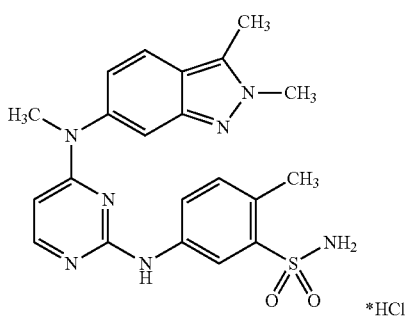

Pazopanib Chemical Structure
Molecular Weight: 473.99.

MYCN Inhibitors

In one embodiment, the agent is; a MYCN inhibitor. In other embodiments, the agent is an aurora kinase inhibitor. In other embodiments, the MYCN inhibitor is chosen from: AMG 900 and/or MLN8237 (alisertib).

In some embodiments, the MYCN inhibitor is AMG 900. AMG 900 is a potent and highly selective pan-Aurora kinases inhibitor for Aurora A/B/C with IC50 of 5 nM/4 nM/1 nM. It is >10-fold selective for Aurora kinases than p38α, Tyk2, JNK2, Met and Tie2. Phase 1. AMG 900 has the chemical name: N-(4-(3-(2-aminopyrimidin-4-yl)pyridin-2-yloxy)phenyl)-4-(4-methylthiophen-2-yl)phthalazin-1-amine; and has the following structure:

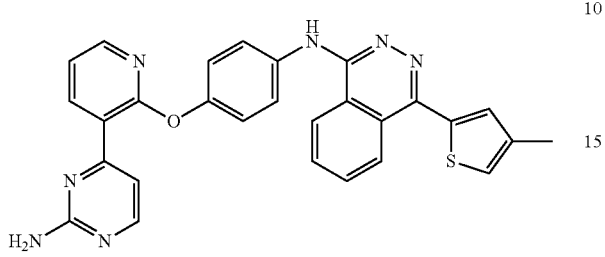

AMG 900 Chemical Structure
Molecular Weight: 503.58.

In some embodiments, the MYCN inhibitor is MLN8237 (alisertib). MLN8237 (alisertib) is a selective Aurora A inhibitor with IC50 of 1.2 nM. It has >200-fold higher selectivity for Aurora A than Aurora B. MLN8237 (alisertib) has the chemical name: Benzoic acid, 4-[[9-chloro-7-(2-fluoro-6-methoxyphenyl)-5H-pyrimido[5,4-d][2]benzazepin-2-yl]amino]-2-methoxy-; and has the following structure:

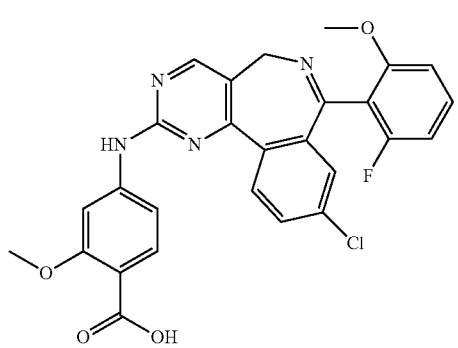

MLN8237 Chemical Structure
Molecular Weight: 529.01.

ALK Inhibitors

In one embodiment, the agent is an ALK inhibitor. In other embodiments, the ALK inhibitor is chosen from: Crizotinib (PF-2341066); LDK378; TAE684 (NVP-TAE684); CH5424802 (AF802, R05424802); GSK1838705A; or AZD-3463.

In some embodiments, the ALK inhibitor is Crizotinib (PF-2341066). Crizotinib is a potent inhibitor of c-Met and ALK with IC50 of 11 nM and 24 nnM, respectiv1EY. Crizotinib has the chemical name: 3-((R)-1-(2,6-dichloro-3-fluorophenyl)ethoxy)-5-(1-(piperidin-4-yl)-1H-pyrazol-4-yl)pyridin-2-amine; and has the following structure:

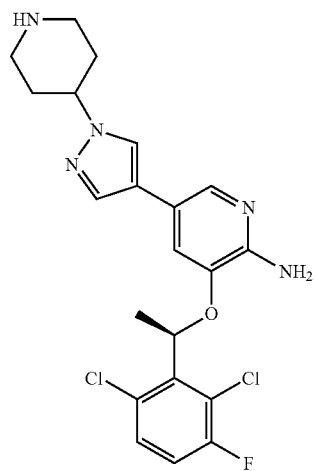

Crizotinib Chemical Structure
Molecular Weight: 450.34.

In some embodiments, the ALK inhibitor is AP26113. AP26113 is a potent ALK inhibitor with IC50 of 0.62 nM, demonstrated ability overcome Crizotinib resistance mediated by a L1196M mutation. AP26113 has the chemical name: 2,4-Pyrimidinediamine, 5-chloro-N2-[4-[4-(dimethylamino)-1-piperidinyl]-2-methoxyphenyl]-N4-[2-(dimethylphosphinyl)phenyl]-; and has the following structure:

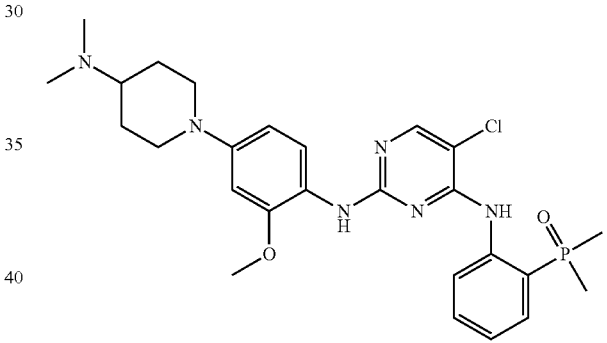

AP26113 Chemical Structure
Molecular Weight: 529.01.

In some embodiments, the ALK inhibitor is LDK378. LDK378 is potent against ALK with IC50 of 0.2 nM, selectivity against these off-targets is 80-, 70- and 230-fold, respectively. LDK378 has the chemical name: 2,4-Pyrimidinediamine, 5-chloro-N4-[2-[(1-methylethyl)sulfonyl]phenyl]-N2-[5-methyl-2-(1-methylethoxy)-4-(4-piperidinyl)phenyl]-; and has the following structure:

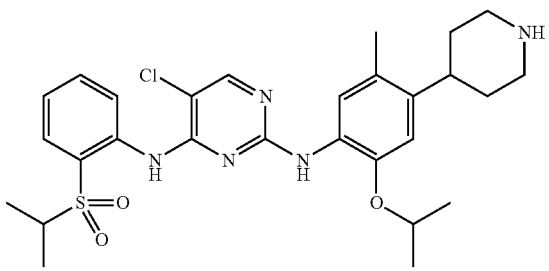

LDK378 Chemical Structure
Molecular Weight: 558.14.

In some embodiments, the ALK inhibitor is TAE684 (NVP-TAE684). TAE684 is a potent and selective ALK inhibitor with IC50 of 3 nM, 100-fold more sensitive for ALK than InsR. TAE684 has the chemical name: 5-chloro-N4-(2-(isopropylsulfonyl)phenyl)-N2-(2-methoxy-4-(4-(4-methylpiperazin-1-yl)piperidin-1-yl)phenyl)pyrimidine-2,4-diamine; and has the following structure:

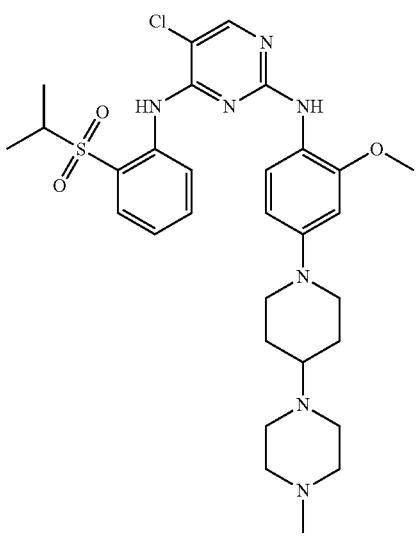

TAE684 Chemical Structure
Molecular Weight: 614.2.

In some embodiments, the ALK inhibitor is CH5424802 (AF802, RO5424802). CH5424802 is a potent ALK inhibitor with IC50 of 1.9 nM, sensitive to L1196M mutation and higher selectivity for ALK than PF-02341066, NVP-TAE684 and PHA-E429. CH5424802 has the chemical name: 9-ethyl-6,6-dimethyl-8-(4-morpholinopiperidin-1-yl)-11-oxo-6,11-dihydro-5H-benzo[b]carbazole-3-carbonitrile; and has the following structure:

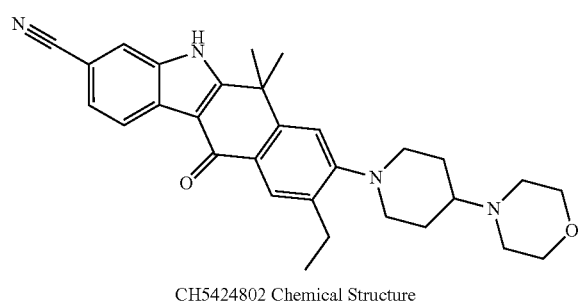

CH5424802 Chemical Structure
Molecular Weight: 482.62.

In some embodiments, the ALK inhibitor is GSK1838705A. GSK1838705A is a potent IGF-1R inhibitor with IC50 of 2.0 nM, modestly potent to IR and ALK with IC50 of 1.6 nM and 0.5 nM, respectively, and little activity to other protein kinases. GSK1838705A has the chemical name: 2-(2-O-(2-(dimethylamino)acetyl)-5-methoxyindolin-6-ylamino)-7H-pyrrolo[2,3-d]pyrimidin-4-ylamino)-6-fluoro-N-methylbenzamide; and has the following structure:

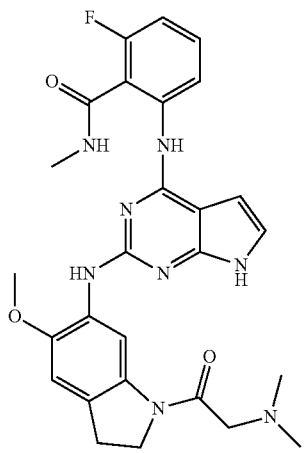

GSK1838705A Chemical Structure
Molecular Weight: 532.47.

In some embodiments, the ALK inhibitor is AZD-3463. AZD-3463 is an inhibitor of ALK with IC50 of 22 nM. AZD-3463 has the chemical name: 2-Pyrimidinamine, N-[4-(4-amino-1-piperidinyl)-2-methoxyphenyl]-5-chloro-4-(1H-indol-3-yl)-; and has the following structure:

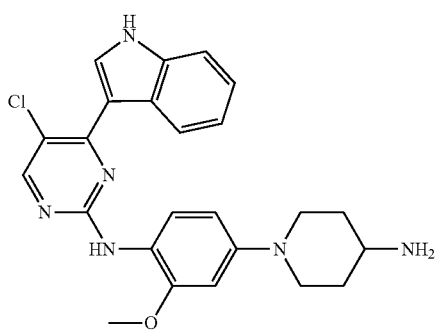

AZD-3463 Chemical Structure
Molecular Weight: 448.95.

CDK Inhibitors

In other embodiments, the agent is a CDK4 and/or CDK6 inhibitor. In other embodiments, the CDK4 and/or CDK6 inhibitor is chosen from: LEE011 (Novartis), LY-2835219, BAY 1000394 or PD 0332991 (Pfizer).

In certain embodiments the CDK4 and/or CDK6 inhibitor is LEE011. LEE011 is an orally available cyclin-dependent kinase (CDK) inhibitor targeting cyclin D1/CDK4 and cyclin D3/CDK6 cell cycle pathway. CDK4/6 inhibitor LEE011 specifically inhibits CDK4 and 6. LEE011 has the chemical name: 4-(5-chloro-3-isopropyl-1H-pyrazol-4-yl)-N-(5-(4-(dimethylamino)piperidin-1-yl)pyridin-2-yl)pyrimidin-2-amine; and has the following structure:

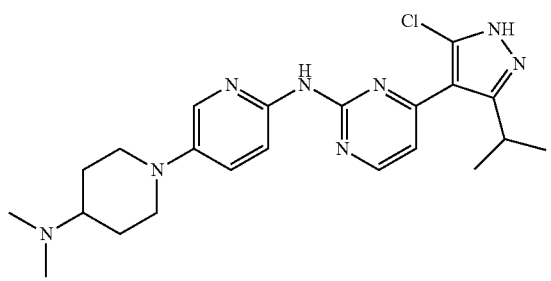

LEE011 Chemical Structure
Molecular Weight: 440.97.

In certain embodiments the CDK4 and/or CDK6 inhibitor is LY-2835219. LY2835219 is a potent and selective inhibitor of CDK4 and CDK6 with IC50 of 2 nM and 10 nM, respectively. LY-2835219 has the chemical name: 2-Pyrimidinamine, N-[5-[(4-ethyl-1-piperazinyl)methyl]-2-pyridinyl]-5-fluoro-4-[4-fluoro-2-methyl-1-(1-methylethyl)-1H-benzimidazol-6-yl]-, methanesulfonate (1:1); and has the following structure:

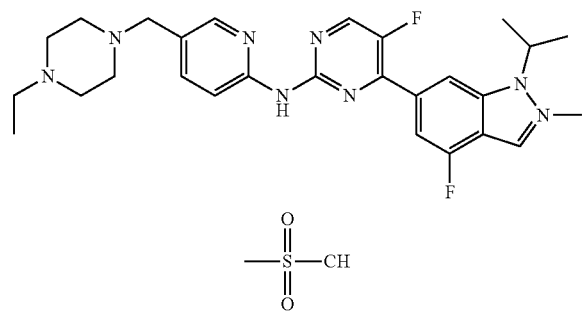

LY-2835219 Chemical Structure
Molecular Weight: 602.7.

In certain embodiments the cell cycle kinase inhibitor is PD0332991 (Palbociclib) Isethionate. PD0332991 Isethionate is a highly selective inhibitor of CDK4/6 with IC50 of 11 nM/16 nM. It shows no activity against CDK1/2/5, EGFR, FGFR, PDGFR, and InsR. PD0332991 has the chemical name: Ethanesulfonic acid, 2-hydroxy-, compd. with 6-acetyl-8-cyclopentyl-5-methyl-2-[[5-(1-piperazinyl)-2-pyridinyl]amino]pyrido[2,3-d]pyrimidin-7(8H)-one (1:1); and has the following structure:

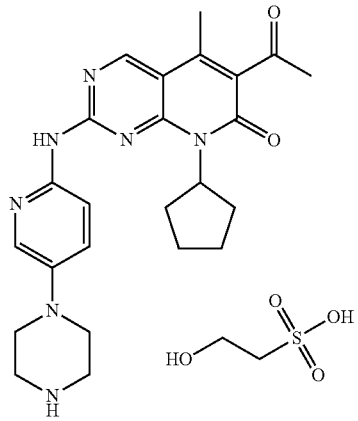

PD0332991 Chemical Structure
Molecular Weight: 573.66.

In certain embodiments the cell cycle kinase inhibitor is BAY1000394. BAY 1000394 is an orally bioavailable pan-CDK inhibitor for CDK1/2/3/4/7/9 with IC50 of 5-25 nM. It also potently inhibits Aurora A, Clk2, ARKS, FGFR1, Flt3, and JAK2/3. BAY1000394 has the chemical name: 2-Butanol, 3-[[2-[[4-[[S(R)]—S-cyclopropylsulfonimidoyl]phenyl]amino]-5-(trifluoromethyl)-4-pyrimidinyl]oxy]-, (2R, 3R)—; and has the following structure:

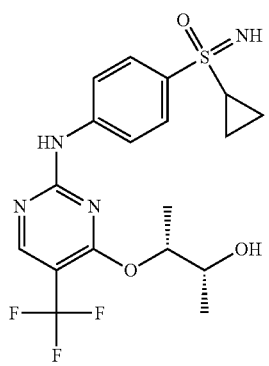

BAY1000394 Chemical Structure
Molecular Weight: 430.44.

NTRK1 Inhibitors

In other embodiments, the agent is an NTRK1 inhibitor. In other embodiments, the NTRK1 inhibitor is chosen from: danusertib (PHA-739358); lestaurtinib (CEP-701); AZ-23; indenopyrrolocarboazole 12a; oxindole 3; isothiazole 5n; thiazole 20 h.

In some embodiments, the NTRK1 inhibitor is danusertib (PHA-739358). Danusertib is an Aurora kinase inhibitor for Aurora A/B/C with IC50 of 13 nM/79 nM/61 nM, modestly potent to Abl, TrkA, c-RET and FGFR1, and less potent to Lck, VEGFR2/3, c-Kit, and CDK2. Danusertib has the chemical name: (R)—N-(5-(2-methoxy-2-phenylacetyl)-1,4,5,6-tetrahydropyrrolo[3,4-c]pyrazol-3-yl)-4-(4-methylpiperazin-1-yl)benzamide; and has the following structure:

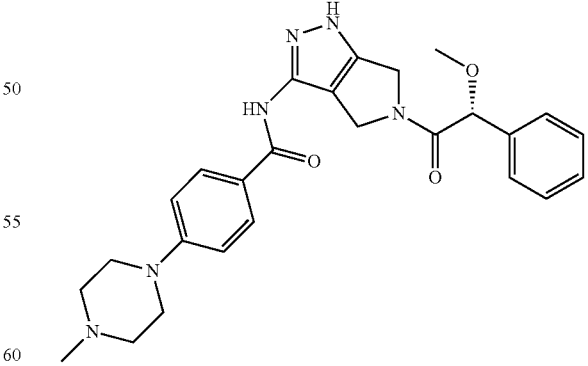

Danusertib Chemical Structure
Molecular Weight: 474.55.

In certain embodiments the NTRK1 inhibitor is lestaurtinib. Lestaurtinib is a otent JAK2, FLT3 and TrkA inhibitor (IC50 values are 0.9, 3 and <25 nM respectively) that prevents STATS phosphorylation (IC$_5$O=20-30 nM). Exhibits antiproliferative activity in vitro (IC50=30-100 nM in HEL92.1.7 cells) and is effective against myeloproliferative disorders in vivo. Lestaurtinib has the chemical name: (9S,10S,12R)-2,3,9,10,11,12-Hexahydro-10-hydroxy-10-(hydroxymethyl)-9-methyl-9,12-epoxy-1H-diindolo[1,2,3-fg:3', 2',1'-kl]pyrrolo[3,4-i][1, 6]benzodiazocin-1-one; and has the following structure:

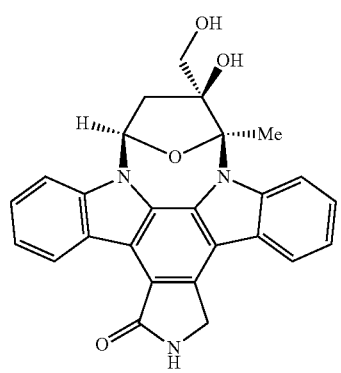

Lestaurtinib Chemical Structure
Molecular Weight: 439.46.

In certain embodiments the NTRK1 inhibitor is PHA-848125 (Milciclib). Milciclib is an orally bioavailable inhibitor of cyclin-dependent kinases (CDKs) and thropomyosin receptor kinase A (TRKA), with potential antineoplastic activity. CDK2/TRKA inhibitor PHA-848125 AC potently inhibits cyclin-dependent kinase 2 (CDK2) and exhibits activity against other CDKs including CDK1 and CDK4, in addition to TRKA. PHA-848125 (Milciclib) has the chemical name: N,1,4,4-tetramethyl-8-((4-(4-methylpiperazin-1-yl)phenypamino)-4,5-dihydro-1H-pyrazolo[4,3-h]quinazoline-3-carboxamide; and has the following structure:

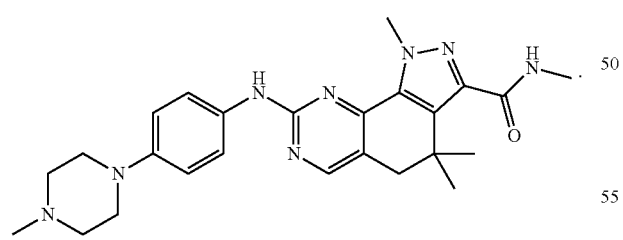

Milciclib Chemical Structure
Molecular Weight: 460.57

In certain embodiments the NTRK1 inhibitor is K252a. K252a is an analog of Staurosporine (Cat. No. 1048) that acts as a non-selective protein kinase inhibitor. Inhibits PKA (Ki=18 nM), PKC (Ki=25 nM), and PKG (Ki=20 nM). Potently inhibits CaMK (Ki=1.8 nM), competitively with ATP and noncompetitively with the substrate. K252a has the following structure:

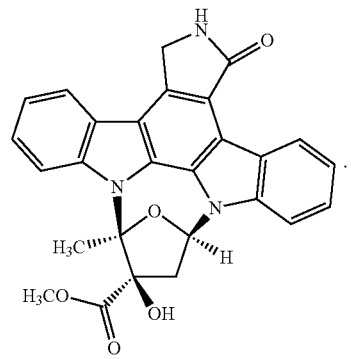

K252a Chemical Structure
Molecular Weight: 467.47

In certain embodiments the NTRK1 inhibitor is AZ-23. AZ-23 is a potent and selective tyrosine kinase Trk inhibitor with IC50 to 2 and 8 nM for TrkA and TrkB respectively; AZ-23 showed in vivo TrkA kinase inhibition and efficacy in mice following oral administration; having potential for therapeutic utility in neuroblastoma and multiple other cancer indications. AZ-23 has the chemical name: 5-chloro-N-[(1S)-1-(5-fluoropyridin-2-yl)ethyl]-M-(5-propan-2-yloxy-1H-pyrazol-3-yl)pyrimidine-2,4-diamine; and has the following structure:

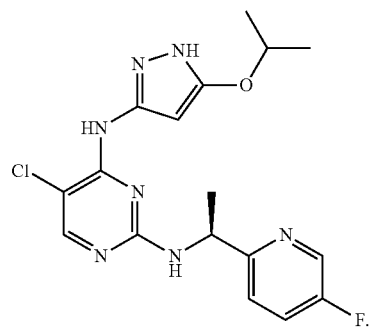

AZ-23 Chemical Structure
Molecular Weight: 391.83

In certain embodiments the NTRK1 inhibitor is oxindole 3. Oxindole 3 has the chemical name: 1,2 Dihydro-3H-indol-3-one; and has the following structure:

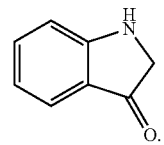

Oxindole 3 Chemical Structure
Molecular Weight: 133.147

FGFR3 Inhibitors

In other embodiments, the agent is a FGFR3 inhibitor. In other embodiments, the FGFR3 inhibitor is chosen from: TKI258 (dovitinib); AP24534 (ponatinib); AZD4547; FP-1039 (GSK3052230) (HGS1036); XL9999; BIBF1120 (Nintedanib; brivanib (BMS-582664); ponatinib; or BGJ398 (NVP-BGJ398).

In certain embodiments the FGFR3 inhibitor is Dovitinib. Dovitinib (TKI258, CHIR258) is a multitargeted RTK inhibitor, mostly for class III (FLT3/c-Kit) with IC50 of 1 nM/2 nM, also potent to class IV (FGFR1/3) and class V (VEGFR1-4) RTKs with IC50 of 8-13 nM, less potent to InsR, EGFR, c-Met, EphA2, Tie2, IGF-1R and HER2. Dovitinib has the chemical name: 1-amino-5-fluoro-3-(6-(4-methylpiperazin-1-yl)-1H-benzo[d]imidazol-2-yl)quinolin-2(1H)-one; and has the following structure:

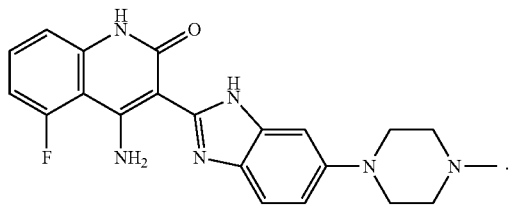

Dovitinib Chemical Structure
Molecular Weight: 392.43

In some embodiments, the FGFR3 inhibitor is brivanib (BMS-540215). Brivanib is an ATP-competitive inhibitor against VEGFR2 with IC50 of 25 nM, moderate potency against VEGFR-1 and FGFR-1, but >240-fold against PDGFR-β. Brivanib has the chemical name: (R)-1-(4-(4-fluoro-2-methyl-1H-indol-5-yloxy)-5-methylpyrrolo[1,2-f][1,2,4]triazin-6-yloxy)propan-2-ol; and has the following structure:

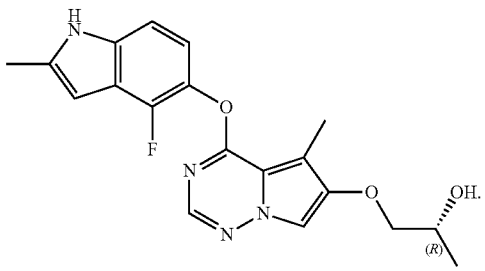

Brivanib Chemical Structure
Molecular Weight: 370.38

In some embodiments, the FGFR3 inhibitor is ponatinib (AP24534). Ponatinib is a novel, potent multi-target inhibitor of Abl, PDGFRα, VEGFR2, FGFR1 and Src with IC50 of 0.37 nM, 1.1 nM, 1.5 nM, 2.2 nM and 5.4 nM, respectively. Ponatinib has the chemical name: 3-(2-(imidazo[1,2-b]pyridazin-3-yl)ethynyl)-4-methyl-N-(4-((4-methylpiperazin-1-yl)methyl)-3-(trifluoromethyl)phenyl)benzamide; and has the following structure:

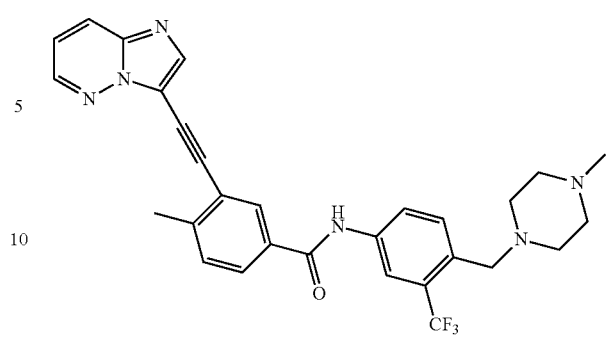

Ponatinib Chemical Structure
Molecular Weight: 532.56.

In some embodiments, the FGFR3 inhibitor is AZD4547. AZD4547 is a novel selective FGFR inhibitor targeting FGFR1/2/3 with IC50 of 0.2 nM/2.5 nM/1.8 nM, weaker activity against FGFR4, VEGFR2(KDR), and little activity observed against IGFR, CDK2, and p38. AZD4547 has the chemical name: N-(5-(3,5-dimethoxyphenethyl)-1H-pyrazol-3-yl)-4-((3S,5R)-3,5-dimethylpiperazin-1-yl)benzamide; and has the following structure:

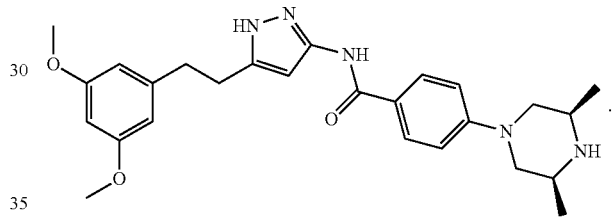

AZD4547 Chemical Structure
Molecular Weight: 463.57

In some embodiments, the FGFR3 inhibitor is pazopanib. Pazopanib is a tyrosine kinase inhibitor (TKI). Pazopanib has the chemical name: 5-[[4-[(2,3-dimethyl-2H-indazol-6yl)methylamino]-2-pyrimidinyl]amino]-2-methylbenzenesulfonamide monohydrochloride; and has the following structure:

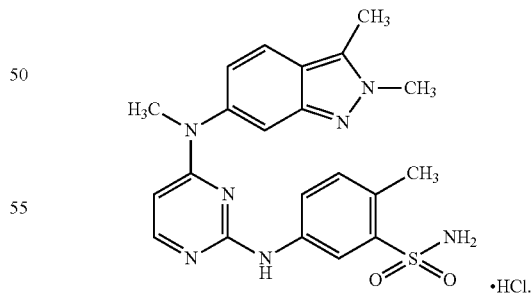

Pazopanib Chemical Structure
Molecular Weight: 473.99

In certain embodiments the FGFR3 inhibitor is BGJ398. BGJ398 (NVP-BGJ398) is a potent and selective FGFR inhibitor for FGFR1/2/3 with IC50 of 0.9 nM/1.4 nM/1 nM, >40-fold selective for FGFR versus FGFR4 and VEGFR2, and little activity to Abl, Fyn, Kit, Lck, Lyn and Yes.

BGJ398 has the chemical name: 3-(2,6-dichloro-3,5-dimethoxyphenyl)-1-(6-(4-(4-ethylpiperazin-1-yl)phenylamino)pyrimidin-4-yl)-1-methylurea; and has the following structure:

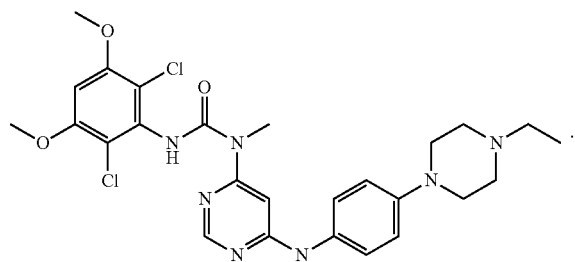

BGJ398 Chemical Structure
Molecular Weight: 560.48

In some embodiments, the FGFR3 inhibitor is BIBF1120 (Nintedanib). Nintedanib is a potent triple angiokinase inhibitor for VEGFR1/2/3, FGFR1/2/3 and PDGFRα/β with IC50 of 34 nM/13 nM/13 nM, 69 nM/37 nM/108 nM and 59 nM/65 nM. BIBF1120 has the chemical name: (Z)-methyl 3-((4-(N-methyl-2-(4-methylpiperazin-1-yl)acetamido)phenylamino)(phenyl)methylene)-2-oxoindoline-6-carboxylate; and has the following structure:

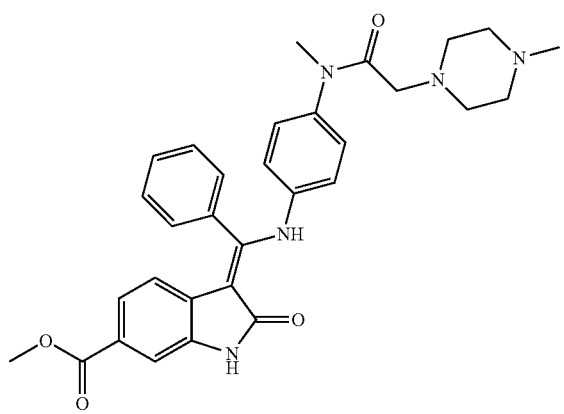

Nintedanib Chemical Structure
Molecular Weight: 539.62.

RAF1 Inhibitors

In other embodiments, the agent is a RAF1 inhibitor. In other embodiments, the RAF1 inhibitor is chosen from: GDC-0973, GDC-0941, sorafenib (nexavar); PLX-4720; XL281; LGX818; U0126; or regorafenib (BAY 73-4506).

In one embodiment, the RAF1 inhibitor is XL518 (GDC-0973). XL518 a potent, selective, orally bioavailable inhibitor of MEK1. XL518 has the chemical name: [3,4-difluoro-2-[(2-fluoro-4-iodophenyl)amino]phenyl][3-hydroxy-3-[(2S)-2-piperidinyl]-1-azetidinyl]methanone; and has the following structure:

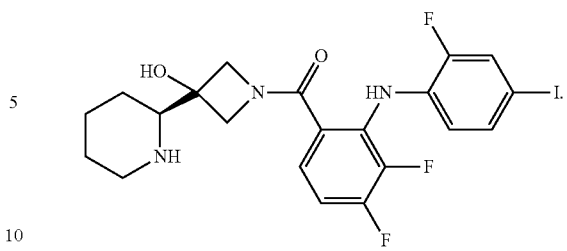

XL518 Chemical Structure
Molecular Weight: 531.31

In one embodiment, the RAF1 inhibitor is GDC-0941. GDC-0941 is a potent inhibitor of PI3Kα/δ with IC50 of 3 nM, with modest selectivity against p110β (11-fold) and p110γ (25-fold). GDC-0941 has the chemical name: 2-(1H-indazol-4-yl)-6-((4-(methylsulfonyl)piperazin-1-yl)methyl)-4-morpholinothieno[3,2-d]pyrimidine; and has the following structure:

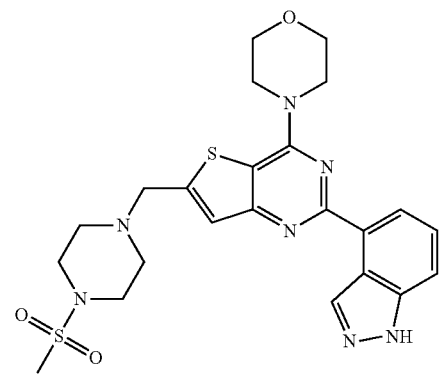

GDC-0941 Chemical Structure
Molecular Weight: 513.64.

In certain embodiments the RAF1 inhibitor sorafenib. Sorafenib is a kinase inhibitor. Sorafenib has the chemical name: 4-(4-{3-[4-Chloro-3-(trifluoromethyl)phenyl]ureido}phenoxy)N2methylpyridine-2-carboxamide 4-methylbenzenesulfonate; and has the following structure:

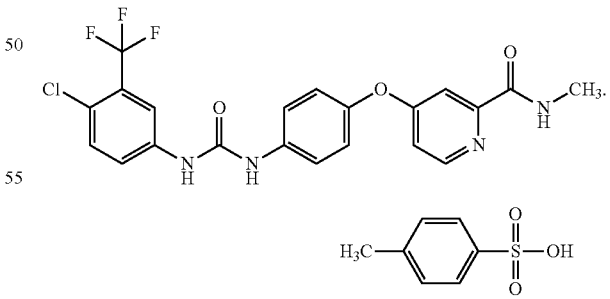

Sorafenib Chemical Structure
Molecular Weight: 637.0

In one embodiment, the RAF1 inhibitor is U0126-EtOH. U0126-EtOH is a highly selective inhibitor of MEK1/2 with IC50 of about 0.07 μM/0.06 μM, 100-fold higher affinity for ΔN3-S218E/S222D MEK than PD098059. PD098059 has the chemical name: (2Z,3Z)-2,3-bis(amino(2-aminophenyl-thio)methylene)succinonitrile, ethanol; and has the following structure:

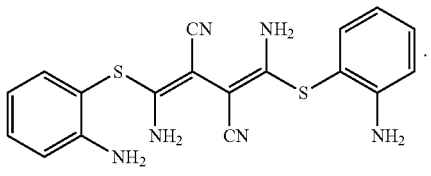

U0126-EtOH Chemical Structure
Molecular Weight: 426.56

In some embodiments, the RAF1 inhibitor is LGX818. In one embodiment, LGX818 has the following chemical name Methyl[(2S)-1-{[4-(3-{5-chloro-2-fluoro-3-[(methylsulfonyl)amino]phenyl}-1-isopropyl-1H-pyrazol-4-yl)-2-pyrimidinyl]amino}-2-propanyl]carbamate; and the following structure:

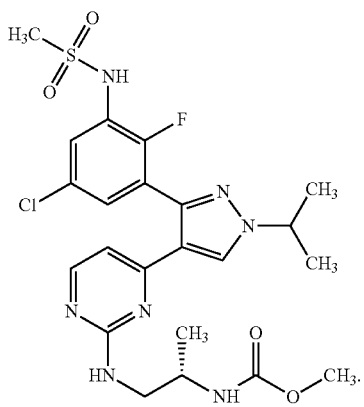 [SMILES: COC(=O)N[C@@H](C)CNc1nccc(-c2cn(C(C)C)nc2-c2cc(Cl)cc(NS(C)(=O)=O)c2F)n1]

In certain embodiments the RAF1 inhibitor is PLX-4720. PLX4720 is a potent and selective inhibitor of B-Raf$^{V600E}$ with IC50 of 13 nM, equally potent to c-Raf-1(Y340D and Y341D mutations), 10-fold selectivity for B-RafV600E than wild-type B-Raf. PLX-4720 has the chemical name: N-(3-(5-chloro-1H-pyrrolo[2,3-b]pyridine-3-carbonyl)-2,4-difluorophenyl)propane-1-sulfonamide; and has the following structure:

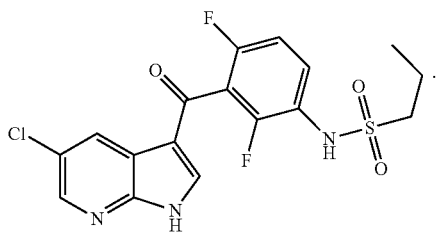

PLX-4720 Chemical Structure
Molecular Weight: 413.83

In certain embodiments the RAF1 inhibitor is regorafenib. Regorafenib (BAY 73-4506) is a multi-target inhibitor for VEGFR1, VEGFR2, VEGFR3, PDGFRβ, Kit, RET and Raf-1 with IC50 of 13 nM/4.2 nM/46 nM, 22 nM, 7 nM, 1.5 nM and 2.5 nM, respectively. Regorafenib has the chemical name: 1-(4-chloro-3-(trifluoromethyl)phenyl)-3-(2-fluoro-4-(2-(methylcarbamoyl)pyridin-4-yloxy)phenyl)urea; and has the following structure:

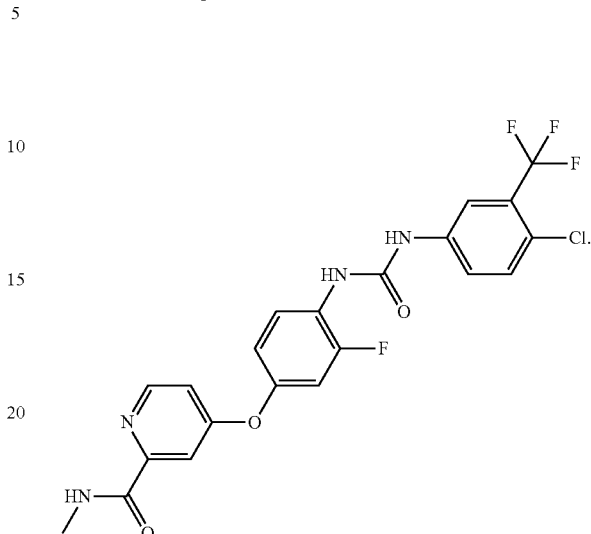

Regorafenib Chemical Structure
Molecular Weight: 482.82

RET Inhibitors

In other embodiments, the agent is a RET inhibitor. In other embodiments, the RET inhibitor is chosen from: sorafenib, sunitinib, erlotinib, gefitinib, cabozantinib (XL-184), CEP-701 (lestaurinib); CEP-751; 2-indolinone, e.g., RPI-1; and quinazoline, e.g., ZD6474 (vandetanib); pazopanib; or TG101209.

In certain embodiments the RET inhibitor is Cabozantinib. Cabozantinib is a small molecule inhibitor of the tyrosine kinases c-Met and VEGFR2, and has been shown to reduce tumor growth, metastasis, and angiogenesis. Cabozantinib has the chemical name N-(4-((6,7-Dimethoxyquinolin-4-yl)oxy)phenyl)-N-(4-fluorophenyl)cyclopropane-1,1-dicarboxamide; and has the following structure:

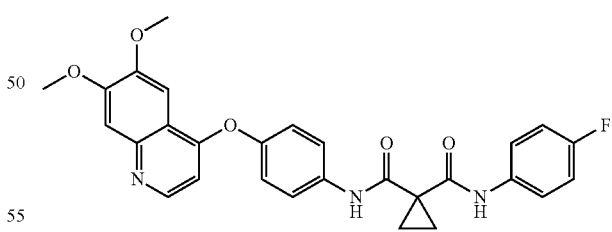

Cabozantinib Chemical Structure
Molecular Weight: 501.51.

In some embodiments, the RET inhibitor is Sunitinib. Sunitinib Malate is a multi-targeted RTK inhibitor targeting VEGFR2 (Flk-1) and PDGFRβ with IC50 of 80 nM and 2 nM, and also inhibits c-Kit. Sunitinib has the chemical name (Z)—N-(2-(diethylamino)ethyl)-5-((5-fluoro-2-oxoindolin-3-ylidene)methyl)-2,4-dimethyl-1H-pyrrole-3-carboxamide, (S)-2-hydroxysuccinic acid; and has the following structure:

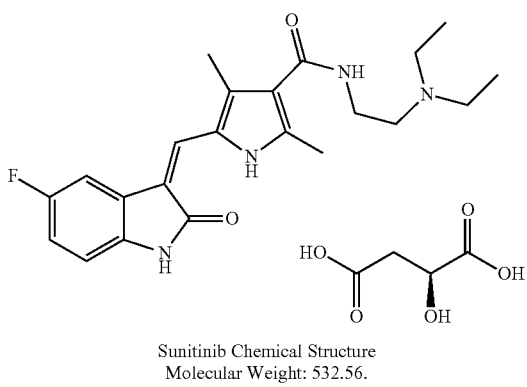 [SMILES: CCN(CC)CCNC(=O)c1c(C)[nH]c(/C=C2\C(=O)Nc3ccc(F)cc32)c1C ; O=C(O)C[C@H](O)C(=O)O]

Sunitinib Chemical Structure
Molecular Weight: 532.56.

In some embodiments, the RET inhibitor is Erlotinib. Erlotinib HCl (OSI-744) is an EGFR inhibitor with IC50 of 2 nM, >1000-fold more sensitive for EGFR than human c-Src or v-Abl. Erlotinib has the chemical name N-(3-ethynylphenyl)-6,7-bis(2-methoxyethoxy)quinazolin-4-amine hydrochloride; and has the following structure:

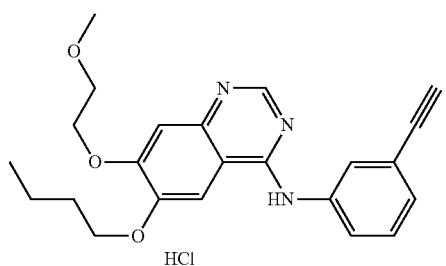

Erlotinib Chemical Structure
Molecular Weight: 429.90.

In some embodiments, the RET inhibitor is Gefitinib. Gefitinib (ZD-1839) is an EGFR inhibitor for Tyr1173, Tyr992, Tyr1173 and Tyr992 in the NR6wtEGFR and NR6W cells with IC50 of 37 nM, 37 nM, 26 nM and 57 nM, respectively. Gefitinib has the chemical name N-(3-chloro-4-fluorophenyl)-7-methoxy-6-(3-morpholinopropoxy)quinazolin-4-amine; and has the following structure:

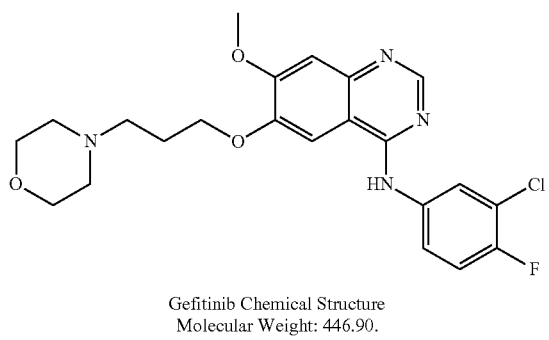 [SMILES: COc1cc2ncnc(Nc3ccc(F)c(Cl)c3)c2cc1OCCCN1CCOCC1]

Gefitinib Chemical Structure
Molecular Weight: 446.90.

In some embodiments, the RET inhibitor is Sorafenib Tosylate (also known as Bay 43-9006, Nexavar). In one embodiment, Sorafenib has the chemical name: 2-Pyridinecarboxamide, 4-[4-[[[[4-chloro-3-(trifluoromethyl)phenyl]amino]carbonyl]amino]phenoxy]-N-methyl-, 4-methylbenzenesulfonate (1:1); and has the following structure:

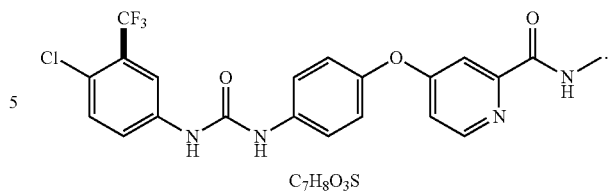

$C_7H_8O_3S$

In certain embodiments the RET inhibitor is lestaurtinib. Lestaurtinib is a potent JAK2, FLT3 and TrkA inhibitor (IC50 values are 0.9, 3 and <25 nM respectively) that prevents STAT5 phosphorylation (IC50=20-30 nM). Exhibits antiproliferative activity in vitro ($IC_{50}$=30-100 nM in HEL92.1.7 cells) and is effective against myeloproliferative disorders in vivo. Lestaurtinib has the chemical name: (9S,10S,12R)-2,3,9,10,11,12-Hexahydro-10-hydroxy-10-(hydroxymethyl)-9-methyl-9,12-epoxy-1H-diindolo[1,2,3-fg:3',2',1'-kl]pyrrolo[3,4-i][1, 6]benzodiazocin-1-one; and has the following structure:

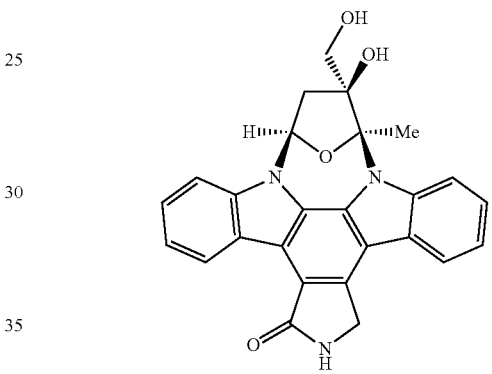

Lestaurtinib Chemical Structure
Molecular Weight: 439.46.

In some embodiments, the RET inhibitor is pazopanib. Pazopanib is a tyrosine kinase inhibitor (TKI). Pazopanib has the chemical name: 5-[[4-[(2,3-dimethyl-2H-indazol-6yl)methylamino]-2-pyrimidinyl]amino]-2-methylbenzenesulfonamide monohydrochloride; and has the following structure:

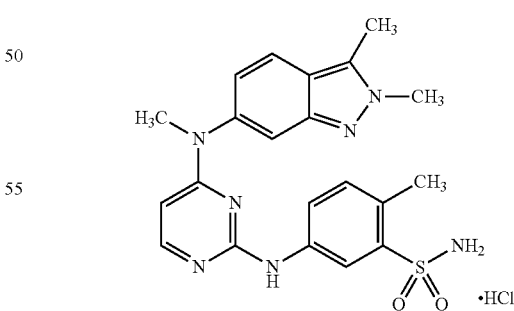

Pazopanib Chemical Structure
Molecular Weight: 473.99.

In certain embodiments the RET inhibitor is TG101209. TG101209 is a selective JAK2 inhibitor with IC50 of 6 nM, less potent to Flt3 and RET with IC50 of 25 nM and 17 nM, ~30-fold selective for JAK2 than JAK3, sensitive to JAK2V617F and MPLW515L/K mutations. TG101209 has the chemical name: N-tert-butyl-3-(5-methyl-2-(4-(4-methylpiperazin-1-yl)phenylamino)pyrimidin-4-ylamino)benzenesulfonamide; and has the following structure:

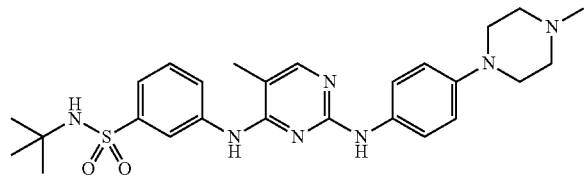

TG101209 Chemical Structure
Molecular Weight: 509.67.

In certain embodiments the RET inhibitor is ZD6474. Vandetanib (ZD6474) is an orally-bioavailable, ATP-competitive, quinazoline-based inhibitor of VEGFR2 that has been shown to inhibit both VEGF-induced signalling in endothelial cells and tumor-induced angiogenesis. [1] Vandetanib inhibits VEGFR2, VEGFR3, EGFR, and RET at IC50s of 40 nM, 110 nM, 500 nM, and 130 nM, respectively. It has been found to inhibit cell proliferation of VEGFR-stimulated cells (IC50 60 nM) and EGFR-stimulated HUVEC proliferation (IC50 170 nM). ZD6474 has the chemical name: N-(4-bromo-2-fluorophenyl)-6-methoxy-7-((1-methylpiperidin-4-ypmethoxy)quinazolin-4-amine; and has the following structure:

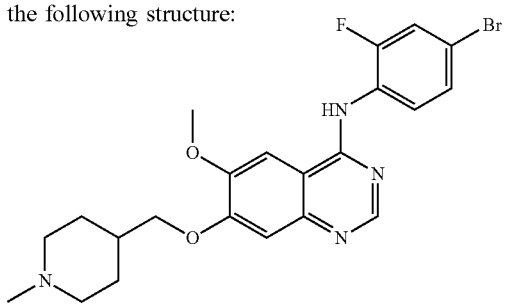

ZD6474 Chemical Structure
Molecular Weight: 475.35.

In certain embodiments the RET inhibitor is RPI-1. RPI-1 is a competitive, potent ATP-dependent Ret kinase inhibitor. Recently it was discover that the compound also inhibits c-Met. Increased tumorigenicity, motility, and invasiveness have been described as biological consequences of HGF/Met deregulation in tumor cells. RPI-1 treatment of H460 cells resulted in a strong reduction of both colony number and size (IC50=24.5+0.5 microM). RPI-1 has the chemical name: 1,3-dihydro-5,6-dimethoxy-3-[(4-hydroxyphenyl)methylene]-H-indol-2-one; and has the following structure:

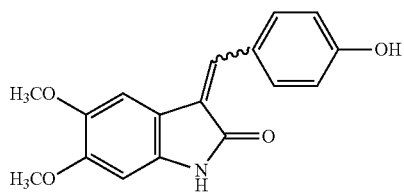

RPI-1 Chemical Structure
Molecular Weight: 297.31.

TGFB Inhibitors

In certain embodiments, the agent is a TGFB inhibitor. In certain embodiments, the TGFB inhibitor is LY2109761. LY2109761 is a novel selective TGF-β receptor type I/II (TβRI/II) dual inhibitor with $K_i$ of 38 nM and 300 nM, respectively; shown to negatively affect the phosphorylation of Smad2. LY2109761 has the chemical name: 7-(2-morpholinoethoxy)-4-(2-(pyridin-2-yl)-5,6-dihydro-4H-pyrrolo[1,2-b]pyrazol-3-yl)quinoline; and has the following structure:

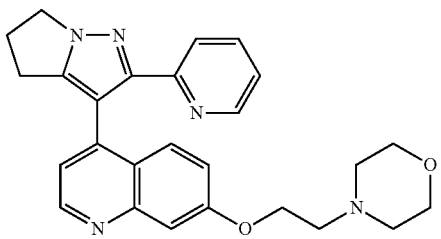

LY2109761 Chemical Structure
Molecular Weight: 441.52.

IGFR1 Inhibitors

In other embodiments, the agent is an IGFR1 inhibitor. In other embodiments, the IGFR1 inhibitor is chosen from: NVP-ADW742; BMS-754807; or AG-1024.

In certain embodiments the IGFR1 inhibitor is NVP-ADW742. NVP-ADW742 is an IGF-1R inhibitor with IC50 of 0.17 μM, >16-fold more potent against IGF-1R than InsR; little activity to HER2, PDGFR, VEGFR-2, Bcr-Abl and c-Kit. NVP-ADW742 has the chemical name: 5-(3-(benzyloxy)phenyl)-7-((1r,3r)-3-(pyrrolidin-1-ylmethyl)cyclobutyl)-7H-pyrrolo[2,3-d]pyrimidin-4-amine; and has the following structure:

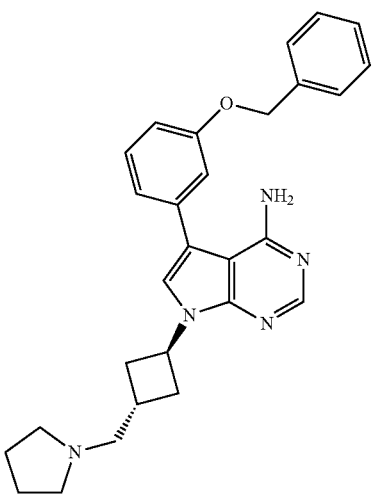

NVP-ADW742 Chemical Structure
Molecular Weight: 453.58.

In certain embodiments the IGFR1 inhibitor is BMS-754807. BMS-754807 is a potent and reversible inhibitor of IGF-1R/InsR with IC50 of 1.8 nM/1.7 nM, less potent to Met, Aurora A/B, TrkA/B and Ron, and shows little activity to Flt3, Lck, MK2, PKA, PKC etc. BMS-754807 has the chemical name: (S)-1-(4-(5-cyclopropyl-1H-pyrazol-3- ylamino)pyrrolo[1,2-f][1,2,4]triazin-2-yl)-N-(6-fluoropyridin-3-yl)-2-methylpyrrolidine-2-carboxamide; and has the following structure:

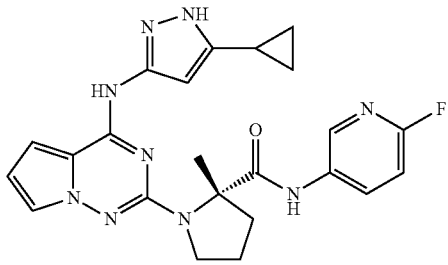

BMS-754807 Chemical Structure
Molecular Weight: 461.49.

In certain embodiments the IGFR1 inhibitor is AG-1024. AG-1024 (Tyrphostin) inhibits IGF-1R autophosphorylation with IC50 of 7 μM, is less potent to IR with IC50 of 57 μM and specifically distinguishes between InsR and IGF-1R (as compared to other tyrphostins). AG-1024 has the chemical name: 2-(3-bromo-5-tert-butyl-4-hydroxybenzylidene)malononitrile; and has the following structure:

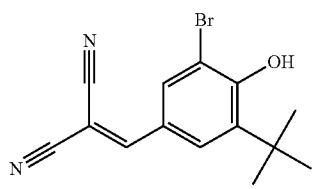

AG-1024 Chemical Structure
Molecular Weight: 305.17.

ERBB4 Inhibitors

In other embodiments, the agent is an ERBB4 inhibitor. In other embodiments, the ERBB4 inhibitor is chosen from: AST-1306; or dacomitinib (PF299804).

In certain embodiments the ERBB4 inhibitor is AST-1306. AST-1306 is a novel irreversible inhibitor of EGFR and ErbB2 with IC50 of 0.5 nM and 3 nM, also effective in mutation EGFR T790M/L858R, more potent to ErbB2-overexpressing cells, 3000-fold selective for ErbB family than other kinases. AST-1306 has the chemical name 2-Propenamide, N-[4-[[3-chloro-4-[(3-fluorophenyl)methoxy]phenyl]amino]-6-quinazolinyl]-, 4-methylbenzenesulfonate (1:1); and has the following structure:

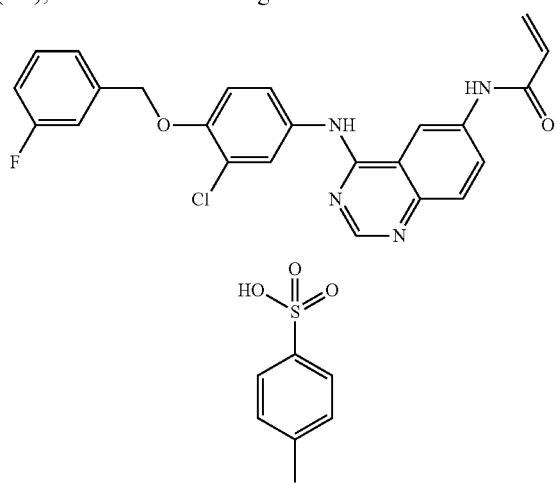

AST-1306 Chemical Structure
Molecular Weight: 621.08.

In certain embodiments the ERBB4 inhibitor is dacomitinib. Dacomitinib is an orally bioavailable, highly selective, second-generation small-molecule inhibitor of the pan-epidermal growth factor receptor (EGFR) family of tyrosine kinases (ErbB family) with potential antineoplastic activity. Dacomitinib specifically and irreversibly binds to and inhibits human EGFR subtypes, resulting in inhibition of proliferation and induction of apoptosis in EGFR-expressing tumor cells. EGFRs play major roles in tumor cell proliferation and tumor vascularization, and are often overexpressed or mutated in various tumor cell types. Dacomitinib has the chemical name (E)-N-(4-((3-chloro-4-fluorophenyl)amino)-7-methoxyquinazolin-6-yl)-4-(piperidin-1-yl)but-2-enamide; and has the following structure:

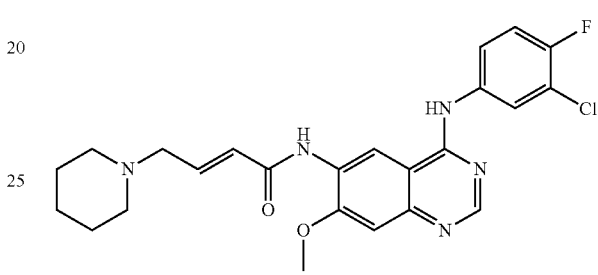

Dacamitinib Chemical Structure
Molecular Weight: 469.939.

FLT4 Inhibitors

In other embodiments, the agent is a FLT4 inhibitor. In other embodiments, the FLT4 inhibitor is chosen from: BIBF1120 (Vargatef); KRN 633; Brivanib alaninate (BMS-582664); Telatinib (BAY 57-9352); E7080 (Lenvatinib); Trivozanib (AV-951); XL999; AL2846; Motesanib; AAL-993; Axitinib; Foretinib; MGCD-265; SAR131675; cediranib, Sorafenib; Pazopanib; Regorafenib (BAY 73-4506); Sunitinib; Vandetanib; and/or IMC-3C5.

In some embodiments, the FLT4 inhibitor is Cediranib. Cediranib (AZD2171) is a highly potent VEGFR (KDR) inhibitor with IC50 of <1 nM, also inhibits Flt1/4 with IC50 of 5 nM/<3 nM, similar activity against c-Kit and PDGFRβ, 36-, 110-fold and >1000-fold selective more for VEGFR than PDGFR-α, CSF-1R and Flt3. Cediranib has the chemical name 4-(4-fluoro-2-methyl-1H-indol-5-yloxy)-6-methoxy-7-(3-(pyrrolidin-1-yl)propoxy)quinazoline; and has the following structure:

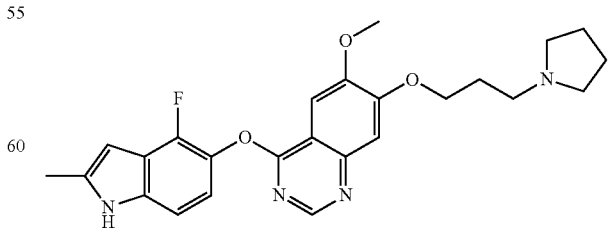

Cediranib Chemical Structure
Molecular Weight: 450.51.

In some embodiments, the FLT4 inhibitor is BIBF1120 (Nintedanib). Nintedanib is a potent triple angiokinase inhibitor for VEGFR1/2/3, FGFR1/2/3 and PDGFRα/β with IC50 of 34 nM/13 nM/13 nM, 69 nM/37 nM/108 nM and 59 nM/65 nM. BIBF1120 has the chemical name: (Z)-methyl 3-((4-(N-methyl-2-(4-methylpiperazin-1-yl)acetamido)phenylamino)(phenyl)methylene)-2-oxoindoline-6-carboxylate; and has the following structure:

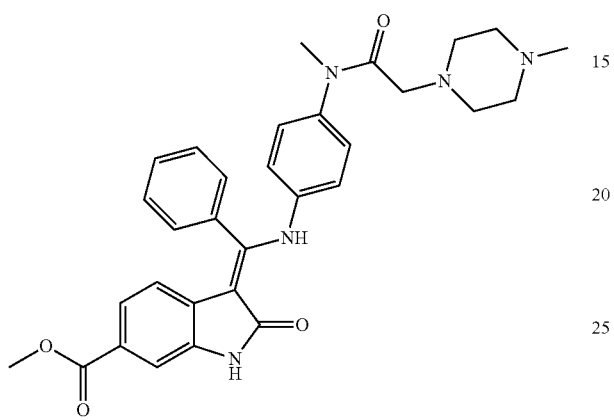

Nintedanib Chemical Structure
Molecular Weight: 539.62.

In some embodiments, the FLT4 inhibitor is Lenvatinib (E7080). E7080 (Lenvatinib) is a multi-target inhibitor, mostly for VEGFR2(KDR)/VEGFR3(Flt-4) with IC50 of 4 nM/5.2 nM, less potent against VEGFR1/Flt-1, ~10-fold more selective for VEGFR2/3 against FGFR1, PDGFRα/β. Lenvatinib (E7080) has the chemical name: 1-(4-(6-carbamoyl-7-methoxyquinolin-4-yloxy)-2-chlorophenyl)-3-cyclopropylurea; and has the following structure:

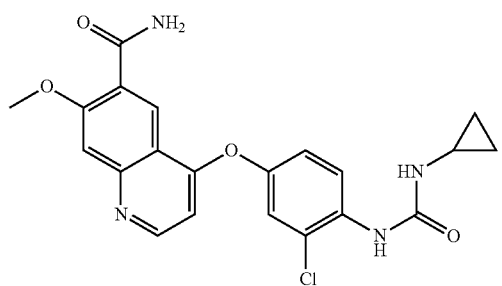

Lenvatinib (E7080) Chemical Structure
Molecular Weight: 426.85.

In some embodiments, the FLT4 inhibitor is KRN 633. KRN 633 is an ATP-competitive inhibitor of VEGFR1/2/3 with IC50 of 170 nM/160 nM/125 nM, weakly inhibits PDGFR-α/β and c-Kit, does not block the phosphorylation of FGFR-1, EGFR or c-Met in cell. KRN 633 has the chemical name: 1-(2-chloro-4-(6,7-dimethoxyquinazolin-4-yloxy)phenyl)-3-propylurea; and has the following structure:

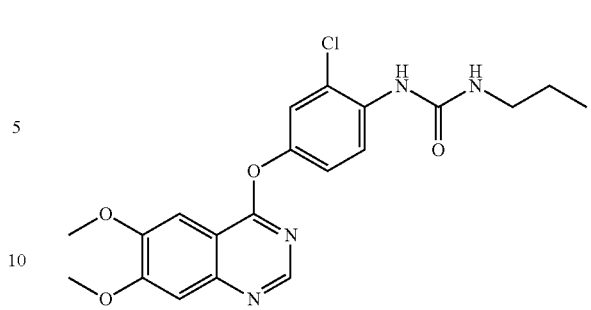

KRN 633 Chemical Structure
Molecular Weight: 416.86.

In some embodiments, the FLT4 inhibitor is Telatinib. Telatinib is a potent inhibitor of VEGFR2/3, c-Kit and PDGFRP with IC50 of 6 nM/4 nM, 1 nM and 15 nM, respectively. Telatinib has the chemical name: 4-((4-(4-chlorophenylamino)furo[2,3-d]pyridazin-7-yloxy)methyl)-N-methylpicolinamide; and has the following structure:

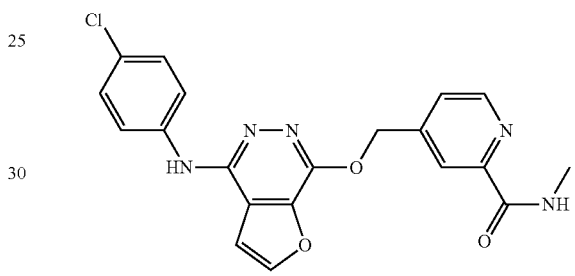

Telatinib Chemical Structure
Molecular Weight: 409.83.

In some embodiments, the FGFR1 inhibitor is brivanib alaninate (BMS-582664). Brivanib alaninate (BMS-582664) is the prodrug of BMS-540215, an ATP-competitive inhibitor against VEGFR2 with IC50 of 25 nM. Brivanib alaninate has the chemical name: (S)—((R)-1-(4-(4-fluoro-2-methyl-1H-indol-5-yloxy)-5-methylpyrrolo[1,2-f][1,2,4]triazin-6-yloxy)propan-2-yl) 2-aminopropanoate; and has the following structure:

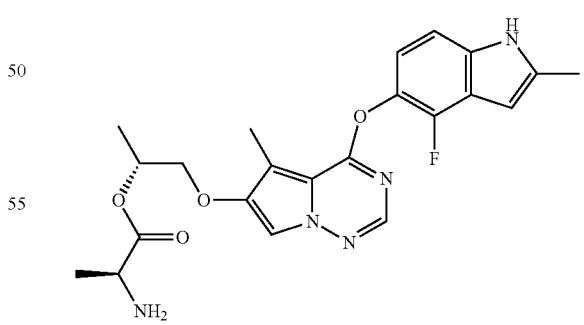

Brivanib Alaninate Chemical Structure
Molecular Weight: 441.46.

In some embodiments, the kinase inhibitor is Tivozanib (AV-951). Tivozanib (AV-951) is a potent and selective VEGFR inhibitor for VEGFR1/2/3 with IC50 of 0.21 nM/0.16 nM/0.24 nM, and also inhibits PDGFR and c-Kit, low activity observed against FGFR-1, Flt3, c-Met EGFR and IGF-1R. Tivozanib (AV-951) has the chemical name 1-(2-chloro-4-(6,7-dimethoxyquinolin-4-yloxy)phenyl)-3-(5-methylisoxazol-3-yl)urea; and has the following structure:

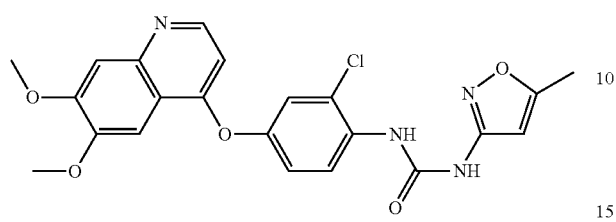

Tivozanib Chemical Structure
Molecular Weight: 454.86.

In some embodiments, the FLT4 (VEGFR3) inhibitor is XL999. XL999, a Spectrum Selective Kinase Inhibitor™ (SSKIs), is a potent inhibitor of key RTKs implicated in the development and maintenance of tumor vasculature and in the proliferation of some tumor cells. It inhibits the FGFR, VEGFR and PDGFR RTKs and exhibited excellent activity in target-specific cellular functional assays. In addition, XL999 is a potent inhibitor of FLT3, an important driver of leukemia cell proliferation in some patients with acute myelogenous leukemia (AML).

In some embodiments, the FLT4 (VEGFR3) inhibitor is AL2846. AL8326 is an inhibitor of Aurora B, FGFr, and VEGFr. It has been shown remarkable efficacy in several xenograft models. AL8326 also has been generally demonstrated better in vivo activities comparing with sunitinib or sorafenib in xenograft models of human NSCLC 95D, liver cancer Bel-7402, glioblastoma SHG44, renal cell carcinoma (RCC) 786-0, AML HL60, U937 and ovarian cancer SKOV3. AL8326 pharmacokinetic profiles on rats are also favorable with oral half life at 1.8 hour and bioavailability at 28.8%.

In some embodiments, the FLT4 (VEGFR3) inhibitor is Motesanib. Motesanib Diphosphate (AMG-706) is a potent ATP-competitive inhibitor of VEGFR1/2/3 with IC50 of 2 nM/3 nM/6 nM, respectively; similar activity against Kit, ~10-fold more selective for VEGFR than PDGFR and Ret. has the chemical name; and has the following structure:

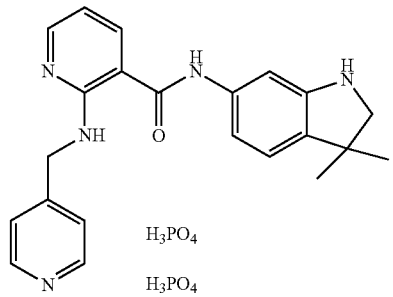

Motesanib Chemical Structure
Molecular Weight: 569.44.

In some embodiments, the FLT4 (VEGFR3) inhibitor is AAL-993. AAL-993 is a highly potent inhibitor of VEGFR-1 (IC50=130 nM), VEGFR-2 (IC50=23 nM) and VEGFR-3 (IC50=18 nM). At higher concentrations it inhibits PDGFR-β (640 nM), c-Kit (236 nM) and CSF-1R (380 nM). AAL-993 has the chemical name 2-((pyridin-4-ylmethyl)amino)-N-(3-(trifluoromethyl)phenyl)benzamide; and has the following structure:

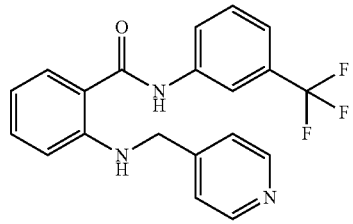

AAL-993 Chemical Structure
Molecular Weight: 371.36.

In some embodiments, the FLT4 (VEGFR3) inhibitor is Axitinib. Axitinib is a multi-target inhibitor of VEGFR1, VEGFR2, VEGFR3, PDGFRβ and c-Kit with IC50 of 0.1 nM, 0.2 nM, 0.1-0.3 nM, 1.6 nM and 1.7 nM, respectively. Axitinib has the following structure:

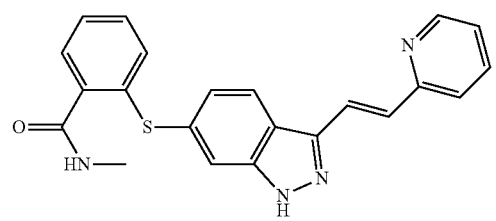

Axitinib Chemical Structure
Molecular Weight: 386.47.

In some embodiments, the FLT4 (VEGFR3) inhibitor is Foretinib. Foretinib (GSK1363089) is an ATP-competitive inhibitor of HGFR and VEGFR, mostly for Met and KDR with IC50 of 0.4 nM and 0.9 nM. Less potent against Ron, Flt-1/3/4, Kit, PDGFRα/β and Tie-2, and little activity to FGFR1 and EGFR. Foretinib has the chemical name N-(3-fluoro-4-(6-methoxy-7-(3-morpholinopropoxy)quinolin-4-yloxy)phenyl)-N-(4-fluorophenyl)cyclopropane-1,1-dicarboxamide; and has the following structure:

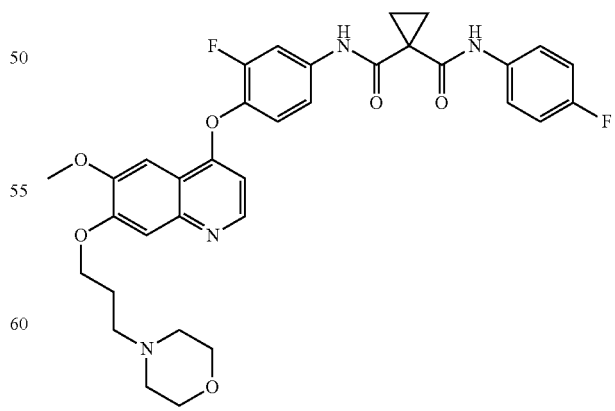

Foretinib Chemical Structure
Molecular Weight: 632.65.

In some embodiments, the FLT4 (VEGFR3) inhibitor is MGCD-265. MGCD-265 has the chemical name N-[[3-fluoro-4-[2-(1-methylimidazol-4-yl)thieno[3, 2-b]pyridin-7-yl]oxyphenyl]carbamothioyl]-2-phenylacetamide; and has the following structure:

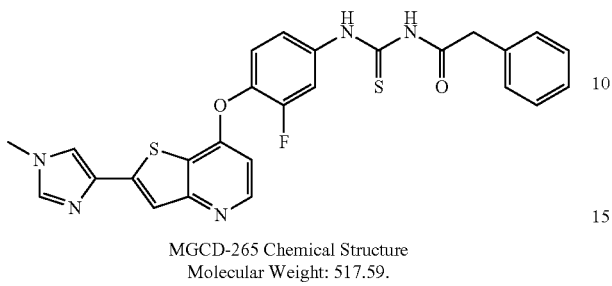

MGCD-265 Chemical Structure
Molecular Weight: 517.59.

In some embodiments, the FLT4 (VEGFR3) inhibitor is SAR131675. SAR131675 is a VEGFR3 inhibitor with IC50/$K_i$ of 23 nM/12 nM, about 50- and 10-fold more selective for VEGFR3 than VEGFR1/2, little activity against Akt1, CDKs, PLK1, EGFR, IGF-1R, c-Met, Flt2 etc. SAR131675 has the chemical name (R)-2-amino-1-ethyl-7-(3-hydroxy-4-methoxy-3-methylbut-1-ynyl)-N-methyl-4-oxo-1,4-dihydro-1,8-naphthyridine-3-carboxamide; and has the following structure:

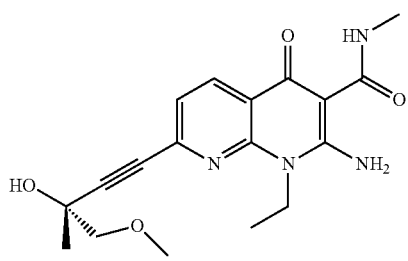

SAR131675 Chemical Structure
Molecular Weight: 358.39.

In some embodiments, the FLT4 (VEGFR3) inhibitor is Sorafenib. Sorafenib Tosylate (Bay 43-9006) is a multikinase inhibitor of Raf-1, B-Raf and VEGFR-2 with IC50 of 6 nM, 22 nM and 90 nM, respectively. Sorafenib has the chemical name 2-Pyridinecarboxamide, 4-[4-[[[[4-chloro-3-(trifluoromethyl)phenyl]amino]carbonyl]amino]phenoxy]-N-methyl-, 4-methylbenzenesulfonate (1:1); and has the following structure:

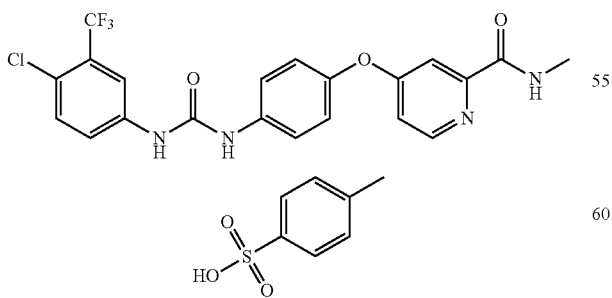

Sorafenib Chemical Structure
Molecular Weight: 637.03.

In some embodiments, the FLT4 (VEGFR3) inhibitor is pazopanib. Pazopanib is a tyrosine kinase inhibitor (TKI). Pazopanib has the chemical name: 5-[[4-[(2,3-dimethyl-2H-indazol-6yl)methylamino]-2-pyrimidinyl]amino]-2-methyl-benzenesulfonamide monohydrochloride; and has the following structure:

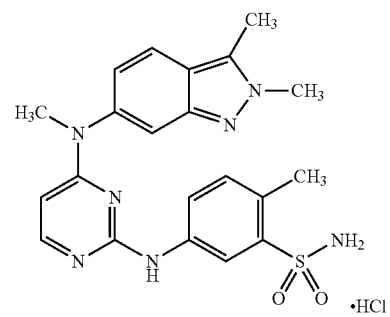

Pazopanib Chemical Structure
Molecular Weight: 473.99.

In some embodiments, the FLT4 (VEGFR3) inhibitor is regorafenib. Regorafenib (BAY 73-4506) is a multi-target inhibitor for VEGFR1, VEGFR2, VEGFR3, PDGFRβ, Kit, RET and Raf-1 with IC50 of 13 nM/4.2 nM/46 nM, 22 nM, 7 nM, 1.5 nM and 2.5 nM, respectively. Regorafenib has the chemical name: 1-(4-chloro-3-(trifluoromethyl)phenyl)-3-(2-fluoro-4-(2-(methylcarbamoyl)pyridin-4-yloxy)phenyl) urea; and has the following structure:

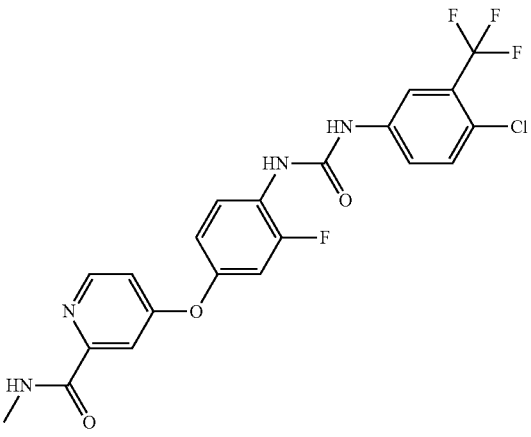

Regorafenib Chemical Structure
Molecular Weigth: 482.82.

In some embodiments, the FLT4 (VEGFR3) inhibitor is Sunitinib. Sunitinib Malate is a multi-targeted RTK inhibitor targeting VEGFR2 (Flk-1) and PDGFRβ with IC50 of 80 nM and 2 nM, and also inhibits c-Kit. Sunitinib has the chemical name (Z)—N-(2-(diethylamino)ethyl)-5-((5-fluoro-2-oxoindolin-3-ylidene)methyl)-2,4-dimethyl-1H-pyrrole-3-carboxamide, (S)-2-hydroxysuccinic acid; and has the following structure:

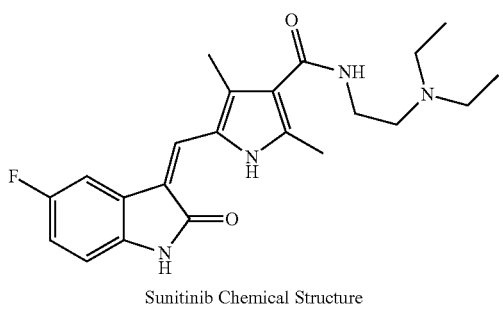

Sunitinib Chemical Structure
Molecular Weight: 532.56.

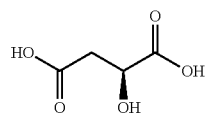

In some embodiments, the FLT4 (VEGFR3) inhibitor is Vandetanib. Vandetanib (ZD6474) is a potent inhibitor of VEGFR2 with IC50 of 40 nM. Vandetanib has the chemical name N-(4-bromo-2-fluorophenyl)-6-methoxy-7-((1-methylpiperidin-4-yl)methoxy)quinazolin-4-amine; and has the following structure:

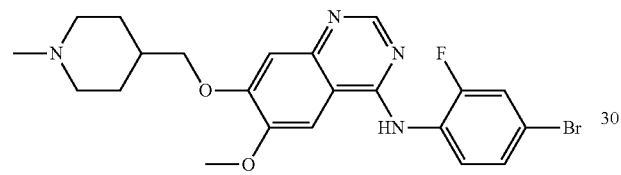

Vandetanib Chemical Structure
Molecular Weight: 475.35.

NOTCH1 Inhibitors

In other embodiments, the agent is a NOTCH1 inhibitor. In other embodiments, the NOTCH1 inhibitor is chosen from: BMS-906024, PF-03084014, and/or MK-0752.

In some embodiments, the NOTCH inhibitor is BMS-906024. BMS-906024 is a novel, potent Notch receptor inhibitor. Cancers have a tendency to relapse or to become resistant to treatments that once worked. A family of proteins called Notch is implicated in that resistance and in cancer progression more generally. BMS-906024 has the chemical name (2R,3S)—N1-((S)-1-methyl-2-oxo-5-phenyl-2,3-dihydro-1H-benzo[e][1,4]diazepin-3-yl)-2,3-bis(3,3,3-trifluoropropyl)succinamide; and has the following structure:

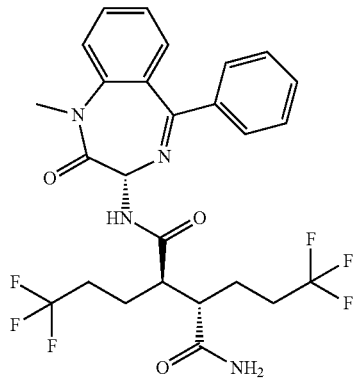

Chemical Structure
Molecular Weight: 556.50.

In some embodiments, the NOTCH inhibitor is PF-03084014. PF-03084014 is a selective gamma secretase (GS) inhibitor with potential antitumor activity. Gamma secretase inhibitor PF-03084014 binds to GS, blocking proteolytic activation of Notch receptors; Notch signaling pathway inhibition may follow, which may result in the induction of apoptosis in tumor cells that overexpress Notch. PF-03084014 has the chemical name (S)-2-(((S)-6,8-difluoro-1,2,3,4-tetrahydronaphthalen-2-yl)amino)-N-(1-(2-methyl-1-(neopentylamino)propan-2-yl)-1H-imidazol-4-yl)pentanamide; and has the following structure:

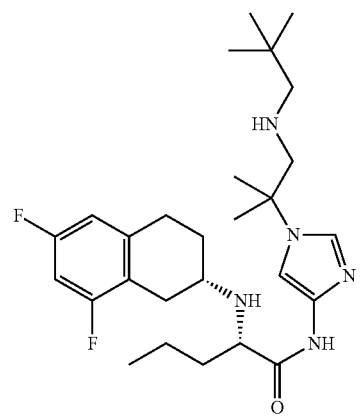

PF-03084014 Chemical Structure
Molecular Weight: 489.64.

In some embodiments, the NOTCH inhibitor is MK-0752. MK-0752 is a moderately potent γ-secretase inhibitor, which reduces Aβ40 production with IC50 of 5 nM. MK-0752 has the chemical name 3-((1r,4s)-4-(4-chlorophenylsulfonyl)-4-(2,5-difluorophenyl)cyclohexyl)propanoic acid; and has the following structure:

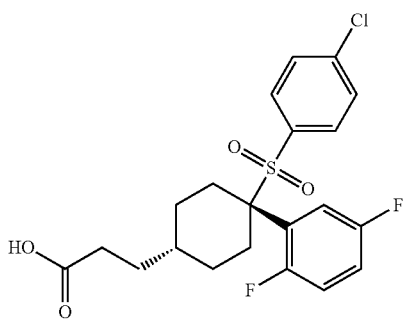

MK-0752 Chemical Structure
Molecular Weight: 442.9.

DOT1L Inhibitors

In one embodiment, the methyltransferase inhibitor is a DOT1L inhibitor including, but not limited to, EPZ004777; EPZ-5676; or SGC0946.

In some embodiments, the DOT1L inhibitor is EPZ004777. EPZ004777 is a potent, selective DOT1L inhibitor with IC50 of 0.4 nM. EPZ004777 has the chemical name 7H-Pyrrolo[2,3-d]pyrimidin-4-amine, 7-[5-deoxy-5-[[3-[[[[4-(1,1-dimethylethyl)phenyl]amino]carbonyl]amino]propyl](1-methylethyl)amino]-β-D-ribofuranosyl]-; and has the following structure:

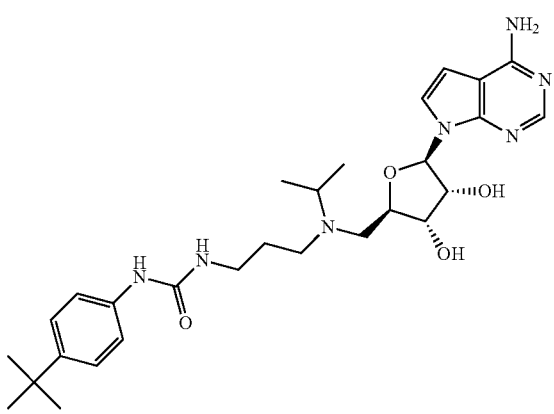

EPZ004777 Chemical Structure
Molecular Weight: 539.67.

In some embodiments, the DOT1L inhibitor is EPZ-5676. EPZ-5676 is an S-adenosyl methionine (SAM) competitive inhibitor of protein methyltransferaseDOT1L with KJ of 80 μM, demonstrating >37,000-fold selectivity against all other PMTs tested, inhibits H3K79 methylation in tumor. EPZ-5676 has the chemical name 9H-Purin-6-amine, 9-[5-deoxy-5-[[cis-3-[2-[6-(1,1-dimethylethyl)-1H-benzimidazol-2-yl]ethyl]cyclobutyl](1-methylethy)amino]-β-D-ribofuranosyl]-; and has the following structure:

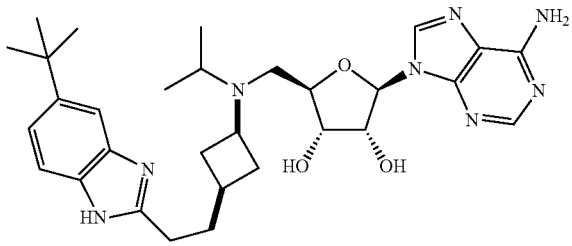

EPZ-5676 Chemical Structure
Molecular Weight: 562.71.

In some embodiments, the DOT1L inhibitor is SGC0946. SGC0946 is a highly potent and selective DOT1L methyltransferase inhibitor with IC50 of 0.3 nM, is inactive against a panel of 12 PMTs and DNMT1. SGC0946 has the chemical name 1-[3-[[[(2R,3S,4R,5R)-5-(4-Amino-5-bromo-7H-pyrrolo[2,3-d]pyrimidin-7-yl)-3,4-dihydro-xytetrahydrofuran-2-yl]methyl](isopropyl)amino]pro-pyl]-3-[4-(2,2-dimethylethyl)phenyl]urea; and has the following structure:

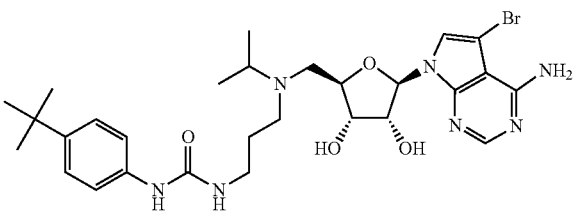

SGC0946 Chemical Structure
Molecular Weight: 618.57.

CBL Inhibitors

In other embodiments, the agent is a CBL inhibitor. In other embodiments, the CBL inhibitor is chosen from: BMS-906024, PF-03084014, and/or MK-0752. XL-184 free base (Cabozantinib); R406; Dovitinib Dilactic acid (TKI258 Dilactic acid); Quizartinib (AC220); Tandutinib (MLN518); Amuvatinib (MP-470); ENMD-2076; KW 2449; TG101209; or Dovitinib (TKI-258).

In certain embodiments the CBL inhibitor is Cabozantinib. Cabozantinib is a small molecule inhibitor of the tyrosine kinases c-Met and VEGFR2, and has been shown to reduce tumor growth, metastasis, and angiogenesis. Cabozantinib has the chemical name N-(4-((6,7-Dimethoxyquinolin-4-yl)oxy)phenyl)-N-(4-fluorophenyl)cyclopropane-1,1-dicarboxamide; and has the following structure:

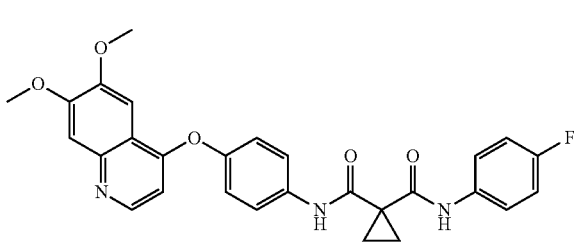

Cabozantinib Chemical Structure
Molecular Weight: 501.51.

In certain embodiments the CBL inhibitor is Dovitinib Dilactic acid. Dovitinib Dilactic acid (TKI258 Dilactic acid) is the Dilactic acid of Dovitinib, which is a multitargeted RTK inhibitor, mostly for class III (FLT3/c-Kit) with IC50 of 1 nM/2 nM, also potent to class IV (FGFR1/3) and class V (VEGFR1-4) RTKs with IC50 of 8-13 nM, less potent to InsR, EGFR, c-Met, EphA2, Tie2, IGFR1 and HER2. Dovitinib Dilactic acid has the chemical name Propanoic acid, 2-hydroxy-, compd. with 4-amino-5-fluoro-3-[6-(4-methyl-1-piperazinyl)-1H-benzimidazol-2-yl]-2(1H)-quinolinone; and has the following structure:

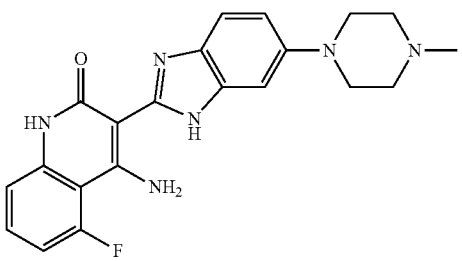

Dovitinib Dilactic acid Chemical Structure
Molecular Weight: 572.59.

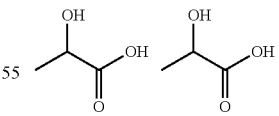

In certain embodiments the CBL inhibitor is Quizartinib. Quizartinib (AC220) is a small molecule receptor tyrosine kinase inhibitor that is currently under development for the treatment of acute myeloid leukaemia. Its molecular target is FLT3, also known as CD135 which is a proto-oncogene. Quizartinib has the chemical name 1-(5-(tert-Butyl)isoxazol-3-yl)-3-(4-(7-(2-morpholinoethoxy)benzo[d]imidazo[2,1-b]thiazol-2-yl)phenyl)urea; and has the following structure:

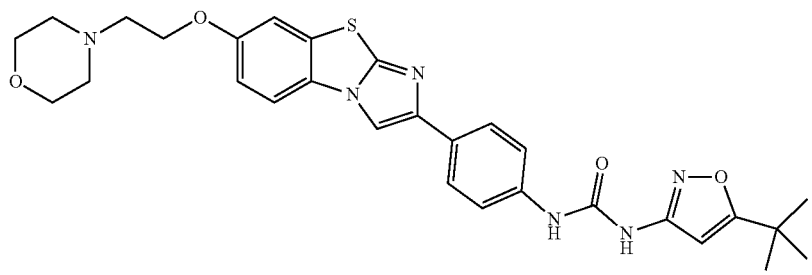

Quizartinib Chemical Structure
Molecular Weight: 560.67.

In certain embodiments the CBL inhibitor is Tandutinib. Tandutinib is a piperazinyl quinazoline receptor tyrosine kinase inhibitor with antineoplastic activity. Tandutinib inhibits the autophosphorylation of FLT3 (FMS-Like Tyrosine kinase-3), c-KIT and PDGF (platelet-derived growth factor) receptor tyrosine kinases, thereby inhibiting cellular proliferation and inducing apoptosis. Tandutinib has the chemical name (4-(6-Methoxy-7-(3-piperidylpropoxy)quinazolin-4-yl)piperazinyl)-N-(4-(methylethoxy)phenyl)carboxamide; and has the following structure:

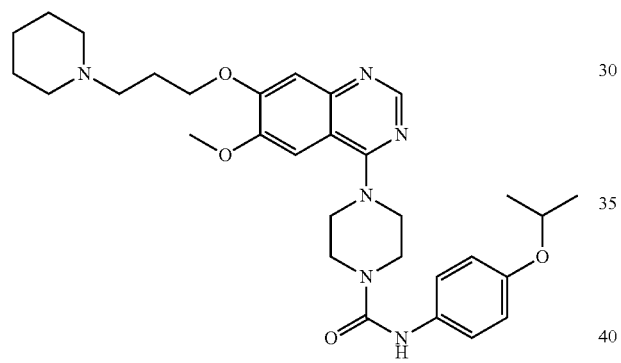

Tandutinib Chemical Structure
Molecular Weight: 562.32675.

In certain embodiments the CBL inhibitor is Amuvatinib. Amuvatinib (MP-470) is a potent and multi-targeted inhibitor of c-Kit, PDGFRα and Flt3 with IC50 of 10 nM, 40 nM and 81 nM, respectively. Amuvatinib has the following structure:

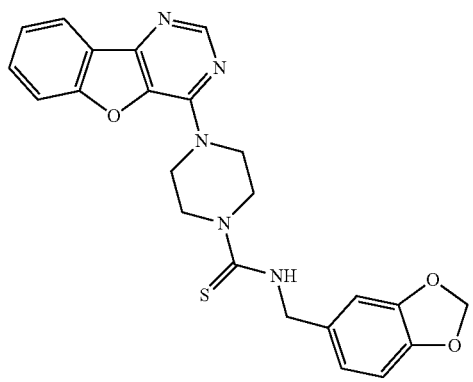

Amuvatinib Chemical Structure
Molecular Weight: 447.51.

In certain embodiments the CBL inhibitor is ENMD-2076. ENMD-2076 has selective activity against Aurora A and VEGFR (Flt3) with IC50 of 14 nM and 1.86 nM, 25-fold selective for Aurora A than over Aurora B and less potent to VEGFR2/KDR and VEGFR3, FGFR1 and FGFR2 and PDGFRα. ENMD-2076 has the chemical name (E)-N-(5-methyl-1H-pyrazol-3-yl)-6-(4-methylpiperazin-1-yl)-2-styrylpyrimidin-4-amine; and has the following structure:

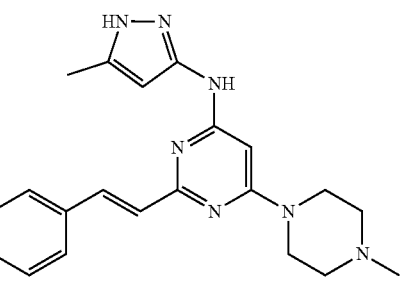

ENMD-2076 Chemical Structure
Molecular Weight: 375.47.

In certain embodiments the CBL inhibitor is KW 2449. KW-2449 is a multiple-targeted inhibitor, mostly for Flt3 with IC50 of 6.6 nM, modestly potent to Flt3, Bcr-Abl and Aurora A; little effect on PDGFRβ, IGF-1R, EGFR. KW 2449 has the chemical name (E)-(4-(2-(1H-indazol-3-yl)vinyl)phenyl)(piperazin-1-yl)methanone; and has the following structure:

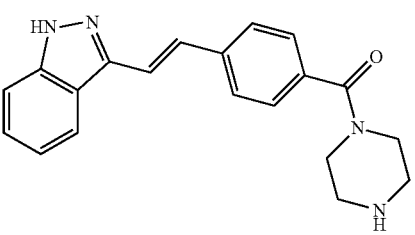

KW 2449 Chemical Structure
Molecular Weight: 332.4.

In certain embodiments the CBL inhibitor is TG101209. TG101209 is a selective JAK2 inhibitor with IC50 of 6 nM, less potent to Flt3 and RET with IC50 of 25 nM and 17 nM, ~30-fold selective for JAK2 than JAK3, sensitive to JAK2V617F and MPLW515L/K mutations. TG101209 has the chemical name: N-tert-butyl-3-(5-methyl-2-(4-(4-methylpiperazin-1-yl)phenylamino)pyrimidin-4-ylamino)benzenesulfonamide; and has the following structure:

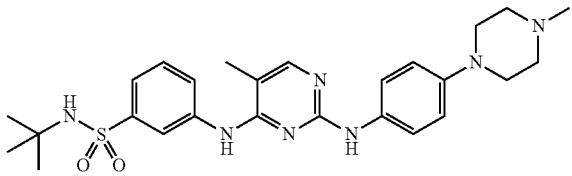

TG101209 Chemical Structure
Molecular Weight: 509.67.

In some embodiments, the CBL inhibitor is dovitinib (TKI258, CHIR258). Dovitinib (TKI258, CHIR258) is a multitargeted RTK inhibitor, mostly for class III (FLT3/c-Kit) with IC50 of 1 nM/2 nM, also potent to class IV (FGFR1/3) and class V (VEGFR1-4) RTKs with IC50 from 8-13 nM, less potent to InsR, EGFR, c-Met, EphA2, Tie2, IGF-1R and HER2. Dovitinib has the chemical name: 1-amino-5-fluoro-3-(6-(4-methylpiperazin-1-yl)-1H-benzo[d]imidazol-2-yl)quinolin-2(1H)-one; and has the following structure:

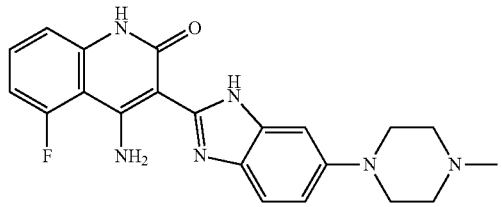

Dovitinib Chemical Structure
Molecular Weight: 392.43

ROS1 Inhibitors

In other embodiments, the agent is a ROS1 inhibitor. In other embodiments, the ROS1 inhibitor is chosen from: BMS-906024, PF-03084014, and/or MK-0752. Ganetespib; Crizotinib; TAE684; a dual ALK and ROS1 inhibitor.

In some embodiments, the ROS1 inhibitor is Ganetespib. Ganetespib (STA-9090) is a synthetic small-molecule inhibitor of heat shock protein 90 (Hsp90) with potential antineoplastic activity. Hsp90 inhibitor STA-9090 binds to and inhibits Hsp90, resulting in the proteasomal degradation of oncogenic client proteins, the inhibition of cell proliferation and the elevation of heat shock protein 72 (Hsp72); it may inhibit the activity of multiple kinases, such as c-Kit, EGFR, and Bcr-Abl, which as client proteins depend on functional HsP90 for maintenance. Ganetespib has the chemical name: 5-[2,4-dihydroxy-5-(1-methylethyl)phenyl]-4-(1-methyl-1H-indol-5-yl)-2,4-dihydro-3H-1,2,4-triazol-3-one; and has the following structure:

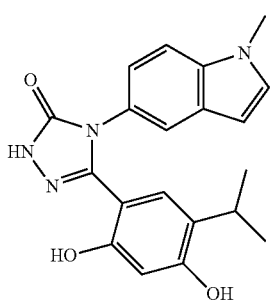

Ganetespib Chemical Structure
Molecular Weight: 364.15354

In some embodiments, the ROS1inhibitor is Crizotinib (PF-2341066). Crizotinib is a potent inhibitor of c-Met and ALK with IC50 of 11 nM and 24 nnM, respectiv1EY. Crizotinib has the chemical name: 3-((R)-1-(2,6-dichloro-3-fluorophenyl)ethoxy)-5-(1-(piperidin-4-yl)-1H-pyrazol-4-yl)pyridin-2-amine; and has the following structure:

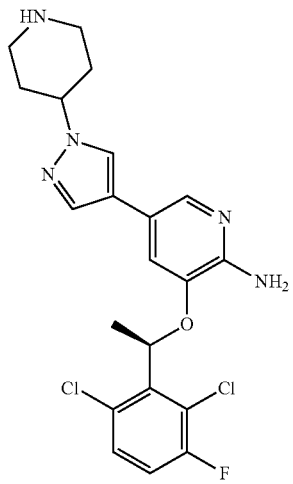

Crizotinib Chemical Structure
Molecular Weight: 450.34.

In some embodiments, the ROS1 inhibitor is TAE684 (NVP-TAE684). TAE684 is a potent and selective ALK inhibitor with IC50 of 3 nM, 100-fold more sensitive for ALK than InsR. TAE684 has the chemical name: 5-chloro-N4-(2-(isopropylsulfonyl)phenyl)-N2-(2-methoxy-4-(4-(4-methylpiperazin-1-yl)piperidin-1-yl)phenyl)pyrimidine-2,4-diamine; and has the following structure:

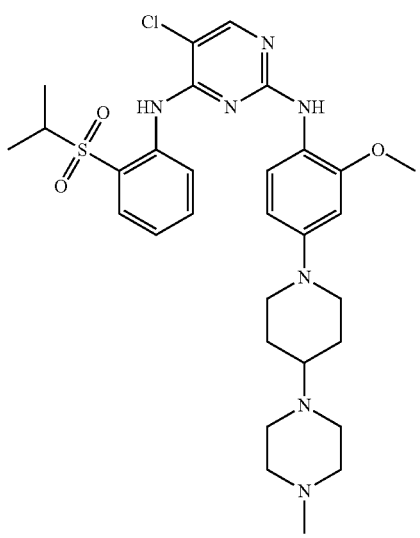

TAE684 Chemical Structure
Molecular Weight: 614.2.

MTOR Inhibitors

In other embodiments, the agent is a MTOR inhibitor. In other embodiments, the MTOR inhibitor is chosen from: BMS-906024, PF-03084014, and/or MK-0752. BEZ235 (NVP-BEZ235); Everolimus (RAD001); Rapamycin (Sirolimus, AY-22989, WY-090217); AZD8055; Temsirolimus (CCI-779, Torisel); PI-103; Ku-0063794; Deforolimus (Ridaforolimus, AP23573, MK-8669); PP242; XL765; GSK1059615; WYE-354; OSI-027; GDC-0980 (RG7422); GSK2126458; PF-05212384 (PKI-587); PF-04691502; Palomid 529 (P529); PP-121; WYE-125132; WYE-687; NVP-BGT226; WAY-600; AZD2014; CH5132799; INK 128; or Torin1.

In some embodiments, the MTOR inhibitor is BEZ235. BEZ235 (NVP-BEZ235) is a dual ATP-competitive PI3K and mTOR inhibitor for p110α/γ/δ/β and mTOR (p70S6K) with IC50 of 4 nM/5 nM/7 nM/75 nM/6 nM, respectively. Inhibits ATR with IC50 of 21 nM; shown to be poor inhibitory to Akt and PDK1. BEZ235 has the chemical name: 2-methyl-2-(4-(3-methyl-2-oxo-8-(quinolin-3-yl)-2,3-dihydroimidazo[4,5-c]quinolin-1-yl)phenyl)propanenitrile; and has the following structure:

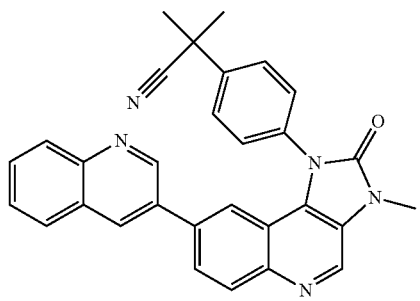

BEZ235 Chemical Structure
Molecular Weight: 469.55.

In some embodiments, the MTOR inhibitor is Everolimus. Everolimus (RAD001) is an mTOR inhibitor of FKBP12 with IC50 of 1.6-2.4 nM. Everolimus has the chemical name 23,27-Epoxy-3H-pyrido[2,1-c][1,4]oxaazacyclohentriacontine, rapamycin deriv; and has the following structure:

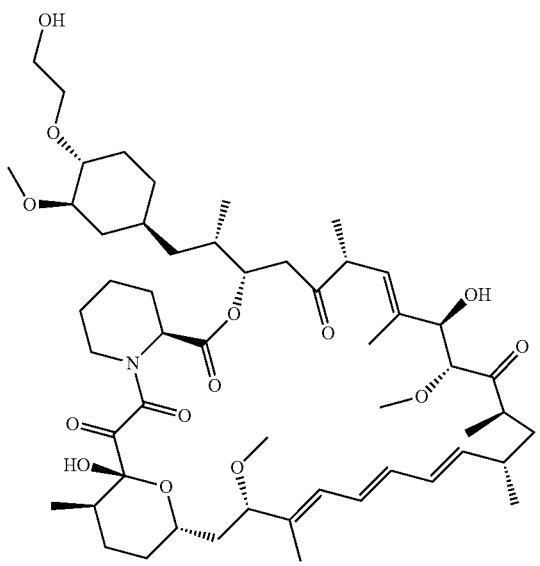

Everolimus Chemical Structure
Molecular Weight: 958.22.

In some embodiments, the MTOR inhibitor is Rapamycin. Rapamycin (Sirolimus, AY-22989, WY-090217) is a specific mTOR inhibitor with IC50 of ~0.1 nM. Rapamycin has the chemical name (3S,6R,7E,9R,10R,12R,14S,15E,17E,19E,21S,23S,26R,27R,34aS)-9,10,12,13,14,21,22,23,24,25,26,27,32,33,34,34a-Hexadecahydro-9,27-dihydroxy-3-[(1R)-2-[(1S,3R,4R)-4-hydroxy-3-methoxycyclohexyl]-1-methylethyl]-10,21-dimethoxy-6,8,12,14,20,26-hexamethyl-23,27-epoxy-3H-pyrido[2,1-c][1,4]oxaazacyclohentriacontine-1,5,11,28,29(4H,6H,31H)-pentone; and has the following structure:

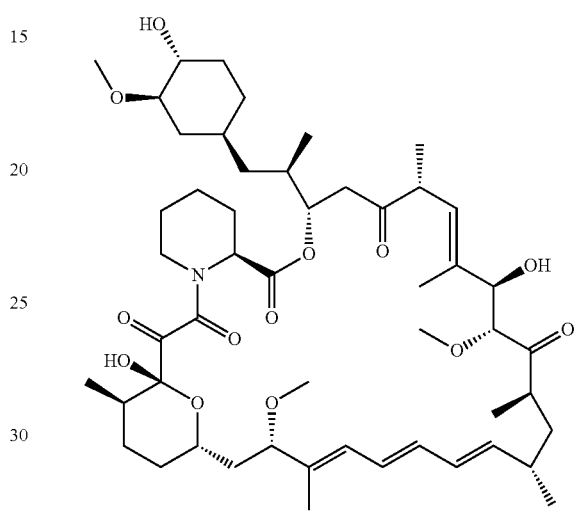

Rapamycin Chemical Structure
Molecular Weight: 914.18.

In some embodiments, the MTOR inhibitor is AZD8055. AZD8055 is a novel ATP-competitive mTOR inhibitor with IC50 of 0.8 nM with excellent selectivity (~1,000-fold) against PI3K isoforms and ATM/DNA-PK. AZD8055 has the chemical name (5-(2,4-bis((S)-3-methylmorpholino)pyrido[2,3-d]pyrimidin-7-yl)-2-methoxyphenyl)methanol; and has the following structure:

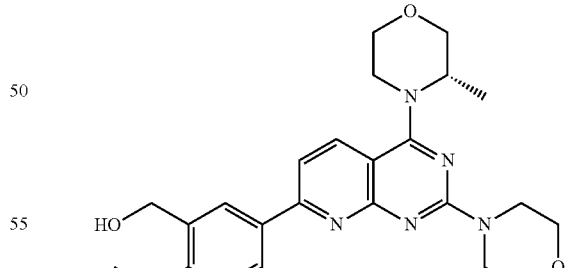

AZD8055 Chemical Structure
Molecular Weight: 465.54.

In some embodiments, the MTOR inhibitor is Temsirolimus. Temsirolimus (CCI-779) is a specific mTOR inhibitor with IC50 of 1.76 μM. Temsirolimus has the chemical name Rapamycin, 42-[3-hydroxy-2-(hydroxymethyl)-2-methylpropanoate]; and has the following structure:

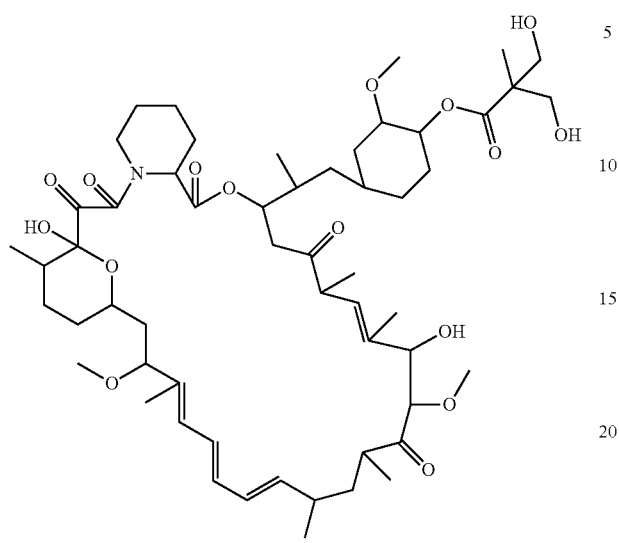

Temsirolimus Chemical Structure
Molecular Weight: 1030.29.

In some embodiments, the MTOR inhibitor is PI-103. PI-103 is a multi-targeted PI3K inhibitor for p110α/β/δ/γ with IC50 of 2 nM/3 nM/3 nM/15 nM, less potent to mTOR/DNA-PK with IC50 of 30 nM/23 nM. PI-103 has the chemical name Phenol, 3-[4-(4-morpholinyl)pyrido[3',2':4,5]furo[3,2-d]pyrimidin-2-yl]-; and has the following structure:

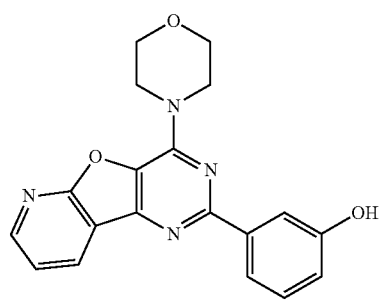

PI-103 Chemical Structure
Molecular Weight: 348.36.

In some embodiments, the MTOR inhibitor is Ku-0063794. KU-0063794 is a potent and highly specific dual-mTOR inhibitor of mTORC1 and mTORC2 with IC50 of −10 nM; no effect on PI3Ks. Ku-0063794 has the chemical name (5-(2-((2R,6S)-2,6-dimethylmorpholino)-4-morpholinopyrido[2,3-d]pyrimidin-7-yl)-2-methoxyphenyl)methanol; and has the following structure:

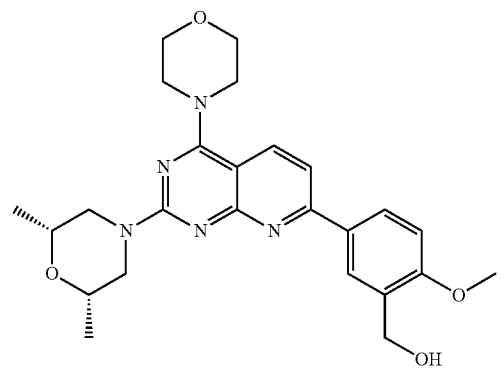

Ku-0063794 Chemical Structure
Molecular Weight: 465.54.

In some embodiments, the MTOR inhibitor is Deforolimus. Ridaforolimus (Deforolimus) is a selective mTOR inhibitor with IC50 of 0.2 nM; while not classified as a prodrug, mTOR inhibition and FKBP12 binding is similar to rapamycin. Deforolimus has the following structure:

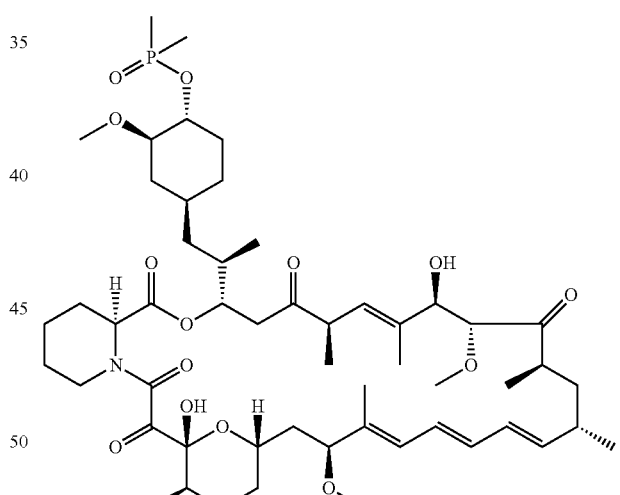

Deforolimus Chemical Structure
Molecular Weight: 990.21.

In some embodiments, the MTOR inhibitor is PP242. PP242 is a selective mTOR inhibitor with IC50 of 8 nM; targets both mTOR complexes with >10- and 100-fold selectivity for mTOR than PI3Kδ or PI3Kα/β/γ, respectively. PP242 has the chemical name 2-(4-amino-1-isopropyl-1H-pyrazolo[3,4-d]pyrimidin-3-yl)-1H-indol-5-ol; and has the following structure:

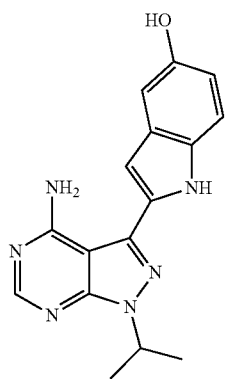

PP242 Chemical Structure
Molecular Weight: 308.34.

In some embodiments, the MTOR inhibitor is XL765. SAR245409 (XL765) is a dual inhibitor of mTOR/PI3K, mostly for p110γ with IC50 of 9 nM; also inhibits DNA-PK and mTOR. XL765 has the chemical name Benzamide, N-[4-[[[3-[(3,5-dimethoxyphenyl)amino]-2-quinoxalinyl]amino]sulfonyl]phenyl]-3-methoxy-4-methyl-; and has the following structure:

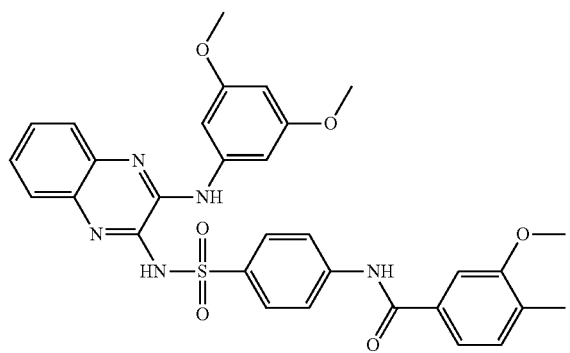

XL765 Chemical Structure
Molecular Weight: 599.66.

In some embodiments, the MTOR inhibitor is GSK1059615. GSK1059615 is a dual inhibitor of PI3Kα/β/δ/γ (reversible) and mTOR with IC50 of 0.4 nM/0.6 nM/2 nM/5 nM and 12 nM, respectively. GSK1059615 has the chemical name (Z)-5-((4-(pyridin-4-yl)quinolin-6-yl)methylene)thiazolidine-2,4-dione; and has the following structure:

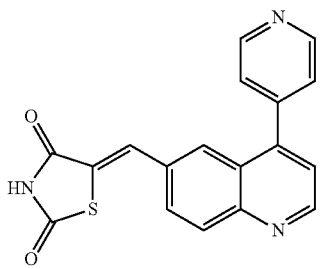

GSK1059615 Chemical Structure
Molecular Weight: 333.36.

In some embodiments, the MTOR inhibitor is WYE-354. WYE-354 is a potent, specific and ATP-competitive inhibitor of mTOR with IC50 of 5 nM, blocks mTORC1/P-S6K (T389) and mTORC2/P-AKT (S473) not P-AKT (T308), selective for mTOR than PI3Kα (>100-fold) and PI3Kγ (>500-fold). WYE-354 has the following structure:

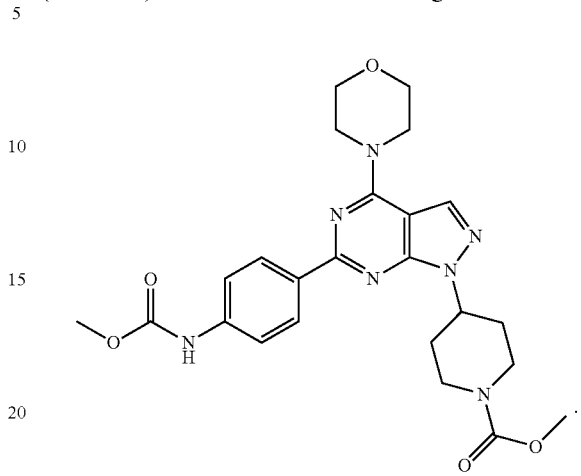

WYE-354 Chemical Structure
Molecular Weight: 495.53

In some embodiments, the MTOR inhibitor is OSI-027. OSI-027 is a selective and potent dual inhibitor of mTORC1 and mTORC2 with IC50 of 22 nM and 65 nM, and more than 100-fold selectivity observed for mTOR than PI3Kα, PI3Kβ, PI3Kγ or DNA-PK. OSI-027 has the chemical name (1r,4r)-4-(4-amino-5-(7-methoxy-1H-indol-2-yl)imidazo[1,5-f][1,2,4]triazin-7-yl)cyclohexanecarboxylic acid; and has the following structure:

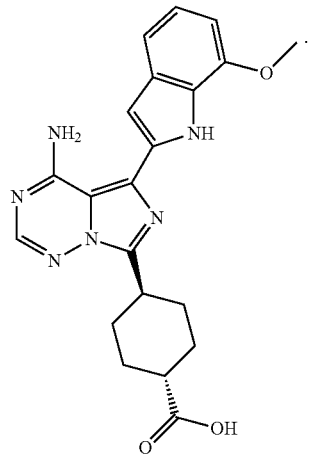

OSI-027 Chemical Structure
Molecular Weight: 406.44

In some embodiments, the MTOR inhibitor is GDC-0980. GDC-0980 (RG7422) is a potent, class I PI3K inhibitor for PI3Kα/β/δ/γ with IC50 of 5 nM/27 nM/7 nM/14 nM, respectively. Also a mTOR inhibitor with $K_i$ of 17 nM, and highly selective versus others PIKK family kinases. GDC-0980 has the chemical name (S)-1-(4-((2-(2-aminopyrimidin-5-yl)-7-methyl-4-morpholinothieno[3,2-d]pyrimidin-6-yl)methyl)piperazin-1-yl)-2-hydroxypropan-1-one; and has the following structure:

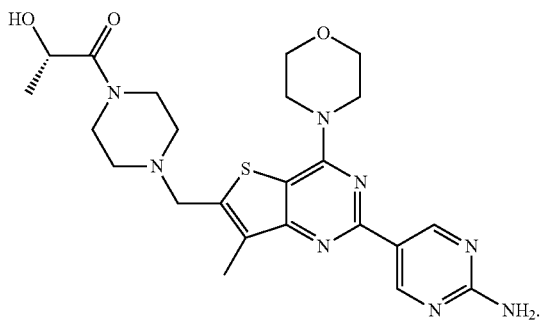

GDC-0980 Chemical Structure
Molecular Weight: 498.6

In some embodiments, the MTOR inhibitor is GSK2126458. GSK2126458 is a highly selective and potent inhibitor of p110α/β/γ/δ, mTORC1/2 with $K_i$ of 0.019 nM/0.13 nM/0.024 nM/0.06 nM and 0.18 nM/0.3 nM, respectively. GSK2126458 has the chemical name 2,4-difluoro-N-(2-methoxy-5-(4-(pyridazin-4-yl)quinolin-6-yl)pyridin-3-yl)benzenesulfonamide; and has the following structure:

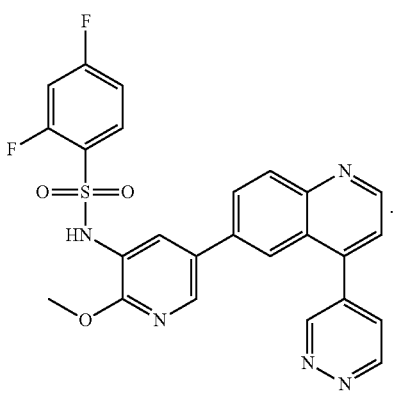

GSK2126458 Chemical Structure
Molecular Weight: 505.5

In some embodiments, the MTOR inhibitor is PF-04691502. PF-04691502 is an ATP-competitive PI3K (α/β/δ/γ)/mTOR dual inhibitor with $K_i$ of 1.8 nM/2.1 nM/1.6 nM/1.9 nM and 16 nM, little activity against either Vps34, AKT, PDK1, p70S6K, MEK, ERK, p38, or JNK. PF-04691502 has the chemical name 2-amino-8-((1 r,4r)-4-(2-hydroxyethoxy)cyclohexyl)-6-(6-methoxypyridin-3-yl)-4-methylpyrido[2,3-d]pyrimidin-7(8H)-one; and has the following structure:

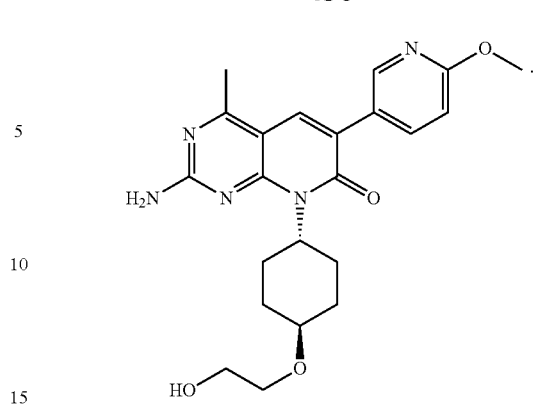

PF-04691502 Chemical Structure
Molecular Weight: 425.48

In some embodiments, the MTOR inhibitor is PF-05212384. PKI-587 is a highly potent dual inhibitor of PI3Kα, PI3Kγ and mTOR with IC50 of 0.4 nM, 5.4 nM and 1.6 nM, respectively. PF-05212384 has the chemical name 1-(4-(4-(dimethylamino)piperidine-1-carbonyl)phenyl)-3-(4-(4,6-dimorpholino-1,3,5-triazin-2-yl)phenyl)urea; and has the following structure:

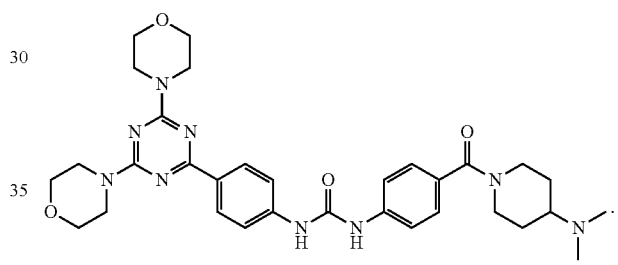

PF-05212384 Chemical Structure
Molecular Weight: 615.73

In some embodiments, the MTOR inhibitor is Palomid 529. Palomid 529 inhibits both the mTORC1 and mTORC2 complexes, reduces phosphorylation of pAktS473, pGSK3βS9, and pS6 but no effect observed on pMAPK or pAktT308. Palomid 529 has the chemical name 3-(4-methoxybenzyloxy)-8-(1-hydroxyethyl)-2-methoxy-6H-benzo[c]chromen-6-one; and has the following structure:

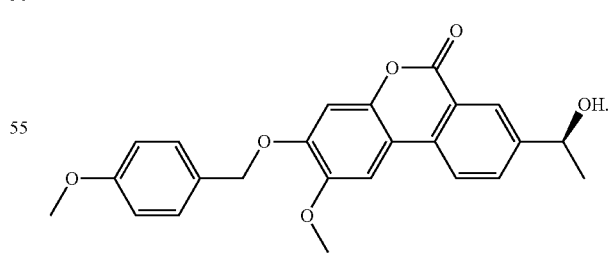

Palomid 529 Chemical Structure
Molecular Weight: 406.43

In some embodiments, the MTOR inhibitor is PP-121. PP-121 is a multi-targeted inhibitor of PDGFR, Hck, mTOR, VEGFR2, Src and Abl with IC50 of 2 nM, 8 nM, 10 nM, 12 nM, 14 nM and 18 nM, also inhibits DNA-PK with IC50 of 60 nM. PP-121 has the chemical name 1-cyclopentyl-3-(1H-pyrrolo[2,3-b]pyridin-5-yl)-1H-pyrazolo[3,4-d]pyrimidin-4-amine; and has the following structure:

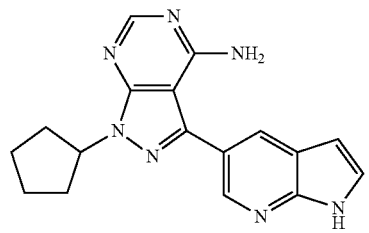

PP-121 Chemical Structure
Molecular Weight: 319.36.

In some embodiments, the MTOR inhibitor is WYE-125132. WYE-125132 is a highly potent, ATP-competitive mTOR inhibitor with IC50 of 0.19 nM; highly selective for mTOR versus PI3Ks or PI3K-related kinases hSMG1 and ATR. WYE-125132 has the chemical name Urea, N-[4-[1-(1,4-dioxaspiro[4.5]dec-8-yl)-4-(8-oxa-3-azabicyclo[3.2.1]oct-3-yl)-1H-pyrazolo[3,4-d]pyrimidin-6-yl]phenyl]-N'-methyl-; and has the following structure:

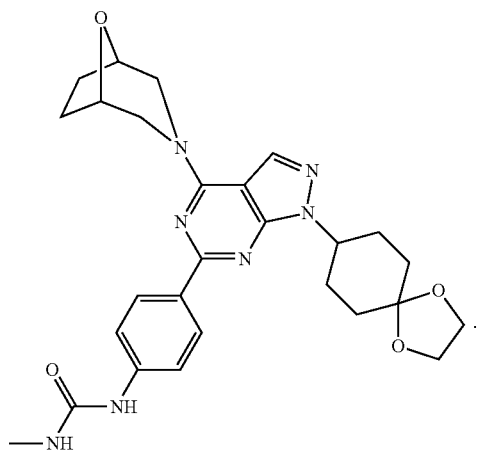

WYE-125132 Chemical Structure
Molecular Weight: 519.6

In some embodiments, the MTOR inhibitor is WYE-687. WYE-687 is an ATP-competitive and selective inhibitor of mTOR with IC50 of 7 nM; blocks mTORC1/pS6K (T389) and mTORC2/P-AKT (S473) but no effect observed on P-AKT (T308). Selectivity for mTOR is greater than PI3Kα (>100-fold) and PI3Kγ (>500-fold). WYE-687 has the chemical name methyl 4-(4-morpholino-1-(1-(pyridin-3-ylmethyl)piperidin-4-yl)-1H-pyrazolo[3,4-d]pyrimidin-6-yl)phenylcarbamate; and has the following structure:

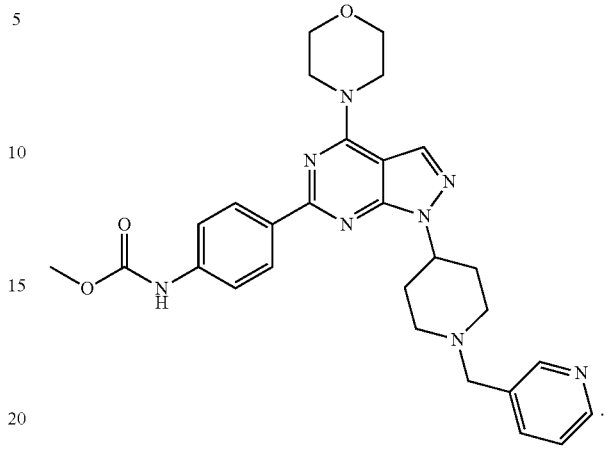

WYE-687 Chemical Structure
Molecular Weight: 528.61

In some embodiments, the MTOR inhibitor is NVP-BGT226. NVP-BGT226 is a novel class I PI3K/mTOR inhibitor for PI3Kα/β/γ with IC50 of 4 nM/63 nM/38 nM. NVP-BGT226 has the chemical name 8-(6-methoxypyridin-3-yl)-3-methyl-1-(4-(piperazin-1-yl)-3-(trifluoromethyl)phenyl)-1H-imidazo[4,5-c]quinolin-2(3H)-one Maleic acid; and has the following structure:

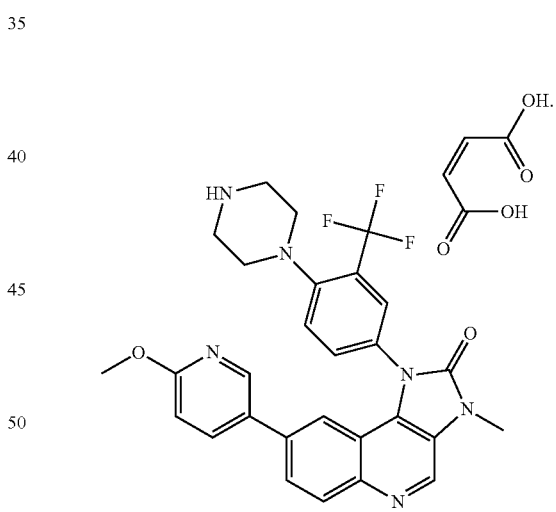

NVP-BGT226 Chemical Structure
Molecular Weight: 650.6

In some embodiments, the MTOR inhibitor is WAY-600. WAY-600 is a potent, ATP-competitive and selective inhibitor of mTOR with IC50 of 9 nM; blocks mTORC1/P-S6K (T389) and mTORC2/P-AKT (S473) but not P-AKT (T308); selective for mTOR than PI3Kα (>100-fold) and PI3Kγ (>500-fold). WAY-600 has the chemical name 6-(1H-indol-5-yl)-4-morpholino-1-(1-(pyridin-3-ylmethyl)piperidin-4-yl)-1H-pyrazolo[3,4-d]pyrimidine; and has the following structure:

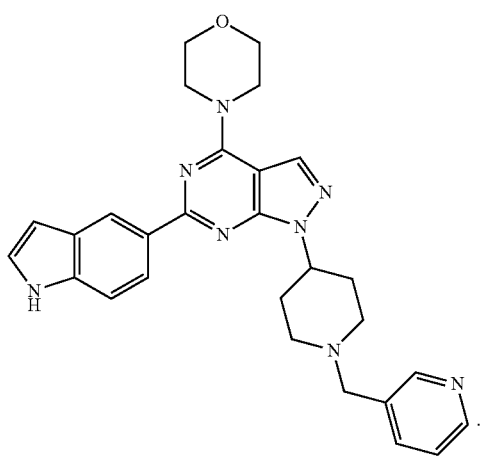

WAY-600 Chemical Structure
Molecular Weight: 494.59

In some embodiments, the MTOR inhibitor is AZD2014. AZD2014 is a novel mTOR inhibitor with IC50 of 2.8 nM; highly selective against multiple PI3K isoforms (α/β/γ/δ). AZD2014 has the chemical name 3-(2,4-bis((S)-3-methyl-morpholino)pyrido[2,3-d]pyrimidin-7-yl)-N-methylbenz-amide; and has the following structure:

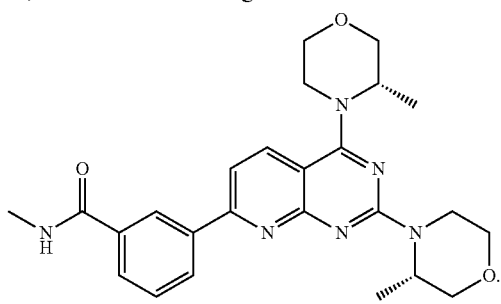

AZD2014 Chemical Structure
Molecular Weight: 462.54

In some embodiments, the MTOR inhibitor is CH5132799. CH5132799 inhibits class I PI3Ks, particularly PI3Kα with IC50 of 14 nM; less potent to PI3Kβδγ, while sensitive in PIK3CA mutations cell lines. CH5132799 has the chemical name 5-(7-(methylsulfonyl)-2-morpholino-6,7-dihydro-5H-pyrrolo[2,3-d]pyrimidin-4-yl)pyrimidin-2-amine; and has the following structure:

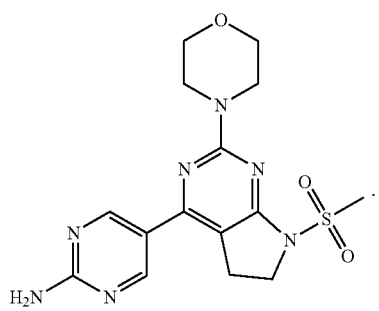

CH5132799 Chemical Structure
Molecular Weight: 377.42

In some embodiments, the MTOR inhibitor is INK 128. INK 128 is a potent and selective mTOR inhibitor with IC50 of 1 nM; >200-fold less potent to class I PI3K isoforms, superior in blocking mTORC1/2 and sensitive to pro-invasion genes (vs Rapamycin). INK 128 has the chemical name 3-(2-aminobenzo[d]oxazol-5-yl)-1-isopropyl-1H-pyrazolo[3,4-d]pyrimidin-4-amine; and has the following structure:

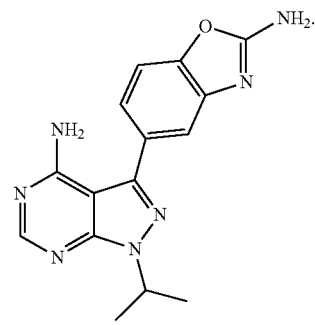

INK 128 Chemical Structure
Molecular Weight: 309.33

In some embodiments, the MTOR inhibitor is Torin1. Torin1 is a potent and selective mTOR inhibitor (IC50=2-10 nM for mTORC1 and mTORC2). Displays 200-fold selectivity for mTOR over DNA-PK, ATM and hVps34. Torin1 has the chemical name 1-[4-[4-(1-Oxopropyl)-1-piperazinyl]-3-(trifluoromethyl)phenyl]-9-(3-quinolinyl)-benzo[h]-1,6-naphthyridin-2(1H)-one; and has the following structure:

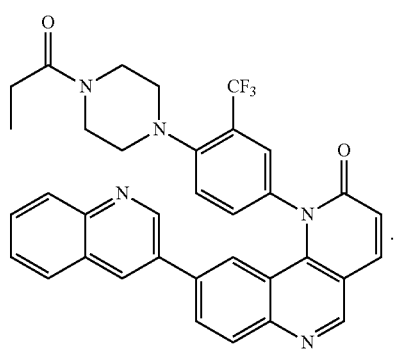

Torin1 Chemical Structure
Molecular Weight: 607.62

In other embodiments, the anti-cancer agent is a fusion antagonist inhibits the expression of nucleic acid encoding a fusion described herein. Examples of such fusion antagonists include nucleic acid molecules, for example, antisense molecules, ribozymes, RNAi, triple helix molecules that hybridize to a nucleic acid encoding a fusion described herein, or a transcription regulatory region, and blocks or reduces mRNA expression of a fusion described herein.

In other embodiments, the kinase inhibitor is administered in combination with a second therapeutic agent or a different therapeutic modality, e.g., anti-cancer agents, and/or in combination with surgical and/or radiation procedures.

By "in combination with," it is not intended to imply that the therapy or the therapeutic agents must be administered at the same time and/or formulated for delivery together, although these methods of delivery are within the scope of the invention. The pharmaceutical compositions can be administered concurrently with, prior to, or subsequent to, one or more other additional therapies or therapeutic agents. In general, each agent will be administered at a dose and/or on a time schedule determined for that agent. In will further be appreciated that the additional therapeutic agent utilized in this combination can be administered together in a single composition or administered separately in different compositions. The particular combination to employ in a regimen will take into account compatibility of the inventive pharmaceutical composition with the additional therapeutically active agent and/or the desired therapeutic effect to be achieved.

For example, the second therapeutic agent can be a cytotoxic or a cytostatic agent. Exemplary cytotoxic agents include antimicrotubule agents, topoisomerase inhibitors, or taxanes, antimetabolites, mitotic inhibitors, alkylating agents, intercalating agents, agents capable of interfering with a signal transduction pathway, agents that promote apoptosis and radiation. In yet other embodiments, the methods can be used in combination with immunodulatory agents, e.g., IL-1, 2, 4, 6, or 12, or interferon alpha or gamma, or immune cell growth factors such as GM-CSF.

Anti-cancer agents, e.g., kinase inhibitors, used in therapeutic methods can be evaluated using the screening assays described herein. In one embodiment, the anti-cancer agents are evaluated in a cell-free system, e.g., a cell lysate or in a reconstituted system. In other embodiments, the anti-cancer agents are evaluated in a cell in culture, e.g., a cell expressing fusion molecule described herein (e.g., a mammalian cell, a tumor cell or cell line, a recombinant cell). In yet other embodiments, the anti-cancer agents are evaluated cell in vivo (a fusion molecule-expressing cell present in a subject, e.g., an animal subject (e.g., an in vivo animal model).

Exemplary parameters evaluated include one or more of:
(i) a change in binding activity, e.g., direct binding of the candidate agent to a fusion polypeptide described herein; a binding competition between a known ligand and the candidate agent to a fusion polypeptide described herein;
(ii) a change in kinase activity, e.g., phosphorylation levels of a fusion polypeptide described herein (e.g., an increased or decreased autophosphorylation); or a change in phosphorylation of a target of an kinase;
(iii) a change in an activity of a cell containing a fusion described herein (e.g., a tumor cell or a recombinant cell), e.g., a change in proliferation, morphology or tumorigenicity of the cell;
(iv) a change in tumor present in an animal subject, e.g., size, appearance, proliferation, of the tumor; or
(v) a change in the level, e.g., expression level, of a fusion polypeptide described herein or nucleic acid molecule described herein.

In one embodiment, a change in a cell free assay in the presence of a candidate agent is evaluated. For example, an activity of a fusion molecule described herein, or interaction of a fusion molecule described herein with a downstream ligand can be detected.

In other embodiments, a change in an activity of a cell is detected in a cell in culture, e.g., a cell expressing a fusion molecule described herein (e.g., a mammalian cell, a tumor cell or cell line, a recombinant cell). In one embodiment, the cell is a recombinant cell that is modified to express a fusion nucleic acid described herein, e.g., is a recombinant cell transfected with a fusion nucleic acid described herein. The transfected cell can show a change in response to the expressed fusion molecule described herein, e.g., increased proliferation, changes in morphology, increased tumorigenicity, and/or acquired a transformed phenotype. A change in any of the activities of the cell, e.g., the recombinant cell, in the presence of the candidate agent can be detected. For example, a decrease in one or more of: proliferation, tumorigenicity, transformed morphology, in the presence of the candidate agent can be indicative of an inhibitor of a fusion molecule described herein. In other embodiments, a change in binding activity or phosphorylation as described herein is detected.

In yet other embodiment, a change in a tumor present in an animal subject (e.g., an in vivo animal model) is detected. In one embodiment, the animal model is a tumor containing animal or a xenograft comprising cells expressing a fusion molecule described herein (e.g., tumorigenic cells expressing a fusion molecule described herein). The anti-cancer agents can be administered to the animal subject and a change in the tumor is detected. In one embodiment, the change in the tumor includes one or more of a tumor growth, tumor size, tumor burden, survival, is evaluated. A decrease in one or more of tumor growth, tumor size, tumor burden, or an increased survival is indicative that the candidate agent is an inhibitor.

The screening methods and assays are described in more detail herein below.

Screening Methods

In another aspect, the invention features a method, or assay, for screening for agents that modulate, e.g., inhibit, the expression or activity of a fusion molecule described herein. The method includes contacting a fusion molecule described herein, or a cell expressing a fusion molecule described herein, with a candidate agent; and detecting a change in a parameter associated with a fusion molecule described herein, e.g., a change in the expression or an activity of the fusion molecule described herein. The method can, optionally, include comparing the treated parameter to a reference value, e.g., a control sample (e.g., comparing a parameter obtained from a sample with the candidate agent to a parameter obtained from a sample without the candidate agent). In one embodiment, if a decrease in expression or activity of the fusion molecule described herein is detected, the candidate agent is identified as an inhibitor. In another embodiment, if an increase in expression or activity of the fusion molecule described herein is detected, the candidate agent is identified as an activator. In certain embodiments, the fusion molecule described herein is a nucleic acid molecule or a polypeptide as described herein.

In one embodiment, the contacting step is effected in a cell-free system, e.g., a cell lysate or in a reconstituted system. In other embodiments, the contacting step is effected in a cell in culture, e.g., a cell expressing a fusion molecule described herein (e.g., a mammalian cell, a tumor cell or cell line, a recombinant cell). In yet other embodiments, the contacting step is effected in a cell in vivo (a fusion molecule described herein-expressing cell present in a subject, e.g., an animal subject (e.g., an in vivo animal model).

Exemplary parameters evaluated include one or more of:
(i) a change in binding activity, e.g., direct binding of the candidate agent to a fusion polypeptide described herein; a binding competition between a known ligand and the candidate agent to a fusion polypeptide described herein;
(ii) a change in kinase activity, e.g., phosphorylation levels of a fusion polypeptide described herein (e.g., an increased or decreased autophosphorylation); or a change in phosphorylation of a target of an kinase. In certain embodiments, a change in kinase activity, e.g., phosphorylation, is detected by any of Western blot (e.g., using an anti-FGFR3 or anti-TACC3 antibody; a phosphor-specific antibody, detecting a shift in the molecular weight of a FGFR3-TACC3 fusion polypeptide), mass spectrometry, immunoprecipitation, immunohistochemistry, immunomagnetic beads, among others;

(iii) a change in an activity of a cell containing a fusion molecule described herein (e.g., a tumor cell or a recombinant cell), e.g., a change in proliferation, morphology or tumorigenicity of the cell;

(iv) a change in tumor present in an animal subject, e.g., size, appearance, proliferation, of the tumor; or (v) a change in the level, e.g., expression level, of a fusion polypeptide described herein or nucleic acid molecule described herein.

In one embodiment, a change in a cell free assay in the presence of a candidate agent is evaluated. For example, an activity of a fusion molecule described herein, or interaction of a fusion molecule described herein with a downstream ligand can be detected. In one embodiment, a fusion polypeptide described herein is contacted with a ligand, e.g., in solution, and a candidate agent is monitored for an ability to modulate, e.g., inhibit, an interaction, e.g., binding, between the fusion polypeptide described herein and the ligand. In one exemplary assay, purified fusion protein described herein is contacted with a ligand, e.g., in solution, and a candidate agent is monitored for an ability to inhibit interaction of the fusion protein with the ligand, or to inhibit phosphorylation of the ligand by the fusion protein. An effect on an interaction between the fusion protein and a ligand can be monitored by methods known in the art, such as by absorbance, and an effect on phosphorylation of the ligand can be assayed, e.g., by Western blot, immunoprecipitation, or immunomagnetic beads.

In other embodiments, a change in an activity of a cell is detected in a cell in culture, e.g., a cell expressing a fusion molecule described herein (e.g., a mammalian cell, a tumor cell or cell line, a recombinant cell). In one embodiment, the cell is a recombinant cell that is modified to express a fusion nucleic acid described herein, e.g., is a recombinant cell transfected with a fusion nucleic acid described herein. The transfected cell can show a change in response to the expressed fusion molecule, e.g., increased proliferation, changes in morphology, increased tumorigenicity, and/or acquired a transformed phenotype. A change in any of the activities of the cell, e.g., the recombinant cell, in the presence of the candidate agent can be detected. For example, a decrease in one or more of: proliferation, tumorigenicity, transformed morphology, in the presence of the candidate agent can be indicative of an inhibitor of a fusion molecule described herein. In other embodiments, a change in binding activity or phosphorylation as described herein is detected.

In an exemplary cell-based assay, a nucleic acid comprising a fusion molecule described herein can be expressed in a cell, such as a cell (e.g., a mammalian cell) in culture. The cell containing a nucleic acid expressing the fusion molecule can be contacted with a candidate agent, and the cell is monitored for an effect of the candidate agent. A candidate agent that causes decreased cell proliferation or cell death can be determined to be a candidate for treating a tumor (e.g., a cancer) that carries a fusion described herein.

In one embodiment, a cell containing a nucleic acid expressing a fusion molecule described herein can be monitored for expression of the fusion protein. Protein expression can be monitored by methods known in the art, such as by, e.g., mass spectrometry (e.g., tandem mass spectrometry), a reporter assay (e.g., a fluorescence-based assay), Western blot, and immunohistochemistry. By one method, decreased fusion expression is detected. A candidate agent that causes decreased expression of the fusion protein as compared to a cell that does not contain the nucleic acid fusion can be determined to be a candidate for treating a tumor (e.g., a cancer) that carries a fusion described herein.

A cell containing a nucleic acid expressing a fusion molecule described herein can be monitored for altered kinase activity. Kinase activity can be assayed by measuring the effect of a candidate agent on a known kinase target protein.

In yet other embodiment, a change in a tumor present in an animal subject (e.g., an in vivo animal model) is detected. In one embodiment, the animal model is a tumor containing animal or a xenograft comprising cells expressing a fusion molecule described herein (e.g., tumorigenic cells expressing a fusion molecule described herein). The candidate agent can be administered to the animal subject and a change in the tumor is detected. In one embodiment, the change in the tumor includes one or more of a tumor growth, tumor size, tumor burden, survival, is evaluated. A decrease in one or more of tumor growth, tumor size, tumor burden, or an increased survival is indicative that the candidate agent is an inhibitor.

In one exemplary animal model, a xenograft is created by injecting cells into mouse. A candidate agent is administered to the mouse, e.g., by injection (such as subcutaneous, intraperitoneal, or tail vein injection, or by injection directly into the tumor) or oral delivery, and the tumor is observed to determine an effect of the candidate anti-cancer agent. The health of the animal is also monitored, such as to determine if an animal treated with a candidate agent survives longer. A candidate agent that causes growth of the tumor to slow or stop, or causes the tumor to shrink in size, or causes decreased tumor burden, or increases survival time, can be considered to be a candidate for treating a tumor (e.g., a cancer) that carries a fusion described herein.

In another exemplary animal assay, cells expressing a fusion described herein are injected into the tail vein, e.g., of a mouse, to induce metastasis. A candidate agent is administered to the mouse, e.g., by injection (such as subcutaneous, intraperitoneal, or tail vein injection, or by injection directly into the tumor) or oral delivery, and the tumor is observed to determine an effect of the candidate anti-cancer agent. A candidate agent that inhibits or prevents or reduces metastasis, or increases survival time, can be considered to be a candidate for treating a tumor (e.g., a cancer) that carries a fusion described herein.

Cell proliferation can be measured by methods known in the art, such as PCNA (Proliferating cell nuclear antigen) assay, 5-bromodeoxyuridine (BrdUrd) incorporation, Ki-67 assay, mitochondrial respiration, or propidium iodide staining. Cells can also be measured for apoptosis, such as by use of a TUNEL (Terminal Deoxynucleotide Transferase dUTP Nick End Labeling) assay. Cells can also be assayed for presence of angiogenesis using methods known in the art, such as by measuring endothelial tube formation or by measuring the growth of blood vessels from subcutaneous tissue, such as into a solid gel of basement membrane.

In other embodiments, a change in expression of a fusion molecule described herein can be monitored by detecting the nucleic acid or protein levels, e.g., using the methods described herein.

In certain embodiments, the screening methods described herein can be repeated and/or combined. In one embodiment, a candidate agent that is evaluated in a cell-free or cell-based described herein can be further tested in an animal subject.

In one embodiment, the candidate agent is identified and re-tested in the same or a different assay. For example, a test compound is identified in an in vitro or cell-free system, and re-tested in an animal model or a cell-based assay. Any order or combination of assays can be used. For example, a high throughput assay can be used in combination with an animal model or tissue culture.

Candidate agents suitable for use in the screening assays described herein include, e.g., small molecule compounds, nucleic acids (e.g., siRNA, aptamers, short hairpin RNAs, antisense oligonucleotides, ribozymes, antagomirs, microRNA mimics or DNA, e.g., for gene therapy) or polypeptides, e.g., antibodies (e.g., full length antibodies or antigen-binding fragments thereof, Fab fragments, or scFv fragments). The candidate anti-cancer agents can be obtained from a library (e.g., a commercial library), or can be rationally designed, such as to target an active site in a functional domain (e.g., a kinase domain).

In other embodiments, the method, or assay, includes providing a step based on proximity-dependent signal generation, e.g., a two-hybrid assay that includes a first fusion protein (e.g., a fusion protein described herein), and a second fusion protein (e.g., a ligand), contacting the two-hybrid assay with a test compound, under conditions wherein said two hybrid assay detects a change in the formation and/or stability of the complex, e.g., the formation of the complex initiates transcription activation of a reporter gene.

In one non-limiting example, the three-dimensional structure of the active site of fusion molecule described herein is determined by crystallizing the complex formed by the fusion molecule and a known inhibitor. Rational drug design is then used to identify new test agents by making alterations in the structure of a known inhibitor or by designing small molecule compounds that bind to the active site of the fusion.

The candidate agents can be obtained using any of the numerous approaches in combinatorial library methods known in the art, including: biological libraries; peptoid libraries (libraries of molecules having the functionalities of peptides, but with a novel, non-peptide backbone which are resistant to enzymatic degradation but which nevertheless remain bioactive; see, e.g., Zuckermann, R. N. et al. (1994) *J. Med. Chem.* 37:2678-85); spatially addressable parallel solid phase or solution phase libraries; synthetic library methods requiring deconvolution; the 'one-bead one-compound' library method; and synthetic library methods using affinity chromatography selection. The biological library and peptoid library approaches are limited to peptide libraries, while the other four approaches are applicable to peptide, non-peptide oligomer or small molecule libraries of compounds (Lam (1997) *Anticancer Drug Des.* 12:145).

Examples of methods for the synthesis of molecular libraries can be found in the art, for example in: DeWitt et al. (1993) *Proc. Natl. Acad. Sci. U.S.A.* 90:6909; Erb et al. (1994) *Proc. Natl. Acad. Sci. USA* 91:11422; Zuckermann et al. (1994). *J. Med. Chem.* 37:2678; Cho et al. (1993) *Science* 261:1303; Carrell et al. (1994) *Angew. Chem. Int. Ed. Engl.* 33:2059; Carell et al. (1994) *Angew. Chem. Int. Ed. Engl.* 33:2061; and Gallop et al. (1994) *J. Med. Chem.* 37:1233.

Libraries of compounds may be presented in solution (e.g., Houghten (1992) *Biotechniques* 13:412-421), or on beads (Lam (1991) *Nature* 354:82-84), chips (Fodor (1993) *Nature* 364:555-556), bacteria (Ladner, U.S. Pat. No. 5,223, 409), spores (Ladner U.S. Pat. No. 5,223,409), plasmids (Cull et al. (1992) *Proc Natl Acad Sci USA* 89:1865-1869) or on phage (Scott and Smith (1990) *Science* 249:386-390; Devlin (1990) *Science* 249:404-406; Cwirla et al. (1990) *Proc. Natl. Acad. Sci.* 87:6378-6382; Felici (1991) *J. Mol. Biol.* 222:301-310; Ladner supra.).

The interaction between two molecules can also be detected, e.g., using fluorescence energy transfer (FET) (see, for example, Lakowicz et al., U.S. Pat. No. 5,631,169; Stavrianopoulos, et al., U.S. Pat. No. 4,868,103). A fluorophore label on the first, 'donor' molecule is selected such that its emitted fluorescent energy will be absorbed by a fluorescent label on a second, 'acceptor' molecule, which in turn is able to fluoresce due to the absorbed energy. Alternately, the 'donor' protein molecule may simply utilize the natural fluorescent energy of tryptophan residues. Labels are chosen that emit different wavelengths of light, such that the 'acceptor' molecule label may be differentiated from that of the 'donor'. Since the efficiency of energy transfer between the labels is related to the distance separating the molecules, the spatial relationship between the molecules can be assessed. In a situation in which binding occurs between the molecules, the fluorescent emission of the 'acceptor' molecule label in the assay should be maximal. An FET binding event can be conveniently measured through standard fluorometric detection means known in the art (e.g., using a fluorimeter).

In another embodiment, determining the ability of the fusion protein to bind to a target molecule can be accomplished using real-time Biomolecular Interaction Analysis (BIA) (see, e.g., Sjolander, S. and Urbaniczky, C. (1991) *Anal. Chem.* 63:2338-2345 and Szabo et al. (1995) *Curr. Opin. Struct. Biol.* 5:699-705). "Surface plasmon resonance" or "BIA" detects biospecific interactions in real time, without labeling any of the interactants (e.g., BIAcore). Changes in the mass at the binding surface (indicative of a binding event) result in alterations of the refractive index of light near the surface (the optical phenomenon of surface plasmon resonance (SPR)), resulting in a detectable signal which can be used as an indication of real-time reactions between biological molecules.

Nucleic Acid Inhibitors

In another embodiment, a fusion inhibitor inhibits the expression of a nucleic acid encoding a fusion described herein. Examples of such fusion inhibitors include nucleic acid molecules, for example, antisense molecules, dsRNA, siRNA, ribozymes, or triple helix molecules, which hybridize to a nucleic acid encoding a fusion described herein, or a transcription regulatory region, and blocks or reduces mRNA expression of the fusion. Accordingly, isolated nucleic acid molecules that are nucleic acid inhibitors, e.g., antisense, siRNA, RNAi, to a fusion-encoding nucleic acid molecule are provided.

Antisense

In some embodiments, the nucleic acid fusion inhibitor is an antisense nucleic acid molecule. An "antisense" nucleic acid can include a nucleotide sequence which is complementary to a "sense" nucleic acid encoding a protein, e.g., complementary to the coding strand of a double-stranded cDNA molecule or complementary to an mRNA sequence. The antisense nucleic acid can be complementary to an entire fusion coding strand, or to only a portion thereof. In another embodiment, the antisense nucleic acid molecule is antisense to a "noncoding region" of the coding strand of a nucleotide sequence encoding fusion (e.g., the 5' and 3' untranslated regions). Anti-sense agents can include, for example, from about 8 to about 80 nucleobases (i.e., from about 8 to about 80 nucleotides), e.g., about 8 to about 50 nucleobases, or about 12 to about 30 nucleobases. Antisense compounds include ribozymes, external guide sequence (EGS) oligonucleotides (oligozymes), and other short catalytic RNAs or catalytic oligonucleotides which hybridize to the target nucleic acid and modulate its expression. Antisense compounds can include a stretch of at least eight consecutive nucleobases that are complementary to a sequence in the target gene. An oligonucleotide need not be 100% complementary to its target nucleic acid sequence to be specifically hybridizable. An oligonucleotide is specifically hybridizable when binding of the oligonucleotide to the target interferes with the normal function of the target molecule to cause a loss of utility, and there is a sufficient degree of complementarity to avoid non-specific binding of the oligonucleotide to non-target sequences under conditions in which specific binding is desired, i.e., under physiological conditions in the case of in vivo assays or therapeutic treatment or, in the case of in vitro assays, under conditions in which the assays are conducted.

Hybridization of antisense oligonucleotides with mRNA can interfere with one or more of the normal functions of mRNA. The functions of mRNA to be interfered with include all key functions such as, for example, translocation of the RNA to the site of protein translation, translation of protein from the RNA, splicing of the RNA to yield one or more mRNA species, and catalytic activity which may be engaged in by the RNA. Binding of specific protein(s) to the RNA may also be interfered with by antisense oligonucleotide hybridization to the RNA.

Exemplary antisense compounds include DNA or RNA sequences that specifically hybridize to the target nucleic acid, e.g., the mRNA encoding a fusion described herein. The complementary region can extend for between about 8 to about 80 nucleobases. The compounds can include one or more modified nucleobases. Modified nucleobases may include, e.g., 5-substituted pyrimidines such as 5-iodouracil, 5-iodocytosine, and C5-propynyl pyrimidines such as C5-propynylcytosine and C5-propynyluracil. Other suitable modified nucleobases include $N^4$—$(C_1$-$C_{12})$ alkylaminocytosines and $N^4,N^4$—$(C_1$-$C_{12})$ dialkylaminocytosines. Modified nucleobases may also include 7-substituted-8-aza-7-deazapurines and 7-substituted-7-deazapurines such as, for example, 7-iodo-7-deazapurines, 7-cyano-7-deazapurines, 7-aminocarbonyl-7-deazapurines. Examples of these include 6-amino-7-iodo-7-deazapurines, 6-amino-7-cyano-7-deazapurines, 6-amino-7-aminocarbonyl-7-deazapurines, 2-amino-6-hydroxy-7-iodo-7-deazapurines, 2-amino-6-hydroxy-7-cyano-7-deazapurines, and 2-amino-6-hydroxy-7-aminocarbonyl-7-deazapurines. Furthermore, $N^6$—$(C_1$-$C_{12})$ alkylaminopurines and $N^6,N^6$—$(C_1$-$C_{12})$ dialkylaminopurines, including $N^6$-methylaminoadenine and $N^6,N^6$-dimethylaminoadenine, are also suitable modified nucleobases. Similarly, other 6-substituted purines including, for example, 6-thioguanine may constitute appropriate modified nucleobases. Other suitable nucleobases include 2-thiouracil, 8-bromoadenine, 8-bromoguanine, 2-fluoroadenine, and 2-fluoroguanine. Derivatives of any of the aforementioned modified nucleobases are also appropriate. Substituents of any of the preceding compounds may include $C_1$-$C_{30}$ alkyl, $C_2$-$C_{30}$ alkenyl, $C_2$-$C_{30}$ alkynyl, aryl, aralkyl, heteroaryl, halo, amino, amido, nitro, thio, sulfonyl, carboxyl, alkoxy, alkylcarbonyl, alkoxycarbonyl, and the like. Descriptions of other types of nucleic acid agents are also available. See, e.g., U.S. Pat. Nos. 4,987,071; 5,116,742; and U.S. Pat. No. 5,093,246; Woolf et al. (1992) *Proc Natl Acad Sci USA; Antisense RNA and DNA*, D. A. Melton, Ed., Cold Spring Harbor Laboratory, Cold Spring Harbor, N.Y. (1988); 89:7305-9; Haselhoff and Gerlach (1988) *Nature* 334:585-59; Helene, C. (1991) *Anticancer Drug Des.* 6:569-84; Helene (1992) *Ann. N.Y. Acad. Sci.* 660:27-36; and Maher (1992) *Bioassays* 14:807-15.

In yet another embodiment, the antisense nucleic acid molecule is an a-anomeric nucleic acid molecule. An a-anomeric nucleic acid molecule forms specific double-stranded hybrids with complementary RNA in which, contrary to the usual β-units, the strands run parallel to each other (Gaultier et al. (1987) *Nucleic Acids. Res.* 15:6625-6641). The antisense nucleic acid molecule can also comprise a 2'-o-methylribonucleotide (Inoue et al. (1987) *Nucleic Acids Res.* 15:6131-6148) or a chimeric RNA-DNA analogue (Inoue et al. (1987) *FEBS Lett.* 215:327-330).

The antisense nucleic acid molecules are typically administered to a subject (e.g., by direct injection at a tissue site), or generated in situ such that they hybridize with or bind to cellular mRNA and/or genomic DNA encoding a fusion described herein to thereby inhibit expression of the protein, e.g., by inhibiting transcription and/or translation. Alternatively, antisense nucleic acid molecules can be modified to target selected cells and then be administered systemically. For systemic administration, antisense molecules can be modified such that they specifically bind to receptors or antigens expressed on a selected cell surface, e.g., by linking the antisense nucleic acid molecules to peptides or antibodies which bind to cell surface receptors or antigens. The antisense nucleic acid molecules can also be delivered to cells using the vectors described herein. To achieve sufficient intracellular concentrations of the antisense molecules, vector constructs in which the antisense nucleic acid molecule is placed under the control of a strong pol II or pol III promoter are preferred.

Ribozyme

In another embodiment, an antisense nucleic acid featured in the invention is a ribozyme. A ribozyme having specificity for a fusion-encoding nucleic acid can include one or more sequences complementary to the nucleotide sequence of a fusion cDNA disclosed herein, and a sequence having known catalytic sequence responsible for mRNA cleavage (see U.S. Pat. No. 5,093,246 or Haselhoff and Gerlach (1988) Nature 334:585-591). For example, a derivative of a Tetrahymena L-19 IVS RNA can be constructed in which the nucleotide sequence of the active site is complementary to the nucleotide sequence to be cleaved in a fusion-encoding mRNA. See, e.g., Cech et al. U.S. Pat. No. 4,987,071; and Cech et al. U.S. Pat. No. 5,116,742. Alternatively, fusion mRNA can be used to select a catalytic RNA having a specific ribonuclease activity from a pool of RNA molecules. See, e.g., Bartel, D. and Szostak, J. W. (1993) *Science* 261:1411-1418.

Triple Helix Molecules

Inhibition of a fusion gene described herein can be accomplished by targeting nucleotide sequences complementary to the regulatory region of the fusion to form triple helical structures that prevent transcription of the fusion gene in target cells. See generally, Helene, C. (1991) *Anticancer Drug Des.* 6:569-84; Helene, C. i (1992) *Ann. N.Y. Acad. Sci.* 660:27-36; and Maher, L. J. (1992) *Bioassays* 14:807-15. The potential sequences that can be targeted for triple helix formation can be increased by creating a so-called "switchback" nucleic acid molecule. Switchback molecules are synthesized in an alternating 5'-3', 3'-5' manner, such that they base pair with first one strand of a duplex and then the other, eliminating the necessity for a sizeable stretch of either purines or pyrimidines to be present on one strand of a duplex.

dsRNAs

In some embodiments, the nucleic acid fusion inhibitor is a dsRNA molecule. dsRNAs having a duplex structure of between about 20 and 23 base pairs, e.g., 21, base pairs are effective at inducing RNA interference (RNAi) (Elbashir et al., *EMBO* 2001, 20:6877-6888). However, others have found that shorter or longer RNA duplex structures can also be effective (Chu and Rana (2007) *RNA* 14:1714-1719; Kim et al. (2005) *Nat Biotech* 23:222-226).

In one embodiment, the dsRNA, is un-modified, and does not comprise, e.g., chemical modifications and/or conjugations known in the art or described herein. In another embodiment, the dsRNA, is chemically modified to enhance stability or other beneficial characteristics. The dsRNA can be synthesized and/or modified by methods well established in the art, such as those described in "Current protocols in nucleic acid chemistry," Beaucage, S. L. et al. (Edrs.), John Wiley & Sons, Inc., New York, N.Y., USA, which is hereby incorporated herein by reference. While a target sequence of a dsRNA can be generally about 15-30 nucleotides in length, there is wide variation in the suitability of particular sequences in this range for directing cleavage of any given target RNA. Various software packages and the guidelines set out herein provide guidance for the identification of optimal target sequences for any given gene target, but an empirical approach can also be taken in which a "window" or "mask" of a given size (as a non-limiting example, 21 nucleotides) is literally or figuratively (including, e.g., in silico) placed on the target RNA sequence to identify sequences in the size range that can serve as target sequences. By moving the sequence "window" progressively one nucleotide upstream or downstream of an initial target sequence location, the next potential target sequence can be identified, until the complete set of possible sequences is identified for any given target size selected. This process, coupled with systematic synthesis and testing of the identified sequences (using assays as described herein or as known in the art) to identify those sequences that perform optimally can identify those RNA sequences that, when targeted with a dsRNA molecule, mediate the best inhibition of target gene expression. Thus, while the sequences identified herein represent effective target sequences, it is contemplated that further optimization of inhibition efficiency can be achieved by progressively "walking the window" one nucleotide upstream or downstream of the given sequences to identify sequences with equal or better inhibition characteristics.

In some embodiments, the nucleic acid fusion inhibitor is a siRNA molecule. siRNAs are small double stranded RNAs (dsRNAs) that optionally include overhangs. For example, the duplex region of an siRNA is about 18 to 25 nucleotides in length, e.g., about 19, 20, 21, 22, 23, or 24 nucleotides in length. Typically, the siRNA sequences are exactly complementary to the target mRNA. dsRNAs and siRNAs in particular can be used to silence gene expression in mammalian cells (e.g., human cells). siRNAs also include short hairpin RNAs (shRNAs) with 29-base-pair stems and 2-nucleotide 3' overhangs. See, e.g., Clemens et al. (2000) *Proc. Natl. Acad. Sci. USA* 97:6499-6503; Billy et al. (2001) *Proc. Natl. Sci. USA* 98:14428-14433; Elbashir et al. (2001) *Nature*. 411:494-8; Yang et al. (2002) *Proc. Natl. Acad. Sci. USA* 99:9942-9947; Siolas et al. (2005), *Nat. Biotechnol.* 23(2):227-31; 20040086884; U.S. 20030166282; 20030143204; 20040038278; and 20030224432.

Modifications of Nucleic Acid Fusion Inhibitor Molecules

A nucleic acid fusion inhibitor can be modified to enhance or obtain beneficial characteristics. For example, a nucleic acid fusion inhibitor can be modified at the base moiety, sugar moiety or phosphate backbone to improve, e.g., the stability, hybridization, or solubility of the molecule. For non-limiting examples of synthetic oligonucleotides with modifications see Toulmé (2001) *Nature Biotech.* 19:17 and Faria et al. (2001) *Nature Biotech.* 19:40-44. Such phosphoramidite oligonucleotides can be effective antisense agents.

A nucleic acid fusion inhibitor molecule can be modified to include one or more bridged nucleic acids (BNAs). A bridged nucleic acid is a nucleotide bearing a conformationally restricted sugar moiety. Oligonucleotides containing BNAs show high binding affinity with RNA complementary strands, and are more tolerant to endinucleolytic and exonucleolytic degradation (Roongjang, S. et al., (2007) *Nucleic Acids Symp Ser* (Oxf) 51:113-114). Exemplary BNAs include, but are not limited to 2'4'-BNA (also known as LNA (see below); 3'-amino2', 4'-BNA, 3', 4'-BNA; BNA$^{COC}$; BNA$^{Nc}$, and BNA$^{(ME)}$. The structure of the BNA will influence the binding affinity of the nucleic acid molecule with complementary single stranded DNA and double stranded DNA, as well as its enzymatic stability against nuclease degradation. The synthesis and purification of BNA molecules can be performed using standard protocols, (e.g., see Imanishi T, et al., (2002) *Chem. Commun.* 16: 1653-1659).

In some embodiments, the nucleic acid can be modified to generate peptide nucleic acids (see Hyrup B. et al. (1996) *Bioorganic & Medicinal Chemistry* 4: 5-23). As used herein, the terms "peptide nucleic acid" or "PNA" refers to a nucleic acid mimic, e.g., a DNA or RNA mimic, in which the deoxyribose or ribose phosphate backbone is replaced by a pseudopeptide backbone and only the four natural nucleobases are retained. The neutral backbone of a PNA can allow for specific hybridization to DNA and RNA under conditions of low ionic strength. PNAs of nucleic acid fusion inhibitor molecules can be used in therapeutic and diagnostic applications. For example, PNAs can be used as antisense, antigene, siRNA, or RNAi agents for sequence-specific modulation of gene expression by, for example, inducing transcription or translation arrest or inhibiting replication. PNAs of nucleic acid fusion inhibitor molecules can also be used in the analysis of single base pair mutations in a gene, (e.g., by PNA-directed PCR clamping); as 'artificial restriction enzymes' when used in combination with other enzymes, (e.g., S1 nucleases (Hyrup B. et al. (1996) supra)); or as probes or primers for DNA sequencing or hybridization (Hyrup B. et al. (1996) supra; Perry-O'Keefe supra).

The synthesis of PNA oligomers can be performed using standard solid phase peptide synthesis protocols as described in Hyrup B. et al. (1996) supra and Perry-O'Keefe et al. *Proc. Natl. Acad. Sci.* 93: 14670-675. Representative U.S. patents that teach the preparation of PNA compounds include, but are not limited to, U.S. Pat. Nos. 5,539,082; 5,714,331; and 5,719,262, the entire contents of each of which are hereby incorporated herein by reference. Additional PNA compounds suitable for use in RNA molecules are described in, for example, in Nielsen et al., *Science*, 1991, 254, 1497-1500.

The nucleic acid fusion inhibitor molecules can also be modified to include one or more locked nucleic acids (LNA). A locked nucleic acid is a nucleotide having a modified sugar moiety in which the sugar moiety comprises an extra bridge connecting the 2' and 4' carbons. This structure effectively "locks" the ribose in the 3'-endo structural conformation. LNA containing nucleic acid molecules possess high affinity to complementary DNA and RNA and improved mismatch discrimination relative to unmodified nucleic acid molecules (Jepson, J., et al., (2004) *Oligonucleotides* 14:130-146). The addition of locked nucleic acids to siRNAs has been shown to increase siRNA stability in serum, and to reduce off-target effects (Elmen, J. et al., (2005) *Nucleic Acids Research* 33(1):439-447; Mook, O R. et al., (2007) *Mol Canc Ther* 6(3):833-843; Grunweller, A. et al., (2003) *Nucleic Acids Research* 31(12):3185-3193). Representative U.S. Patents that teach the preparation of locked nucleic acid nucleotides include, but are not limited to, the following: U.S. Pat. Nos. 6,268,490; 6,670,461; 6,794,499; 6,998,484; 7,053,207; 7,084,125; and 7,399,845, the entire contents of each of which are hereby incorporated herein by reference.

A nucleic acid fusion inhibitor molecule can also include nucleobase (often referred to in the art simply as "base") modifications or substitutions. As used herein, "unmodified" or "natural" nucleobases include the purine bases adenine (A) and guanine (G), and the pyrimidine bases thymine (T), cytosine (C) and uracil (U). Modified nucleobases include other synthetic and natural nucleobases such as 5-methylcytosine (5-me-C), 5-hydroxymethyl cytosine, xanthine, hypoxanthine, 2-aminoadenine, 6-methyl and other alkyl derivatives of adenine and guanine, 2-propyl and other alkyl derivatives of adenine and guanine, 2-thiouracil, 2-thiothymine and 2-thiocytosine, 5-halouracil and cytosine, 5-propynyl uracil and cytosine, 6-azo uracil, cytosine and thymine, 5-uracil (pseudouracil), 4-thiouracil, 8-halo, 8-amino, 8-thiol, 8-thioalkyl, 8-hydroxyl anal other 8-substituted adenines and guanines, 5-halo, particularly 5-bromo, 5-trifluoromethyl and other 5-substituted uracils and cytosines, 7-methylguanine and 7-methyladenine, 8-azaguanine and 8-azaadenine, 7-deazaguanine and 7-daazaadenine and 3-deazaguanine and 3-deazaadenine. Further nucleobases include those disclosed in U.S. Pat. No. 3,687,808, those disclosed in Modified Nucleosides in Biochemistry, Biotechnology and Medicine, Herdewijn, P. ed. Wiley-VCH, 2008; those disclosed in The Concise Encyclopedia Of Polymer Science And Engineering, pages 858-859, Kroschwitz, J. L, ed. John Wiley & Sons, 1990, these disclosed by Englisch et al., Angewandte Chemie, International Edition, 1991, 30, 613, and those disclosed by Sanghvi, Y S., Chapter 15, dsRNA Research and Applications, pages 289-302, Crooke, S. T. and Lebleu, B., Ed., CRC Press, 1993. Certain of these nucleobases are particularly useful for increasing the binding affinity of the oligomeric compounds featured in the invention. These include 5-substituted pyrimidines, 6-azapyrimidines and N-2, N-6 and 0-6 substituted purines, including 2-aminopropyladenine, 5-propynyluracil and 5-propynylcytosine. 5-methylcytosine substitutions have been shown to increase nucleic acid duplex stability by 0.6-1.2° C. (Sanghvi, Y. S., Crooke, S. T. and Lebleu, B., Eds., dsRNA Research and Applications, CRC Press, Boca Raton, 1993, pp. 276-278) and are exemplary base substitutions, even more particularly when combined with 2'-O-methoxyethyl sugar modifications.

Representative U.S. patents that teach the preparation of certain of the above noted modified nucleobases as well as other modified nucleobases include, but are not limited to, the above noted U.S. Pat. Nos. 3,687,808, 4,845,205; 5,130, 30; 5,134,066; 5,175,273; 5,367,066; 5,432,272; 5,457,187; 5,459,255; 5,484,908; 5,502,177; 5,525,711; 5,552,540; 5,587,469; 5,594,121, 5,596,091; 5,614,617; 5,681,941; 5,750,692; 6,015,886; 6,147,200; 6,166,197; 6,222,025; 6,235,887; 6,380,368; 6,528,640; 6,639,062; 6,617,438; 7,045,610; 7,427,672; and 7,495,088, the entire contents of each of which are hereby incorporated herein by reference.

Potentially stabilizing modifications to the ends of nucleic acid fusion inhibitor molecules can include N-(acetylaminocaproyl)-4-hydroxyprolinol (Hyp-C6-NHAc), N-(caproyl-4-hydroxyprolinol (Hyp-C6), N-(acetyl-4-hydroxyprolinol (Hyp-NHAc), thymidine-2'-O-deoxythymidine (ether), N-(aminocaproyl)-4-hydroxyprolinol (Hyp-C6-amino), 2-docosanoyl-uridine-3"-phosphate, inverted base dT (idT) and others. Disclosure of this modification can be found in PCT Publication No. WO 2011/005861.

In other embodiments, the nucleic acid fusion inhibitor molecule may include other appended groups such as peptides (e.g., for targeting host cell receptors in vivo), or agents facilitating transport across the cell membrane (see, e.g., Letsinger et al. (1989) *Proc. Natl. Acad. Sci. USA* 86:6553-6556; Lemaitre et al. (1987) *Proc. Natl. Acad. Sci. USA* 84:648-652; WO88/09810) or the blood-brain barrier (see, e.g., WO 89/10134). In addition, oligonucleotides can be modified with hybridization-triggered cleavage agents (see, e.g., Krol et al. (1988) *Bio-Techniques* 6:958-976) or intercalating agents (See, e.g., Zon (1988) *Pharm. Res.* 5:539-549). To this end, the oligonucleotide may be conjugated to another molecule, (e.g., a peptide, hybridization triggered cross-linking agent, transport agent, or hybridization-triggered cleavage agent).

In some embodiment, modifications to the fusion nucleic acid molecules can include, for example, end modifications, e.g., 5'-end modifications (phosphorylation, conjugation, inverted linkages) or 3'-end modifications (conjugation, DNA nucleotides, inverted linkages, etc.); base modifications, e.g., replacement with stabilizing bases, destabilizing bases, or bases that base pair with an expanded repertoire of partners, removal of bases (abasic nucleotides), or conjugated bases; sugar modifications (e.g., at the 2'-position or 4'-position) or replacement of the sugar; and/or backbone modifications, including modification or replacement of the phosphodiester linkages. Specific examples include, but are not limited to fusion nucleic acid molecules containing modified backbones or no natural internucleoside linkages. fusion nucleic acid molecules having modified backbones include, among others, those that do not have a phosphorus atom in the backbone.

Modified nucleic acid backbones include, for example, phosphorothioates, chiral phosphorothioates, phosphorodithioates, phosphotriesters, aminoalkylphosphotriesters, methyl and other alkyl phosphonates including 3'-alkylene phosphonates and chiral phosphonates, phosphinates, phosphoramidates including 3'-amino phosphoramidate and aminoalkylphosphoramidates, thionophosphoramidates, thionoalkylphosphonates, thionoalkylphosphotriesters, and boranophosphates having normal 3'-5' linkages, 2'-5'-linked analogs of these, and those having inverted polarity wherein the adjacent pairs of nucleoside units are linked 3'-5' to 5'-3' or 2'-5' to 5'-2'. Various salts, mixed salts and free acid forms are also included.

Representative U.S. patents that teach the preparation of the above phosphorus-containing linkages include, but are not limited to, U.S. Pat. Nos. 3,687,808; 4,469,863; 4,476, 301; 5,023,243; 5,177,195; 5,188,897; 5,264,423; 5,276, 019; 5,278,302; 5,286,717; 5,321,131; 5,399,676; 5,405, 939; 5,453,496; 5,455,233; 5,466,677; 5,476,925; 5,519, 126; 5,536,821; 5,541,316; 5,550,111; 5,563,253; 5,571, 799; 5,587,361; 5,625,050; 6,028,188; 6,124,445; 6,160, 109; 6,169,170; 6,172,209; 6,239,265; 6,277,603; 6,326, 199; 6,346,614; 6,444,423; 6,531,590; 6,534,639; 6,608,035; 6,683,167; 6,858,715; 6,867,294; 6,878,805; 7,015,315; 7,041,816; 7,273,933; 7,321,029; and U.S. Pat. RE39464, the entire contents of each of which are hereby incorporated herein by reference.

Modified nucleic acid backbones that do not include a phosphorus atom therein have backbones that are formed by short chain alkyl or cycloalkyl internucleoside linkages, mixed heteroatoms and alkyl or cycloalkyl internucleoside linkages, or one or more short chain heteroatomic or heterocyclic internucleoside linkages. These include those having morpholino linkages (formed in part from the sugar portion of a nucleoside); siloxane backbones; sulfide, sulfoxide and sulfone backbones; formacetyl and thioformacetyl backbones; methylene formacetyl and thioformacetyl backbones; alkene containing backbones; sulfamate backbones; methyleneimino and methylenehydrazino backbones; sulfonate and sulfonamide backbones; amide backbones; and others having mixed N, O, S and CH2 component parts.

Representative U.S. patents that teach the preparation of the above oligonucleosides include, but are not limited to, U.S. Pat. Nos. 5,034,506; 5,166,315; 5,185,444; 5,214,134; 5,216,141; 5,235,033; 5,64,562; 5,264,564; 5,405,938; 5,434,257; 5,466,677; 5,470,967; 5,489,677; 5,541,307; 5,561,225; 5,596,086; 5,602,240; 5,608,046; 5,610,289; 5,618,704; 5,623,070; 5,663,312; 5,633,360; 5,677,437; and, 5,677,439, the entire contents of each of which are hereby incorporated herein by reference.

Some embodiments include nucleic acid fusion inhibitor molecules with phosphorothioate backbones and oligonucleosides with heteroatom backbones, and in particular —CH$_2$—NH—CH$_2$—, —CH$_2$—N(CH$_3$)—O—CH$_2$— [known as a methylene (methylimino) or MMI backbone], —CH$_2$—O—N(CH$_3$)—CH$_2$—, —CH$_2$—N(CH$_3$)—N(CH$_3$)—CH$_2$— and —N(CH$_3$)—CH$_2$—CH$_2$— [wherein the native phosphodiester backbone is represented as —O—P—O—CH$_2$—] of the above-referenced U.S. Pat. No. 5,489,677, and the amide backbones of the above-referenced U.S. Pat. No. 5,602,240.

Modified nucleic acid fusion inhibitor molecules can also contain one or more substituted sugar moieties. The nucleic acid, e.g., RNA, molecules can include one of the following at the 2'-position: OH; F; O-, S-, or N-alkyl; O-, S-, or N-alkenyl; O-, S- or N-alkynyl; or O-alkyl-O-alkyl, wherein the alkyl, alkenyl and alkynyl can be substituted or unsubstituted $C_1$ to $C_{10}$ alkyl or $C_2$ to $C_{10}$ alkenyl and alkynyl. Exemplary suitable modifications include O[(CH2)$_n$O]$_m$CH$_3$, O(CH$_2$).$_n$OCH$_3$, O(CH$_2$)$_n$NH$_2$, O(CH$_2$)$_n$CH$_3$, O(CH$_2$)$_n$ONH$_2$, and O(CH$_2$)$_n$ON[(CH$_2$)$_n$CH$_3$)]2, where n and m are from 1 to about 10. In other embodiments, dsRNAs include one of the following at the 2' position: $C_1$ to $C_{10}$ lower alkyl, substituted lower alkyl, alkaryl, aralkyl, O-alkaryl or O-aralkyl, SH, SCH$_3$, OCN, Cl, Br, CN, CF$_3$, OCF$_3$, SOCH$_3$, SO$_2$CH$_3$, ONO$_2$, NO$_2$, N$_3$, NH$_2$, heterocycloalkyl, heterocycloalkaryl, aminoalkylamino, polyalkylamino, substituted silyl, an RNA cleaving group, a reporter group, an intercalator, a group for improving the pharmacokinetic properties of an RNA molecule, or a group for improving the pharmacodynamic properties of an RNA molecule, and other substituents having similar properties. In some embodiments, the modification includes a 2'-methoxyethoxy (2'-O—CH$_2$CH$_2$OCH$_3$, also known as 2'-O-(2-methoxyethyl) or 2'-MOE) (Martin et al., *Helv. Chim. Acta*, 1995, 78:486-504) i.e., an alkoxy-alkoxy group. Another exemplary modification is 2'-dimethylaminooxyethoxy, i.e., a O(CH$_2$)$_2$ON(CH$_3$)$_2$ group, also known as 2'-DMAOE, as described in examples herein below, and 2'-dimethylaminoethoxyethoxy (also known in the art as 2'-O-dimethylaminoethoxyethyl or 2'-DMAEOE), i.e., 2'-O—CH$_2$—O—CH$_2$—N(CH$_2$)$_2$.

Other modifications can include 2'-methoxy (2'-OCH$_3$), 2'-aminopropoxy (2'-OCH$_2$CH$_2$CH$_2$NH$_2$) and 2'-fluoro (2'-F). Similar modifications can also be made at other positions on the RNA of an RNA molecule, particularly the 3' position of the sugar on the 3' terminal nucleotide or in 2'-5' linked dsRNAs and the 5' position of 5' terminal nucleotide. RNA molecules can also have sugar mimetics such as cyclobutyl moieties in place of the pentofuranosyl sugar. Representative U.S. patents that teach the preparation of such modified sugar structures include, but are not limited to, U.S. Pat. Nos. 4,981,957; 5,118,800; 5,319,080; 5,359,044; 5,393,878; 5,446,137; 5,466,786; 5,514,785; 5,519,134; 5,567,811; 5,576,427; 5,591,722; 5,597,909; 5,610,300; 5,627,053; 5,639,873; 5,646,265; 5,658,873; 5,670,633; and 5,700,920, certain of which are commonly owned with the instant application. The entire contents of each of the foregoing are hereby incorporated herein by reference.

Evaluation of Subjects

Subjects, e.g., patients, can be evaluated for the presence of a fusion molecule described herein. A patient can be evaluated, for example, by determining the genomic sequence of the patient, e.g., by an NGS method. Alternatively, or in addition, evaluation of a patient can include directly assaying for the presence of a fusion described herein, in the patient, such as by an assay to detect a fusion nucleic acid (e.g., DNA or RNA), such as by, Southern blot, Northern blot, or RT-PCR, e.g., qRT-PCR. Alternatively, or in addition, a patient can be evaluated for the presence of a protein fusion, such as by immunohistochemistry, Western blot, immunoprecipitation, or immunomagnetic bead assay.

Evaluation of a patient can also include a cytogenetic assay, such as by fluorescence in situ hybridization (FISH), to identify the chromosomal rearrangement resulting in the fusion. For example, to perform FISH, at least a first probe tagged with a first detectable label can be designed to target TACC3, such as in one or more exons of TACC3 and at least a second probe tagged with a second detectable label can be designed to target FGFR3, such as in one or more exons of FGFR3 (e.g., the exons containing the part of the protein that includes the tyrosine kinase domain). The at least one first probe and the at least one second probe will be closer together in patients who carry the FGFR3-TACC3 fusion than in patients who do not carry the FGFR3-TACC3 fusion. These methods can be utilized in a similar manner for any fusion described herein.

Additional methods for fusion detection are provided below.

In one aspect, the results of a clinical trial, e.g., a successful or unsuccessful clinical trial, can be repurposed to identify agents that target a fusion described herein. By one exemplary method, a candidate agent used in a clinical trial can be reevaluated to determine if the agent in the trial targets a fusion, or is effective to treat a tumor containing a particular fusion. For example, subjects who participated in a clinical trial for an agent, such as a kinase inhibitor, can be identified. Patients who experienced an improvement in symptoms, e.g., cancer (e.g., lung cancer) symptoms, such as decreased tumor size, or decreased rate of tumor growth, can be evaluated for the presence of a fusion described herein. Patients who did not experience an improvement in cancer symptoms can also be evaluated for the presence of a fusion described herein. Where patients carrying a fusion described herein are found to have been more likely to respond to the test agent than patients who did not carry such a fusion, then the agent is determined to be an appropriate treatment option for a patient carrying the fusion.

"Reevaluation" of patients can include, for example, determining the genomic sequence of the patients, or a subset of the clinical trial patients, e.g., by an NGS method. Alternatively, or in addition, reevaluation of the patients can include directly assaying for the presence of a fusion described herein, in the patient, such as by an assay to detect a fusion nucleic acid (e.g., RNA), such as by RT-PCR, e.g., qRT-PCR. Alternatively, or in addition, a patient can be evaluated for the presence of a protein fusion, such as by immunohistochemistry, Western blot, immunoprecipitation, or immunomagnetic bead assay.

Clinical trials suitable for repurposing as described above include trials that tested tyrosine kinase inhibitors, and multikinase inhibitors.

Methods for Detection of Fusion Nucleic Acids and Polypeptides

Methods for evaluating a fusion gene, mutations and/or gene products are known to those of skill in the art. In one embodiment, the fusion is detected in a nucleic acid molecule by a method chosen from one or more of: nucleic acid hybridization assay, amplification-based assays (e.g., polymerase chain reaction (PCR)), PCR-RFLP assay, real-time PCR, sequencing, screening analysis (including metaphase cytogenetic analysis by standard karyotype methods, FISH (e.g., break away FISH), spectral karyotyping or MFISH, comparative genomic hybridization), in situ hybridization, SSP, HPLC or mass-spectrometric genotyping.

Additional exemplary methods include, traditional "direct probe" methods such as Southern blots or in situ hybridization (e.g., fluorescence in situ hybridization (FISH) and FISH plus SKY), and "comparative probe" methods such as comparative genomic hybridization (CGH), e.g., cDNA-based or oligonucleotide-based CGH, can be used. The methods can be used in a wide variety of formats including, but not limited to, substrate (e.g., membrane or glass) bound methods or array-based approaches.

In certain embodiments, the evaluation methods include the probes/primers described herein. In one embodiment, probes/primers can be designed to detect a fusion molecule described herein or a reciprocal thereof. Probes/primers are suitable, e.g., for FISH or PCR amplification. For PCR, e.g., to amply a region including a fusion junction described herein, forward primers can be designed to hybridize to a gene sequence from nucleotides corresponding to one of the genes of a fusion described herein, and reverse primers can be designed to hybridize to a sequence from nucleotides corresponding to the second gene involved in the fusion.

For example, probes/primers can be designed to detect a FGFR3-TACC3 fusion or a reciprocal thereof. The FGFR3 probes/primers can hybridize to the nucleotides encoding one or more exons of the FGFR3 protein. The TACC3 probes/primers can hybridize to the nucleotides encoding one or more exons of the TACC3 protein). These probes/primers are suitable, e.g., for FISH or PCR amplification.

The probes/primers described above use FGFR3-TACC3 as an example, and such methods can be readily applied to any of the fusions described herein by one of skill in the art.

In one embodiment, FISH analysis is used to identify the chromosomal rearrangement resulting in the fusions as described above. For example, to perform FISH, at least a first probe tagged with a first detectable label can be designed to target a first gene of a fusion described herein, such as in one or more exons of the gene and at least a second probe tagged with a second detectable label can be designed to target a second gene of the fusion, such as in one or more exons of genes (e.g., the exons containing the part of the protein that includes the tyrosine kinase domain). The at least one first probe and the at least one second probe will be closer together in a subject who carries the fusion compared to a subject who does not carry the fusion.

In one approach, a variation of a FISH assay, e.g., "break-away FISH", is used to evaluate a patient. By this method, at least one probe targeting the fusion junction and at least one probe targeting an individual gene of the fusion, e.g., at one or more exons and or introns of the gene, are utilized. In normal cells, both probes will be observed (or a secondary color will be observed due to the close proximity of the two genes of the gene fusion), and only the single gene probe will be observed when the translocation occurs. Other variations of the FISH method known in the art are suitable for evaluating a patient.

For example, by this method, at least one probe targeting the FGFR3 intron 17/TACC3 intron 7 junction and at least one probe targeting TACC3(or FGFR3), e.g., at one or more exons and or introns of TACC3 or FGFR3, are utilized. In normal cells, both probes will be observed (or a secondary color will be observed due to the close proximity of the TACC3 and FGFR3 genes), and only the TACC3 probe will be observed when the translocation occurs. Other variations of the FISH method known in the art are suitable for evaluating a patient.

The FISH methods described herein above use FGFR3-TACC3 as an example, and such methods can be readily applied to any of the fusions described herein by one of skill in the art.

Probes are used that contain DNA segments that are essentially complementary to DNA base sequences existing in different portions of chromosomes. Examples of probes useful according to the invention, and labeling and hybridization of probes to samples are described in two U.S. patents to Vysis, Inc. U.S. Pat. Nos. 5,491,224 and 6,277,569 to Bittner, et al.

Additional protocols for FISH detection are described below.

Chromosomal probes are typically about 50 to about $10^5$ nucleotides in length. Longer probes typically comprise smaller fragments of about 100 to about 500 nucleotides in length. Probes that hybridize with centromeric DNA and locus-specific DNA are available commercially, for example, from Vysis, Inc. (Downers Grove, Ill.), Molecular Probes, Inc. (Eugene, Oreg.) or from Cytocell (Oxfordshire, UK). Alternatively, probes can be made non-commercially from chromosomal or genomic DNA through standard techniques. For example, sources of DNA that can be used include genomic DNA, cloned DNA sequences, somatic cell hybrids that contain one, or a part of one, chromosome (e.g., human chromosome) along with the normal chromosome complement of the host, and chromosomes purified by flow cytometry or microdissection. The region of interest can be isolated through cloning, or by site-specific amplification via the polymerase chain reaction (PCR). See, for example, Nath and Johnson, Biotechnic Histochem., 1998, 73(1):6-22, Wheeless et al., Cytometry 1994, 17:319-326, and U.S. Pat. No. 5,491,224.

The probes to be used hybridize to a specific region of a chromosome to determine whether a cytogenetic abnormality is present in this region. One type of cytogenetic abnormality is a deletion. Although deletions can be of one or more entire chromosomes, deletions normally involve loss of part of one or more chromosomes. If the entire region of a chromosome that is contained in a probe is deleted from a cell, hybridization of that probe to the DNA from the cell will normally not occur and no signal will be present on that chromosome. If the region of a chromosome that is partially contained within a probe is deleted from a cell, hybridization of that probe to the DNA from the cell can still occur, but less of a signal can be present. For example, the loss of a signal is compared to probe hybridization to DNA from control cells that do not contain the genetic abnormalities which the probes are intended to detect. In some embodiments, at least 1, 5, 10, 20, 30, 40, 50, 60, 70, 80, 90, 100, 110, 120, 130, 140, 150, 160, 170, 180, 190, 200, or more cells are enumerated for presence of the cytogenetic abnormality.

Cytogenetic abnormalities to be detected can include, but are not limited to, non-reciprocal translocations, balanced translocations, intra-chromosomal inversions, point mutations, deletions, gene copy number changes, gene expression level changes, and germ line mutations. In particular, one type of cytogenetic abnormality is a duplication. Duplications can be of entire chromosomes, or of regions smaller than an entire chromosome. If the region of a chromosome that is contained in a probe is duplicated in a cell, hybridization of that probe to the DNA from the cell will normally produce at least one additional signal as compared to the number of signals present in control cells with no abnormality of the chromosomal region contained in the probe.

Chromosomal probes are labeled so that the chromosomal region to which they hybridize can be detected. Probes typically are directly labeled with a fluorophore, an organic molecule that fluoresces after absorbing light of lower wavelength/higher energy. The fluorophore allows the probe to be visualized without a secondary detection molecule. After covalently attaching a fluorophore to a nucleotide, the nucleotide can be directly incorporated into the probe with standard techniques such as nick translation, random priming, and PCR labeling. Alternatively, deoxycytidine nucleotides within the probe can be transaminated with a linker. The fluorophore then is covalently attached to the transaminated deoxycytidine nucleotides. See, U.S. Pat. No. 5,491,224.

U.S. Pat. No. 5,491,224 describes probe labeling as a number of the cytosine residues having a fluorescent label covalently bonded thereto. The number of fluorescently labeled cytosine bases is sufficient to generate a detectable fluorescent signal while the individual so labeled DNA segments essentially retain their specific complementary binding (hybridizing) properties with respect to the chromosome or chromosome region to be detected. Such probes are made by taking the unlabeled DNA probe segment, transaminating with a linking group a number of deoxycytidine nucleotides in the segment, covalently bonding a fluorescent label to at least a portion of the transaminated deoxycytidine bases.

Probes can also be labeled by nick translation, random primer labeling or PCR labeling. Labeling is done using either fluorescent (direct)-or haptene (indirect)-labeled nucleotides. Representative, non-limiting examples of labels include: AMCA-6-dUTP, CascadeBlue-4-dUTP, Fluorescein-12-dUTP, Rhodamine-6-dUTP, TexasRed-6-dUTP, Cy3-6-dUTP, Cy5-dUTP, Biotin(BIO)-11-dUTP, Digoxygenin(DIG)-11-dUTP or Dinitrophenyl (DNP)-11-dUTP.

Probes also can be indirectly labeled with biotin or digoxygenin, or labeled with radioactive isotopes such as $^{32}P$ and $^{3}H$, although secondary detection molecules or further processing then is required to visualize the probes. For example, a probe labeled with biotin can be detected by avidin conjugated to a detectable marker. For example, avidin can be conjugated to an enzymatic marker such as alkaline phosphatase or horseradish peroxidase. Enzymatic markers can be detected in standard colorimetric reactions using a substrate and/or a catalyst for the enzyme. Catalysts for alkaline phosphatase include 5-bromo-4-chloro-3-indolylphosphate and nitro blue tetrazolium. Diaminobenzoate can be used as a catalyst for horseradish peroxidase.

Probes can also be prepared such that a fluorescent or other label is not part of the DNA before or during the hybridization, and is added after hybridization to detect the probe hybridized to a chromosome. For example, probes can be used that have antigenic molecules incorporated into the DNA. After hybridization, these antigenic molecules are detected using specific antibodies reactive with the antigenic molecules. Such antibodies can themselves incorporate a fluorochrome, or can be detected using a second antibody with a bound fluorochrome.

However treated or modified, the probe DNA is commonly purified in order to remove unreacted, residual products (e.g., fluorochrome molecules not incorporated into the DNA) before use in hybridization.

Prior to hybridization, chromosomal probes are denatured according to methods well known in the art. Probes can be hybridized or annealed to the chromosomal DNA under hybridizing conditions. "Hybridizing conditions" are conditions that facilitate annealing between a probe and target chromosomal DNA. Since annealing of different probes will vary depending on probe length, base concentration and the like, annealing is facilitated by varying probe concentration, hybridization temperature, salt concentration and other factors well known in the art.

Hybridization conditions are facilitated by varying the concentrations, base compositions, complexities, and lengths of the probes, as well as salt concentrations, temperatures, and length of incubation. For example, in situ hybridizations are typically performed in hybridization buffer containing 1-2×SSC, 50-65% formamide and blocking DNA to suppress non-specific hybridization. In general, hybridization conditions, as described above, include temperatures of about 25° C. to about 55° C., and incubation lengths of about 0.5 hours to about 96 hours.

Non-specific binding of chromosomal probes to DNA outside of the target region can be removed by a series of washes. Temperature and concentration of salt in each wash are varied to control stringency of the washes. For example, for high stringency conditions, washes can be carried out at about 65° C. to about 80° C., using 0.2× to about 2×SSC, and about 0.1% to about 1% of a non-ionic detergent such as Nonidet P-40 (NP40). Stringency can be lowered by decreasing the temperature of the washes or by increasing the concentration of salt in the washes. In some applications it is necessary to block the hybridization capacity of repetitive sequences. Thus, in some embodiments, tRNA, human genomic DNA, or Cot-I DNA is used to block non-specific hybridization. After washing, the slide is allowed to drain and air dry, then mounting medium, a counterstain such as DAPI, and a coverslip are applied to the slide. Slides can be viewed immediately or stored at −20° C. before examination.

For fluorescent probes used in fluorescence in situ hybridization (FISH) techniques, fluorescence can be viewed with a fluorescence microscope equipped with an appropriate filter for each fluorophore, or by using dual or triple band-pass filter sets to observe multiple fluorophores. See, for example, U.S. Pat. No. 5,776,688. Alternatively, techniques such as flow cytometry can be used to examine the hybridization pattern of the chromosomal probes.

In CGH methods, a first collection of nucleic acids (e.g., from a sample, e.g., a possible tumor) is labeled with a first label, while a second collection of nucleic acids (e.g., a control, e.g., from a healthy cell/tissue) is labeled with a second label. The ratio of hybridization of the nucleic acids is determined by the ratio of the two (first and second) labels binding to each fiber in the array. Where there are chromosomal deletions or multiplications, differences in the ratio of the signals from the two labels will be detected and the ratio will provide a measure of the copy number. Array-based CGH can also be performed with single-color labeling (as opposed to labeling the control and the possible tumor sample with two different dyes and mixing them prior to hybridization, which will yield a ratio due to competitive hybridization of probes on the arrays). In single color CGH, the control is labeled and hybridized to one array and absolute signals are read, and the possible tumor sample is labeled and hybridized to a second array (with identical content) and absolute signals are read. Copy number difference is calculated based on absolute signals from the two arrays. Hybridization protocols suitable for use with the methods featured in the invention are described, e.g., in Albertson (1984) *EMBO J.* 3: 1227-1234; Pinkel (1988) *Proc. Natl. Acad. Sci. USA* 85: 9138-9142; EPO Pub. No. 430,402; *Methods in Molecular Biology*, Vol. 33: In situ Hybridization Protocols, Choo, ed., Humana Press, Totowa, N.J. (1994), etc. In one embodiment, the hybridization protocol of Pinkel, et al. (1998) *Nature Genetics* 20: 207-211, or of Kallioniemi (1992) *Proc. Natl Acad Sci USA* 89:5321-5325 (1992) is used. Array-based CGH is described in U.S. Pat. No. 6,455,258, the contents of each of which are incorporated herein by reference.

In still another embodiment, amplification-based assays can be used to measure presence/absence and copy number. In such amplification-based assays, the nucleic acid sequences act as a template in an amplification reaction (e.g., Polymerase Chain Reaction (PCR). In a quantitative amplification, the amount of amplification product will be proportional to the amount of template in the original sample. Comparison to appropriate controls, e.g., healthy tissue, provides a measure of the copy number.

Methods of "quantitative" amplification are well known to those of skill in the art. For example, quantitative PCR involves simultaneously co-amplifying a known quantity of a control sequence using the same primers. This provides an internal standard that can be used to calibrate the PCR reaction. Detailed protocols for quantitative PCR are provided in Innis, et al. (1990) PCR Protocols, *A Guide to Methods and Applications*, Academic Press, Inc. N.Y.).

Measurement of DNA copy number at microsatellite loci using quantitative PCR analysis is described in Ginzonger, et al. (2000) *Cancer Research* 60:5405-5409. The known nucleic acid sequence for the genes is sufficient to enable one of skill in the art to routinely select primers to amplify any portion of the gene. Fluorogenic quantitative PCR can also be used. In fluorogenic quantitative PCR, quantitation is based on amount of fluorescence signals, e.g., TaqMan and sybr green.

Other suitable amplification methods include, but are not limited to, ligase chain reaction (LCR) (see Wu and Wallace (1989) *Genomics* 4: 560, Landegren, et al. (1988) *Science* 241:1077, and Barringer et al. (1990) *Gene* 89: 117), transcription amplification (Kwoh, et al. (1989) *Proc. Natl. Acad. Sci. USA* 86: 1173), self-sustained sequence replication (Guatelli, et al. (1990) *Proc. Nat. Acad. Sci. USA* 87: 1874), dot PCR, and linker adapter PCR, etc.

Nucleic Acid Samples

A variety of tissue samples can be the source of the nucleic acid samples used in the present methods. Genomic or subgenomic DNA fragments can be isolated from a subject's sample (e.g., a tumor sample, a normal adjacent tissue (NAT), a blood sample or any normal control)). In certain embodiments, the tissue sample is preserved as a frozen sample or as formaldehyde- or paraformaldehyde-fixed paraffin-embedded (FFPE) tissue preparation. For example, the sample can be embedded in a matrix, e.g., an FFPE block or a frozen sample. The isolating step can include flow-sorting of individual chromosomes; and/or micro-dissecting a subject's sample (e.g., a tumor sample, a NAT, a blood sample).

Protocols for DNA isolation from a tissue sample are known in the art. Additional methods to isolate nucleic acids (e.g., DNA) from formaldehyde- or paraformaldehyde-fixed, paraffin-embedded (FFPE) tissues are disclosed, e.g., in Cronin M. et al., (2004) *Am J Pathol.* 164(1):35-42; Masuda N. et al., (1999) *Nucleic Acids Res.* 27(22):4436-4443; Specht K. et al., (2001) *Am J Pathol.* 158(2):419-429, Ambion RecoverAll™ Total Nucleic Acid Isolation Protocol (Ambion, Cat. No. AM1975, September 2008), and QIAamp® DNA FFPE Tissue Handbook (Qiagen, Cat. No. 37625, October 2007). RecoverAll™ Total Nucleic Acid Isolation Kit uses xylene at elevated temperatures to solubilize paraffin-embedded samples and a glass-fiber filter to capture nucleic acids. QIAamp® DNA FFPE Tissue Kit uses QIAamp® DNA Micro technology for purification of genomic and mitochondrial DNA.

The isolated nucleic acid samples (e.g., genomic DNA samples) can be fragmented or sheared by practicing routine techniques. For example, genomic DNA can be fragmented by physical shearing methods, enzymatic cleavage methods, chemical cleavage methods, and other methods well known to those skilled in the art. The nucleic acid library can contain all or substantially all of the complexity of the genome. The term "substantially all" in this context refers to the possibility that there can in practice be some unwanted loss of genome complexity during the initial steps of the procedure. The methods described herein also are useful in cases where the nucleic acid library is a portion of the genome, i.e., where the complexity of the genome is reduced by design. In some embodiments, any selected portion of the genome can be used with the methods described herein. In certain embodiments, the entire exome or a subset thereof is isolated.

Methods can further include isolating a nucleic acid sample to provide a library (e.g., a nucleic acid library). In certain embodiments, the nucleic acid sample includes whole genomic, subgenomic fragments, or both. The isolated nucleic acid samples can be used to prepare nucleic acid libraries. Thus, in one embodiment, the methods featured in the invention further include isolating a nucleic acid sample to provide a library (e.g., a nucleic acid library as described herein). Protocols for isolating and preparing libraries from whole genomic or subgenomic fragments are known in the art (e.g., Illumina's genomic DNA sample preparation kit). In certain embodiments, the genomic or subgenomic DNA fragment is isolated from a subject's sample (e.g., a tumor sample, a normal adjacent tissue (NAT), a blood sample or any normal control)). In one embodiment, the sample (e.g., the tumor or NAT sample) is a preserved. For example, the sample is embedded in a matrix, e.g., an FFPE block or a frozen sample. In certain embodiments, the isolating step includes flow-sorting of individual chromosomes; and/or microdissecting a subject's sample (e.g., a tumor sample, a NAT, a blood sample). In certain embodiments, the nucleic acid sample used to generate the nucleic acid library is less than 5, less than 1 microgram, less than 500 ng, less than 200 ng, less than 100 ng, less than 50 ng or less than 20 ng (e.g., 10 ng or less).

In still other embodiments, the nucleic acid sample used to generate the library includes RNA or cDNA derived from RNA. In some embodiments, the RNA includes total cellular RNA. In other embodiments, certain abundant RNA sequences (e.g., ribosomal RNAs) have been depleted. In some embodiments, the poly(A)-tailed mRNA fraction in the total RNA preparation has been enriched. In some embodiments, the cDNA is produced by random-primed cDNA synthesis methods. In other embodiments, the cDNA synthesis is initiated at the poly(A) tail of mature mRNAs by priming by oligo(dT)-containing oligonucleotides. Methods for depletion, poly(A) enrichment, and cDNA synthesis are well known to those skilled in the art.

The method can further include amplifying the nucleic acid sample (e.g., DNA or RNA sample) by specific or non-specific nucleic acid amplification methods that are well known to those skilled in the art. In some embodiments, certain embodiments, the nucleic acid sample is amplified, e.g., by whole-genome amplification methods such as random-primed strand-displacement amplification.

In other embodiments, the nucleic acid sample is fragmented or sheared by physical or enzymatic methods and ligated to synthetic adapters, size-selected (e.g., by preparative gel electrophoresis) and amplified (e.g., by PCR). In other embodiments, the fragmented and adapter-ligated group of nucleic acids is used without explicit size selection or amplification prior to hybrid selection.

In other embodiments, the isolated DNA (e.g., the genomic DNA) is fragmented or sheared. In some embodiments, the library includes less than 50% of genomic DNA, such as a subfraction of genomic DNA that is a reduced representation or a defined portion of a genome, e.g., that has been subfractionated by other means. In other embodiments, the library includes all or substantially all genomic DNA.

In some embodiments, the library includes less than 50% of genomic DNA, such as a subfraction of genomic DNA that is a reduced representation or a defined portion of a genome, e.g., that has been subfractionated by other means. In other embodiments, the library includes all or substantially all genomic DNA. Protocols for isolating and preparing libraries from whole genomic or subgenomic fragments are known in the art (e.g., 1llumina's genomic DNA sample preparation kit). Alternative DNA shearing methods can be more automatable and/or more efficient (e.g., with degraded FFPE samples). Alternatives to DNA shearing methods can also be used to avoid a ligation step during library preparation.

The methods described herein can be performed using a small amount of nucleic acids, e.g., when the amount of source DNA is limiting (e.g., even after whole-genome amplification). In one embodiment, the nucleic acid comprises less than about 5 µg, 4 µg, 3 µg, 2 µg, 1 µg, 0.8 µg, 0.7 µg, 0.6 µg, 0.5 µg, or 400 ng, 300 ng, 200 ng, 100 ng, 50 ng, or 20 ng or less of nucleic acid sample. For example, to prepare 500 ng of hybridization-ready nucleic acids, one typically begins with 3 µg of genomic DNA. One can start with less, however, if one amplifies the genomic DNA (e.g., using PCR) before the step of solution hybridization. Thus it is possible, but not essential, to amplify the genomic DNA before solution hybridization.

In some embodiments, a library is generated using DNA (e.g., genomic DNA) from a sample tissue, and a corresponding library is generated with RNA (or cDNA) isolated from the same sample tissue.

Design of Baits

A bait can be a nucleic acid molecule, e.g., a DNA or RNA molecule, which can hybridize to (e.g., be complementary to), and thereby allow capture of a target nucleic acid. In one embodiment, a bait is an RNA molecule. In other embodiments, a bait includes a binding entity, e.g., an affinity tag, that allows capture and separation, e.g., by binding to a binding entity, of a hybrid formed by a bait and a nucleic acid hybridized to the bait. In one embodiment, a bait is suitable for solution phase hybridization.

Baits can be produced and used by methods and hybridization conditions as described in US 2010/0029498 and Gnirke, A. et al. (2009) *Nat Biotechnol.* 27(2):182-189, and U.S. Ser. No. 61/428,568, filed Dec. 30, 2010, incorporated herein by reference. For example, biotinylated RNA baits can be produced by obtaining a pool of synthetic long oligonucleotides, originally synthesized on a microarray, and amplifying the oligonucleotides to produce the bait sequences. In some embodiments, the baits are produced by adding an RNA polymerase promoter sequence at one end of the bait sequences, and synthesizing RNA sequences using RNA polymerase. In one embodiment, libraries of synthetic oligodeoxynucleotides can be obtained from commercial suppliers, such as Agilent Technologies, Inc., and amplified using known nucleic acid amplification methods.

Each bait sequence can include a target-specific (e.g., a member-specific) bait sequence and universal tails on each end. As used herein, the term "bait sequence" can refer to the target-specific bait sequence or the entire oligonucleotide including the target-specific "bait sequence" and other nucleotides of the oligonucleotide. In one embodiment, a target-specific bait hybridizes to a nucleic acid sequence comprising a nucleic acid sequence in an intron of one gene of a fusion described herein, in an intron of the other gene of a fusion described herein, or a fusion junction joining the introns. In one embodiment, the bait is an oligonucleotide about 200 nucleotides in length, of which 170 nucleotides are target-specific "bait sequence". The other 30 nucleotides (e.g., 15 nucleotides on each end) are universal arbitrary tails used for PCR amplification. The tails can be any sequence selected by the user.

The bait sequences described herein can be used for selection of exons and short target sequences. In one embodiment, the bait is between about 100 nucleotides and 300 nucleotides in length. In another embodiment, the bait is between about 130 nucleotides and 230 nucleotides in length. In yet another embodiment, the bait is between about 150 nucleotides and 200 nucleotides in length. The target-specific sequences in the baits, e.g., for selection of exons and short target sequences, are between about 40 nucleotides and 1000 nucleotides in length. In one embodiment, the target-specific sequence is between about 70 nucleotides and 300 nucleotides in length. In another embodiment, the target-specific sequence is between about 100 nucleotides and 200 nucleotides in length. In yet another embodiment, the target-specific sequence is between about 120 nucleotides and 170 nucleotides in length.

Sequencing

The invention also includes methods of sequencing nucleic acids. In one embodiment, any of a variety of sequencing reactions known in the art can be used to directly sequence at least a portion of a fusion molecule described herein. In one embodiment, the fusion sequence is compared to a corresponding reference (control) sequence.

In one embodiment, the sequence of the fusion nucleic acid molecule is determined by a method that includes one or more of: hybridizing an oligonucleotide, e.g., an allele specific oligonucleotide for one alteration described herein to said nucleic acid; hybridizing a primer, or a primer set (e.g., a primer pair), that amplifies a region comprising the mutation or a fusion junction of the allele; amplifying, e.g., specifically amplifying, a region comprising the mutation or a fusion junction of the allele; attaching an adapter oligonucleotide to one end of a nucleic acid that comprises the mutation or a fusion junction of the allele; generating an optical, e.g., a colorimetric signal, specific to the presence of the one of the mutation or fusion junction; hybridizing a nucleic acid comprising the mutation or fusion junction to a second nucleic acid, e.g., a second nucleic acid attached to a substrate; generating a signal, e.g., an electrical or fluorescent signal, specific to the presence of the mutation or fusion junction; and incorporating a nucleotide into an oligonucleotide that is hybridized to a nucleic acid that contains the mutation or fusion junction.

In another embodiment, the sequence is determined by a method that comprises one or more of: determining the nucleotide sequence from an individual nucleic acid molecule, e.g., where a signal corresponding to the sequence is derived from a single molecule as opposed, e.g., from a sum of signals from a plurality of clonally expanded molecules; determining the nucleotide sequence of clonally expanded proxies for individual nucleic acid molecules; massively parallel short-read sequencing; template-based sequencing; pyrosequencing; real-time sequencing comprising imaging the continuous incorporation of dye-labeling nucleotides during DNA synthesis; nanopore sequencing; sequencing by hybridization; nano-transistor array based sequencing; polony sequencing; scanning tunneling microscopy (STM) based sequencing; or nanowire-molecule sensor based sequencing.

Any method of sequencing known in the art can be used. Exemplary sequencing reactions include those based on techniques developed by Maxam and Gilbert (*Proc. Natl Acad Sci USA* (1977) 74:560) or Sanger (Sanger et al. (1977) *Proc. Nat. Acad. Sci* 74:5463). Any of a variety of automated sequencing procedures can be utilized when performing the assays (*Biotechniques* (1995) 19:448), including sequencing by mass spectrometry (see, for example, U.S. Pat. No. 5,547,835 and international patent application Publication Number WO 94/16101, entitled DNA Sequencing by Mass Spectrometry by H. Koster; U.S. Pat. No. 5,547,835 and international patent application Publication Number WO 94/21822 entitled DNA Sequencing by Mass Spectrometry Via Exonuclease Degradation by H. Koster), and U.S. Pat. No. 5,605,798 and International Patent Application No. PCT/US96/03651 entitled DNA Diagnostics Based on Mass Spectrometry by H. Koster; Cohen et al. (1996) *Adv Chromatogr* 36:127-162; and Griffin et al. (1993) *Appl Biochem Biotechnol* 38:147-159).

Sequencing of nucleic acid molecules can also be carried out using next-generation sequencing (NGS). Next-generation sequencing includes any sequencing method that determines the nucleotide sequence of either individual nucleic acid molecules or clonally expanded proxies for individual nucleic acid molecules in a highly parallel fashion (e.g., greater than $10^5$ molecules are sequenced simultaneously). In one embodiment, the relative abundance of the nucleic acid species in the library can be estimated by counting the relative number of occurrences of their cognate sequences in the data generated by the sequencing experiment. Next generation sequencing methods are known in the art, and are described, e.g., in Metzker, M. (2010) *Nature Biotechnology Reviews* 11:31-46, incorporated herein by reference.

In one embodiment, the next-generation sequencing allows for the determination of the nucleotide sequence of an individual nucleic acid molecule (e.g., Helicos BioSciences' HeliScope Gene Sequencing system, and Pacific Biosciences' PacBio RS system). In other embodiments, the sequencing method determines the nucleotide sequence of clonally expanded proxies for individual nucleic acid molecules (e.g., the Solexa sequencer, Illumina Inc., San Diego, Calif.; 454 Life Sciences (Branford, Conn.), and Ion Torrent). e.g., massively parallel short-read sequencing (e.g., the Solexa sequencer, Illumina Inc., San Diego, Calif.), which generates more bases of sequence per sequencing unit than other sequencing methods that generate fewer but longer reads. Other methods or machines for next-generation sequencing include, but are not limited to, the sequencers provided by 454 Life Sciences (Branford, Conn.), Applied Biosystems (Foster City, Calif.; SOLiD sequencer), and Helicos BioSciences Corporation (Cambridge, Mass.).

Platforms for next-generation sequencing include, but are not limited to, Roche/454's Genome Sequencer (GS) FLX System, Illumina/Solexa's Genome Analyzer (GA), Life/APG's Support Oligonucleotide Ligation Detection (SOLiD) system, Polonator's G.007 system, Helicos BioSciences' HeliScope Gene Sequencing system, and Pacific Biosciences' PacBio RS system.

NGS technologies can include one or more of steps, e.g., template preparation, sequencing and imaging, and data analysis.

Template Preparation

Methods for template preparation can include steps such as randomly breaking nucleic acids (e.g., genomic DNA or cDNA) into smaller sizes and generating sequencing templates (e.g., fragment templates or mate-pair templates). The spatially separated templates can be attached or immobilized to a solid surface or support, allowing massive amounts of sequencing reactions to be performed simultaneously. Types of templates that can be used for NGS reactions include, e.g., clonally amplified templates originating from single DNA molecules, and single DNA molecule templates.

Methods for preparing clonally amplified templates include, e.g., emulsion PCR (emPCR) and solid-phase amplification.

EmPCR can be used to prepare templates for NGS. Typically, a library of nucleic acid fragments is generated, and adapters containing universal priming sites are ligated to the ends of the fragment. The fragments are then denatured into single strands and captured by beads. Each bead captures a single nucleic acid molecule. After amplification and enrichment of emPCR beads, a large amount of templates can be attached or immobilized in a polyacrylamide gel on a standard microscope slide (e.g., Polonator), chemically crosslinked to an amino-coated glass surface (e.g., Life/APG; Polonator), or deposited into individual PicoTiterPlate (PTP) wells (e.g., Roche/454), in which the NGS reaction can be performed.

Solid-phase amplification can also be used to produce templates for NGS. Typically, forward and reverse primers are covalently attached to a solid support. The surface density of the amplified fragments is defined by the ratio of the primers to the templates on the support. Solid-phase amplification can produce hundreds of millions spatially separated template clusters (e.g., Illumina/Solexa). The ends of the template clusters can be hybridized to universal sequencing primers for NGS reactions.

Other methods for preparing clonally amplified templates also include, e.g., Multiple Displacement Amplification (MDA) (Lasken R. S. *Curr Opin Microbiol.* 2007; 10(5): 510-6). MDA is a non-PCR based DNA amplification technique. The reaction involves annealing random hexamer primers to the template and DNA synthesis by high fidelity enzyme, typically 029 at a constant temperature. MDA can generate large sized products with lower error frequency.

Template amplification methods such as PCR can be coupled with NGS platforms to target or enrich specific regions of the genome (e.g., exons). Exemplary template enrichment methods include, e.g., microdroplet PCR technology (Tewhey R. et al., *Nature Biotech.* 2009, 27:1025-1031), custom-designed oligonucleotide microarrays (e.g., Roche/NimbleGen oligonucleotide microarrays), and solution-based hybridization methods (e.g., molecular inversion probes (MIPs) (Porreca G. J. et al., *Nature Methods*, 2007, 4:931-936; Krishnakumar S. et al., *Proc. Natl. Acad. Sci. USA*, 2008, 105:9296-9310; Turner E. H. et al., *Nature Methods*, 2009, 6:315-316), and biotinylated RNA capture sequences (Gnirke A. et al., *Nat. Biotechnol.* 2009; 27(2): 182-9)

Single-molecule templates are another type of templates that can be used for NGS reaction. Spatially separated single molecule templates can be immobilized on solid supports by various methods. In one approach, individual primer molecules are covalently attached to the solid support. Adapters are added to the templates and templates are then hybridized to the immobilized primers. In another approach, single-molecule templates are covalently attached to the solid support by priming and extending single-stranded, single-molecule templates from immobilized primers. Universal primers are then hybridized to the templates. In yet another approach, single polymerase molecules are attached to the solid support, to which primed templates are bound.

Sequencing and Imaging

Exemplary sequencing and imaging methods for NGS include, but are not limited to, cyclic reversible termination (CRT), sequencing by ligation (SBL), single-molecule addition (pyrosequencing), and real-time sequencing.

CRT uses reversible terminators in a cyclic method that minimally includes the steps of nucleotide incorporation, fluorescence imaging, and cleavage. Typically, a DNA polymerase incorporates a single fluorescently modified nucleotide corresponding to the complementary nucleotide of the template base to the primer. DNA synthesis is terminated after the addition of a single nucleotide and the unincorporated nucleotides are washed away. Imaging is performed to determine the identity of the incorporated labeled nucleotide. Then in the cleavage step, the terminating/inhibiting group and the fluorescent dye are removed. Exemplary NGS platforms using the CRT method include, but are not limited to, Illumina/Solexa Genome Analyzer (GA), which uses the clonally amplified template method coupled with the four-color CRT method detected by total internal reflection fluorescence (TIRF); and Helicos BioSciences/HeliScope, which uses the single-molecule template method coupled with the one-color CRT method detected by TIRF.

SBL uses DNA ligase and either one-base-encoded probes or two-base-encoded probes for sequencing. Typically, a fluorescently labeled probe is hybridized to its complementary sequence adjacent to the primed template. DNA ligase is used to ligate the dye-labeled probe to the primer. Fluorescence imaging is performed to determine the identity of the ligated probe after non-ligated probes are washed away. The fluorescent dye can be removed by using cleavable probes to regenerate a 5'-$PO_4$ group for subsequent ligation cycles. Alternatively, a new primer can be hybridized to the template after the old primer is removed. Exemplary SBL platforms include, but are not limited to, Life/APG/SOLiD (support oligonucleotide ligation detection), which uses two-base-encoded probes.

Pyrosequencing method is based on detecting the activity of DNA polymerase with another chemiluminescent enzyme. Typically, the method allows sequencing of a single strand of DNA by synthesizing the complementary strand along it, one base pair at a time, and detecting which base was actually added at each step. The template DNA is immobile, and solutions of A, C, G, and T nucleotides are sequentially added and removed from the reaction. Light is produced only when the nucleotide solution complements the first unpaired base of the template. The sequence of solutions which produce chemiluminescent signals allows the determination of the sequence of the template. Exemplary pyrosequencing platforms include, but are not limited to, Roche/454, which uses DNA templates prepared by emPCR with 1-2 million beads deposited into PTP wells.

Real-time sequencing involves imaging the continuous incorporation of dye-labeled nucleotides during DNA synthesis. Exemplary real-time sequencing platforms include, but are not limited to, Pacific Biosciences platform, which uses DNA polymerase molecules attached to the surface of individual zero-mode waveguide (ZMW) detectors to obtain sequence information when phospholinked nucleotides are being incorporated into the growing primer strand; Life/VisiGen platform, which uses an engineered DNA polymerase with an attached fluorescent dye to generate an enhanced signal after nucleotide incorporation by fluorescence resonance energy transfer (FRET); and LI-COR Biosciences platform, which uses dye-quencher nucleotides in the sequencing reaction.

Other sequencing methods for NGS include, but are not limited to, nanopore sequencing, sequencing by hybridization, nano-transistor array based sequencing, polony sequencing, scanning tunneling microscopy (STM) based sequencing, and nanowire-molecule sensor based sequencing.

Nanopore sequencing involves electrophoresis of nucleic acid molecules in solution through a nano-scale pore which provides a highly confined space within which single-nucleic acid polymers can be analyzed. Exemplary methods of nanopore sequencing are described, e.g., in Branton D. et al., *Nat Biotechnol.* 2008; 26(10):1146-53.

Sequencing by hybridization is a non-enzymatic method that uses a DNA microarray. Typically, a single pool of DNA is fluorescently labeled and hybridized to an array containing known sequences. Hybridization signals from a given spot on the array can identify the DNA sequence. The binding of one strand of DNA to its complementary strand in the DNA double-helix is sensitive to even single-base mismatches when the hybrid region is short or is specialized mismatch detection proteins are present. Exemplary methods of sequencing by hybridization are described, e.g., in Hanna G. J. et al., *J. Clin. Microbiol.* 2000; 38 (7): 2715-21; and Edwards J. R. et al., *Mut. Res.* 2005; 573 (1-2): 3-12.

Polony sequencing is based on polony amplification and sequencing-by-synthesis via multiple single-base-extensions (FISSEQ). Polony amplification is a method to amplify DNA in situ on a polyacrylamide film. Exemplary polony sequencing methods are described, e.g., in US Patent Application Publication No. 2007/0087362.

Nano-transistor array based devices, such as Carbon NanoTube Field Effect Transistor (CNTFET), can also be used for NGS. For example, DNA molecules are stretched and driven over nanotubes by micro-fabricated electrodes. DNA molecules sequentially come into contact with the carbon nanotube surface, and the difference in current flow from each base is produced due to charge transfer between the DNA molecule and the nanotubes. DNA is sequenced by recording these differences. Exemplary Nano-transistor array based sequencing methods are described, e.g., in U.S. Patent Application Publication No. 2006/0246497.

Scanning tunneling microscopy (STM) can also be used for NGS. STM uses a piezo-electric-controlled probe that performs a raster scan of a specimen to form images of its surface. STM can be used to image the physical properties of single DNA molecules, e.g., generating coherent electron tunneling imaging and spectroscopy by integrating scanning tunneling microscope with an actuator-driven flexible gap. Exemplary sequencing methods using STM are described, e.g., in U.S. Patent Application Publication No. 2007/0194225.

A molecular-analysis device which is comprised of a nanowire-molecule sensor can also be used for NGS. Such device can detect the interactions of the nitrogenous material disposed on the nanowires and nucleic acid molecules such as DNA. A molecule guide is configured for guiding a molecule near the molecule sensor, allowing an interaction and subsequent detection. Exemplary sequencing methods using nanowire-molecule sensor are described, e.g., in U.S. Patent Application Publication No. 2006/0275779.

Double ended sequencing methods can be used for NGS. Double ended sequencing uses blocked and unblocked primers to sequence both the sense and antisense strands of DNA. Typically, these methods include the steps of annealing an unblocked primer to a first strand of nucleic acid; annealing a second blocked primer to a second strand of nucleic acid; elongating the nucleic acid along the first strand with a polymerase; terminating the first sequencing primer; deblocking the second primer; and elongating the nucleic acid along the second strand. Exemplary double ended sequencing methods are described, e.g., in U.S. Pat. No. 7,244,567.

Data Analysis

After NGS reads have been generated, they can be aligned to a known reference sequence or assembled de novo.

For example, identifying genetic variations such as single-nucleotide polymorphism and structural variants in a sample (e.g., a tumor sample) can be accomplished by aligning NGS reads to a reference sequence (e.g., a wild-type sequence). Methods of sequence alignment for NGS are described e.g., in Trapnell C. and Salzberg S. L. *Nature Biotech.*, 2009, 27:455-457.

Examples of de novo assemblies are described, e.g., in Warren R. et al., *Bioinformatics*, 2007, 23:500-501; Butler J. et al., *Genome Res.*, 2008, 18:810-820; and Zerbino D. R. and Birney E., *Genome Res.*, 2008, 18:821-829.

Sequence alignment or assembly can be performed using read data from one or more NGS platforms, e.g., mixing Roche/454 and Illumina/Solexa read data.

Algorithms and methods for data analysis are described in U.S. Ser. No. 61/428,568, filed Dec. 30, 2010, incorporated herein by reference.

Fusion Expression Level

In certain embodiments, expression level of a fusion described herein can also be assayed. Fusion expression can be assessed by any of a wide variety of methods for detecting expression of a transcribed molecule or protein. Non-limiting examples of such methods include immunological methods for detection of secreted, cell-surface, cytoplasmic, or nuclear proteins, protein purification methods, protein function or activity assays, nucleic acid hybridization methods, nucleic acid reverse transcription methods, and nucleic acid amplification methods.

In certain embodiments, activity of a particular gene is characterized by a measure of gene transcript (e.g., mRNA), by a measure of the quantity of translated protein, or by a measure of gene product activity. Fusion expression can be monitored in a variety of ways, including by detecting mRNA levels, protein levels, or protein activity, any of which can be measured using standard techniques. Detection can involve quantification of the level of gene expression (e.g., genomic DNA, cDNA, mRNA, protein, or enzyme activity), or, alternatively, can be a qualitative assessment of the level of gene expression, in particular in comparison with a control level. The type of level being detected will be clear from the context.

Methods of detecting and/or quantifying the fusion gene transcript (mRNA or cDNA made therefrom) using nucleic acid hybridization techniques are known to those of skill in the art (see Sambrook et al. supra). For example, one method for evaluating the presence, absence, or quantity of cDNA involves a Southern transfer as described above. Briefly, the mRNA is isolated (e.g., using an acid guanidinium-phenol-chloroform extraction method, Sambrook et al. supra.) and reverse transcribed to produce cDNA. The cDNA is then optionally digested and run on a gel in buffer and transferred to membranes. Hybridization is then carried out using the nucleic acid probes specific for the cDNA of a fusion described herein, e.g., using the probes and primers described herein.

In other embodiments, expression of a fusion molecule described herein is assessed by preparing genomic DNA or mRNA/cDNA (i.e., a transcribed polynucleotide) from cells in a subject sample, and by hybridizing the genomic DNA or mRNA/cDNA with a reference polynucleotide which is a complement of a polynucleotide comprising the fusion, and fragments thereof. cDNA can, optionally, be amplified using any of a variety of polymerase chain reaction methods prior to hybridization with the reference polynucleotide. Expression of a fusion as described herein can likewise be detected using quantitative PCR (QPCR) to assess the level of expression.

Detection of Fusion Polypeptide

The activity or level of a fusion polypeptide described herein can also be detected and/or quantified by detecting or quantifying the expressed polypeptide. The fusion polypeptide can be detected and quantified by any of a number of means known to those of skill in the art. These can include analytic biochemical methods such as electrophoresis, capillary electrophoresis, high performance liquid chromatography (HPLC), thin layer chromatography (TLC), hyperdiffusion chromatography, and the like, or various immunological methods such as fluid or gel precipitin reactions, immunodiffusion (single or double), immunoelectrophoresis, radioimmunoassay (RIA), enzyme-linked immunosorbent assays (ELISAs), immunofluorescent assays, Western blotting, immunohistochemistry (IHC) and the like. A skilled artisan can adapt known protein/antibody detection methods.

Another agent for detecting a fusion polypeptide is an antibody molecule capable of binding to a polypeptide corresponding to a marker, e.g., an antibody with a detectable label. Techniques for generating antibodies are described herein. The term "labeled", with regard to the probe or antibody, is intended to encompass direct labeling of the probe or antibody by coupling (i.e., physically linking) a detectable substance to the probe or antibody, as well as indirect labeling of the probe or antibody by reactivity with another reagent that is directly labeled. Examples of indirect labeling include detection of a primary antibody using a fluorescently labeled secondary antibody and end-labeling of a DNA probe with biotin such that it can be detected with fluorescently labeled streptavidin.

In another embodiment, the antibody is labeled, e.g., a radio-labeled, chromophore-labeled, fluorophore-labeled, or enzyme-labeled antibody. In another embodiment, an antibody derivative {e.g., an antibody conjugated with a substrate or with the protein or ligand of a protein-ligand pair (e.g., biotin-streptavidin}), or an antibody fragment (e.g., a single-chain antibody, an isolated antibody hypervariable domain, etc.) which binds specifically with a fusion protein described herein, is used.

Fusion polypeptides from cells can be isolated using techniques that are known to those of skill in the art. The protein isolation methods employed can, for example, be such as those described in Harlow and Lane (Harlow and Lane, 1988, *Antibodies: A Laboratory Manual*, Cold Spring Harbor Laboratory Press, Cold Spring Harbor, New York).

Means of detecting proteins using electrophoretic techniques are well known to those of skill in the art (see generally, R. Scopes (1982) *Protein Purification*, Springer-Verlag, N.Y.; Deutscher, (1990) *Methods in Enzymology* Vol. 182: *Guide to Protein Purification*, Academic Press, Inc., N.Y.).

In another embodiment, Western blot (immunoblot) analysis is used to detect and quantify the presence of a polypeptide in the sample.

In another embodiment, the polypeptide is detected using an immunoassay. As used herein, an immunoassay is an assay that utilizes an antibody to specifically bind to the analyte. The immunoassay is thus characterized by detection of specific binding of a polypeptide to an anti-antibody as opposed to the use of other physical or chemical properties to isolate, target, and quantify the analyte.

The fusion polypeptide is detected and/or quantified using any of a number of immunological binding assays (see, e.g., U.S. Pat. Nos. 4,366,241; 4,376,110; 4,517,288; and 4,837,168). For a review of the general immunoassays, see also Asai (1993) *Methods in Cell Biology Volume* 37: Antibodies in Cell Biology, Academic Press, Inc. New York; Stites & Ten (1991) *Basic and Clinical Immunology* 7th Edition.

Kits

In one aspect, the invention features, a kit, e.g., containing an oligonucleotide having a mutation described herein, e.g., a fusion molecule described herein. Optionally, the kit can also contain an oligonucleotide that is the wildtype counterpart of the mutant oligonucleotide.

A kit featured in the invention can include a carrier, e.g., a means being compartmentalized to receive in close confinement one or more container means. In one embodiment the container contains an oligonucleotide, e.g., a primer or probe as described above. The components of the kit are useful, for example, to diagnose or identify a mutation in a tumor sample in a patient. The probe or primer of the kit can be used in any sequencing or nucleotide detection assay known in the art, e.g., a sequencing assay, e.g., an NGS method, RT-PCR, or in situ hybridization.

In some embodiments, the components of the kit are useful, for example, to diagnose or identify a fusion described herein in a tumor sample in a patient, and to accordingly identify an appropriate therapeutic agent to treat the cancer.

A kit featured in the invention can include, e.g., assay positive and negative controls, nucleotides, enzymes (e.g., RNA or DNA polymerase or ligase), solvents or buffers, a stabilizer, a preservative, a secondary antibody, e.g., an anti-HRP antibody (IgG) and a detection reagent.

An oligonucleotide can be provided in any form, e.g., liquid, dried, semi-dried, or lyophilized, or in a form for storage in a frozen condition.

Typically, an oligonucleotide, and other components in a kit are provided in a form that is sterile. An oligonucleotide, e.g., an oligonucleotide that contains a mutation, e.g., a fusion described herein, or an oligonucleotide complementary to a fusion described herein, is provided in a liquid solution, the liquid solution generally is an aqueous solution, e.g., a sterile aqueous solution. When the oligonucleotide is provided as a dried form, reconstitution generally is accomplished by the addition of a suitable solvent. The solvent, e.g., sterile buffer, can optionally be provided in the kit.

The kit can include one or more containers for the composition containing an oligonucleotide in a concentration suitable for use in the assay or with instructions for dilution for use in the assay. In some embodiments, the kit contains separate containers, dividers or compartments for the oligonucleotide and assay components, and the informational material. For example, the oligonucleotides can be contained in a bottle or vial, and the informational material can be contained in a plastic sleeve or packet. In other embodiments, the separate elements of the kit are contained within a single, undivided container. For example, an oligonucleotide composition is contained in a bottle or vial that has attached thereto the informational material in the form of a label. In some embodiments, the kit includes a plurality (e.g., a pack) of individual containers, each containing one or more unit forms (e.g., for use with one assay) of an oligonucleotide. For example, the kit includes a plurality of ampoules, foil packets, or blister packs, each containing a single unit of oligonucleotide for use in sequencing or detecting a mutation in a tumor sample. The containers of the kits can be air tight and/or waterproof. The container can be labeled for use.

For antibody-based kits, the kit can include: (1) a first antibody (e.g., attached to a solid support) which binds to a fusion polypeptide; and, optionally, (2) a second, different antibody which binds to either the polypeptide or the first antibody and is conjugated to a detectable agent.

In one embodiment, the kit can include informational material for performing and interpreting the sequencing or diagnostic. In another embodiment, the kit can provide guidance as to where to report the results of the assay, e.g., to a treatment center or healthcare provider. The kit can include forms for reporting the results of a sequencing or diagnostic assay described herein, and address and contact information regarding where to send such forms or other related information; or a URL (Uniform Resource Locator) address for reporting the results in an online database or an online application (e.g., an app). In another embodiment, the informational material can include guidance regarding whether a patient should receive treatment with a particular chemotherapeutic drug, depending on the results of the assay.

The informational material of the kits is not limited in its form. In many cases, the informational material, e.g., instructions, is provided in printed matter, e.g., a printed text, drawings, and/or photographs, e.g., a label or printed sheet. However, the informational material can also be provided in other formats, such as computer readable material, video recording, or audio recording. In another embodiment, the informational material of the kit is contact information, e.g., a physical address, email address, website, or telephone number, where a user of the kit can obtain substantive information about the sequencing or diagnostic assay and/or its use in the methods described herein. The informational material can also be provided in any combination of formats.

In some embodiments, a biological sample is provided to an assay provider, e.g., a service provider (such as a third party facility) or a healthcare provider, who evaluates the sample in an assay and provides a read out. For example, in one embodiment, an assay provider receives a biological sample from a subject, such as a blood or tissue sample, e.g., a biopsy sample, and evaluates the sample using an assay described herein, e.g., a sequencing assay or in situ hybridization assay, and determines that the sample contains a fusion described herein. The assay provider, e.g., a service provider or healthcare provider, can then conclude that the subject is, or is not, a candidate for a particular drug or a particular cancer treatment regimen.

The assay provider can provide the results of the evaluation, and optionally, conclusions regarding one or more of diagnosis, prognosis, or appropriate therapy options to, for example, a healthcare provider, or patient, or an insurance company, in any suitable format, such as by mail or electronically, or through an online database. The information collected and provided by the assay provider can be stored in a database.

Incorporated by reference herein in their entirety are any polynucleotide and polypeptide sequences which reference an accession number correlating to an entry in a public database, such as those maintained by the COSMIC database, available on the worldwide web at sanger.ac.uk/genetics/CGP/cosmic/; and the Institute for Genomic Research (TIGR) on the world wide web at tigr.org and/or the National Center for Biotechnology Information (NCBI) on the world wide web at ncbi.nlm.nih.gov.

EQUIVALENTS

Those skilled in the art will recognize, or be able to ascertain using no more than routine experimentation, many equivalents to the specific embodiments described herein. Such equivalents are intended to be encompassed by the following claims.

SEQUENCE LISTING (145 sequences)

SEQ ID NO: 1 - DNA, 3147 bp, Artificial Sequence
  source: /note="Description of Artificial Sequence: Synthetic polynucleotide"
  CDS (1)..(3144)
atgggcgcccctgcctgcgccctcgcgctctgcgtggccgtggccatcgtggccggcgcctcctcggagtccttggggacggagcagcgcgtcgtggggcgagcggcagaagtcccgggcccagagcccggccagcaggagcagttggtcttcggcagcggggatgctgtggagctgagctgtcccccgcccgggggtggtcccatggggcccactgtctgggtcaaggatggcacagggctggtgccctcggagcgtgtcctggtggggccccagcggctgcaggtgctgaatgcctcccacgaggactccggggcctacagctgccggcagcggctcacgcagcgcgtactgtgccacttcagtgtgcgggtgacagacgctccatcctcgggagatgacgaagacggggaggacgaggctgaggacacaggtgtggacacaggggccccttactggacacggcccgagcggatggacaagaagctgctggccgtgccggccgccaacaccgtccgcttccgctgcccagccgctggcaaccccactccctccatctcctggctgaagaacggcagggagttccgcggcgagcaccgcattggaggcatcaagctgcggcatcagcagtggagcctggtcatggaaagcgtggtgccctcggaccgcggcaactacacctgcgtcgtggagaacaagtttggcagcatccggcagacgtacacgctggacgtgctggagcgctccccgcaccggcccatcctgcaggcggggctgccggccaaccagacggcggtgctgggcagcgacgtggagttccactgcaaggtgtacagtgacgcacagccccacatccagtggctcaagcacgtggaggtgaatggcagcaaggtgggcccggacggcacaccctacgttaccgtgctcaagacggcgggcgctaacaccaccgacaaggagctagaggttctctccttgcacaacgtcacctttgaggacgccggggagtacacctgcctggcgggcaattctattgggttttctcatcactctgcgtggctggtggtgctgccagccgaggaggagctggtggaggctgacgaggcgggcagtgtgtatgcaggcatcctcagctacggggtgggcttcttcctgttcatcctggtggtggcggctgtgacgctctgccgcctgcgcagcccccccaagaaaggcctgggctcccccaccgtgcacaagatctcccgcttcccgctcaagcgacaggtgtccctggagtccaacgcgtccatgagctccaacacaccactggtgcgcatcgcaaggctgtcctcaggggagggccccacgctggccaatgtctccgagctcgagctgcctgccgaccccaaatgggagctgtctcgggcccggctgaccctgggcaagccccttggggagggctgcttcggccaggtggtcatggcggaggccatcggcattgacaaggaccgggccgccaagcctgtcaccgtagccgtgaagatgctgaaagacgatgccactgacaaggacctgtcggacctggtgtctgagatggagatgatgaagatgatcgggaaacacaaaaacatcatcaacctgctgggcgcctgcacgcagggcgggcccctgtacgtgctggtggagtacgcggccaagggtaacctgcgggagtttctgcgggcgcggcggcccccgggcctggactactccttcgacacctgcaagccgcccgaggagcagctcaccttcaaggacctggtgtcctgtgcctaccaggtggcccggggcatggagtacttggcctcccagaagtgcatccacagggacctggctgcccgcaatgtgctggtgaccgaggacaacgtgatgaagatcgcagacttcgggctggcccgggacgtgcacaacctcgactactacaagaagacaaccaacggccggctgcccgtgaagtggatggcgcctgaggccttgtttgaccgagtctacactcaccagagtgacgtctggtcctttggggtcctgctctgggagatcttcacgctggggggctccccgtaccccggcatccctgtggaggagctcttcaagctgctgaaggagggccaccgcatggacaagcccgccaactgcacacacgacctgtacatgatcatgcgggagtgctggcatgccgcgccctcccagaggcccaccttcaagcagctggtggaggacctggaccgtgtccttaccgtgacgtccaccgactttaaggagtcggccttgaggaagcagtccttatacctcaagttcgaccccctcctgagggacagtcctggtagaccagtgcccgtggccaccgagaccagcagcatgcacggtgcaaatgagactccctcaggacgtccgcgggaagccaagcttgtggagttcgatttcttgggagcactggacattcctgtgccaggcccacccccaggtgttcccgcgcctgggggcccacccctgtccaccggacctatagtggacctgctccagtacagccagaaggacctggatgcagtggtaaaggcgacacaggaggagaaccgggagctgaggagcaggtgtgaggagctccacgggaagaacctggaactggggaagatcatggacaggttcgaagaggttgtgtaccaggccatggaggaagttcagaagcagaaggaactttccaaagctgaaatccagaaagttctaaaagaaaaagaccaacttaccacagatctgaactccatggagaagtccttctccgacctcttcaagcgttttgagaaacagaaagaggtgatcgagggctaccgcaagaacgaagagtcactgaagaagtgcgtggaggattacctggcaaggatcacccaggagggccagaggtaccaagccctgaaggcccacgcggaggagaagctgcagctggcaaacgaggagatcgcccaggtccggagcaaggcccaggcggaagcgttggccctccaggccagcctgaggaaggagcagatgcgcatccagtcgctggagaagacagtggagcagaagactaaagagaacgaggagctgaccaggatctgcgacgacctcatctccaagatggagaagatctga

SEQ ID NO: 2 - protein, 1048 aa, Artificial Sequence
  source: /note="Description of Artificial Sequence: Synthetic polypeptide"
MGAPACALALCVAVAIVAGASSESLGTEQRVVGRAAEVPGPEPGQQEQLVFGSGDAVELSCPPPGGGPMGPTVWVKDGTGLVPSERVLVGPQRLQVLNASHEDSGAYSCRQRLTQRVLCHFSVRVTDAPSSGDDEDGEDEAEDTGVDTGAPYWTRPERMDKKLLAVPAANTVRFRCPAAGNPTPSISWLKNGREFRGEHRIGGIKLRHQQWSLVMESVVPSDRGNYTCVVENKFGSIRQTYTLDVLERSPHRPILQAGLPANQTAVLGSDVEFHCKVYSDAQPHIQWLKHVEVNGSKVGPDGTPYVTVLKTAGANTTDKELEVLSLHNVTFEDAGEYTCLAGNSIGFSHHSAWLVVLPAEEELVEADEAGSVYAGILSYGVGFFLFILVVAAVTLCRLRSPPKKGLGSPTVHKISRFPLKRQVSLESNASMSSNTPLVRIARLSSGEGPTLANVSELELPADPKWELSRARLTLGKPLGEGCFGQVVMAEAIGIDKDRAAKPVTVAVKMLKDDATDKDLSDLVSEMEMMKMIGKHKNIINLLGACTQGGPLYVLVEYAAKGNLREFLRARRPPGLDYSFDTCKPPEEQLTFKDLVSCAYQVARGMEYLASQKCIHRDLAARNVLVTEDNVMKIADFGLARDVHNLDYYKKTTNGRLPVKWMAPEALFDRVYTHQSDVWSFGVLLWEIFTLGGSPYPGIPVEELFKLLKEGHRMDKPANCTHDLYMIMRECWHAAPSQRPTFKQLVEDLDRVLTVTSTDFKESALRKQSLYLKFDPLLRDSPGRPVPVATETSSMHGANETPSGRPREAKLVEFDFLGALDIPVPGPPPGVPAPGGPPLSTGPIVDLLQYSQKDLDAVVKATQEENRELRSRCEELHGKNLELGKIMDRFEEVVYQAMEEVQKQKELSKAEIQKVLKEKDQLTTDLNSMEKSFSDLFKRFEKQKEVIEGYRKNEESLKKCVEDYLARITQEGQRYQALKAHAEEKLQLANEEIAQVRSKAQAEALALQASLRKEQMRIQSLEKTVEQKTKENEELTRICDDLISKMEKI

SEQ ID NO: 3 - DNA, 4304 bp, Homo sapiens
gtcgcgggcagctggcgccgcgcggtcctgctctgccggtcgcacggacgcaccggcgggccgccggccggagggacggggcgggagctgggcccgcggacagcgagccggagcgggagccgcgcgtagcgagccgggctccggcgctcgccagtctcccgagcggcgcccgcctcccgccggtgcccgcgccgggccgtggggggcagcatgcccgcgcgcgctgcctgaggacgccgcggcccccgcccccgccatgggcgcccctgcctgcgccctcgcgctctgcgtggccgtggccatcgtggccggcgcctcctcggagtccttggggacggagcagcgcgtcgtggggcgagcggcagaagtcccgggcccagagcccggccagcaggagcagttggtcttcggcagcggggatgctgtggagctgagctgtcccccgcccgggggtggtcccatggggcccactgtctgggtcaaggatggcacagggctggtgccctcggagcgtgtcctggtggggccccagcggctgcaggtgctgaatgcctcccacgaggactccggggcctacagctgccggcagcggctcacgcagcgcgtactgtgccacttcagtgtgcgggtgacagacgctccatcctcgggagatgacgaagacggggaggacgaggctgaggacacaggtgtggacacaggggccccttactggacacggcccgagcggatggacaagaagctgctggccgtgccggccgccaacaccgtccgcttccgctgcccagccgctggcaaccccactccctccatctcctggctgaagaacggcagggagttccgcggcgagcaccgcattggaggcatcaagctgcggcatcagcagtggagcctggtcatggaaagcgtggtgccctcggaccgcggcaactacacctgcgtcgtggagaacaagtttggcagcatccggcagacgtacacgctggacgtgctggagcgctccccgcaccggcccatcctgcaggcggggctgccggccaaccagacggcggtgctgggcagcgacgtggagttccactgcaaggtgtacagtgacgcacagccccacatccagtggctcaagcacgtggaggtgaatggcagcaaggtgggcccggacggcacaccctacgttaccgtgctcaagacggcgggcgctaacaccaccgacaaggagctagaggttctctccttgcacaacgtcacctttgaggacgccggggagtacacctgcctggcgggcaattctattgggttttctcatcactctgcgtggctggtggtgctgccagccgaggaggagctggtggaggctgacgaggcgggcagtgtgtatgcaggcatcctcagctacggggtgggcttcttcctgttcatcctggtggtggcggctgtgacgctctgccgcctgcgcagcccccccaagaaaggcctgggctcccccaccgtgcacaagatctcccgcttcccgctcaagcgacaggtgtccctggagtccaacgcgtccatgagctccaacacaccactggtgcgcatcgcaaggctgtcctcaggggagggccccacgctggccaatgtctccgagctcgagctgcctgccgaccccaaatgggagctgtctcgggcccggctgaccctgggcaagccccttggggagggctgcttcggccaggtggtcatggcggaggccatcggcattgacaaggaccgggccgccaagcctgtcaccgtagccgtgaagatgctgaaagacgatgccactgacaaggacctgtcggacctggtgtctgagatggagatgatgaagatgatcgggaaacacaaaaacatcatcaacctgctgggcgcctgcacgcagggcgggcccctgtacgtgctggtggagtacgcggccaagggtaacctgcgggagtttctgcgggcgcggcggcccccgggcctggactactccttcgacacctgcaagccgcccgaggagcagctcaccttcaaggacctggtgtcctgtgcctaccaggtggcccggggcatggagtacttggcctcccagaagtgcatccacagggacctggctgcccgcaatgtgctggtgaccgaggacaacgtgatgaagatcgcagacttcgggctggcccgggacgtgcacaacctcgactactacaagaagacaaccaacggccggctgcccgtgaagtggatggcgcctgaggccttgtttgaccgagtctacactcaccagagtgacgtctggtcctttggggtcctgctctgggagatcttcacgctggggggctccccgtaccccggcatccctgtggaggagctcttcaagctgctgaaggagggccaccgcatggacaagcccgccaactgcacacacgacctgtacatgatcatgcgggagtgctggcatgccgcgccctcccagaggcccaccttcaagcagctggtggaggacctggaccgtgtccttaccgtgacgtccaccgacgagtacctggacctgtcggcgcctttcgagcagtactccccgggtggccaggacacccccagctccagctcctcaggggacgactccgtgtttgcccacgacctgctgcccccggccccacccagcagtgggggctcgcggacgtgaagggccactggtccccaacaatgtgaggggtccctagcagcccaccctgctgctggtgcacagccactccccggcatgagactcagtgcagatggagagacagctacacagagctttggtctgtgtgtgtgtgtgtgcgtgtgtgtgtgtgtgtgtgcacatccgcgtgtgcctgtgtgcgtgcgcatcttgcctccaggtgcagaggtaccctgggtgtccccgctgctgtgcaacggtctcctgactggtgctgcagcaccgaggggcctttgttctggggggacccagtgcagaatgtaagtgggcccacccggtgggacccccgtggggcagggagctgggcccgacatggctccggcctctgcctttgcaccacgggacatcacagggtgggcctcggcccctcccacacccaaagctgagcctgcagggaagccccacatgtccagcaccttgtgcctggggtgttagtggcaccgcctccccacctccaggctttcccacttcccaccctgcccctcagagactgaaattacgggtacctgaagatgggagcctttaccttttatgcaaaaggtttattccggaaactagtgtacatttctataaatagatgctgtgtatatggtatatatacatatatatatataacatatatggaagaggaaaaggctggtacaacggaggcctgcgaccctgggggcacaggaggcaggcatggccctgggcggggcgtgggggggcgtggagggaggccccagggggtctcacccatgcaagcagaggaccagggccttttctggcaccgcagttttgttttaaaactggacctgtatatttgtaaagctatttatgggcccctggcactcttgttcccacaccccaacacttccagcatttagctggccacatggcggagagttttaatttttaacttattgacaaccgagaaggtttatcccgccgatagagggacggccaagaatgtacgtccagcctgccccggagctggaggatcccctccaagcctaaaaggttgttaatagttggaggtgattccagtgaagatattttatttcctttgtcctttttcaggagaattagatttctataggatttttctttaggagatttattttttggacttcaaagcaagctggtattttcatacaaattcttctaattgctgtgtgtcccaggcagggagacggtttccagggaggggccggccctgtgtgcaggttccgatgttattagatgttacaagtttatatatatctatatatataatttattgagtttttacaagatgtatttgttgtagacttaacacttcttacgcaatgcttctagagttttatagcctggactgctacctttcaaagcttggagggaagccgtgaattcagttggttcgttctgtactgttactgggccctgagtctgggcagctgtcccttgcttgcctgcagggccatggctcagggtggtctcttcttggggcccagtgcatggtggccagaggtgtcacccaaaccggcaggtgcgattttgttaacccagcgacgaactttccgaaaaataaagacacctggttgctaacctggaaaaaaaaaaaaaaaaa

SEQ ID NO: 4 - protein, 806 aa, Homo sapiens
MGAPACALALCVAVAIVAGASSESLGTEQRVVGRAAEVPGPEPGQQEQLVFGSGDAVELSCPPPGGGPMGPTVWVKDGTGLVPSERVLVGPQRLQVLNASHEDSGAYSCRQRLTQRVLCHFSVRVTDAPSSGDDEDGEDEAEDTGVDTGAPYWTRPERMDKKLLAVPAANTVRFRCPAAGNPTPSISWLKNGREFRGEHRIGGIKLRHQQWSLVMESVVPSDRGNYTCVVENKFGSIRQTYTLDVLERSPHRPILQAGLPANQTAVLGSDVEFHCKVYSDAQPHIQWLKHVEVNGSKVGPDGTPYVTVLKTAGANTTDKELEVLSLHNVTFEDAGEYTCLAGNSIGFSHHSAWLVVLPAEEELVEADEAGSVYAGILSYGVGFFLFILVVAAVTLCRLRSPPKKGLGSPTVHKISRFPLKRQVSLESNASMSSNTPLVRIARLSSGEGPTLANVSELELPADPKWELSRARLTLGKPLGEGCFGQVVMAEAIGIDKDRAAKPVTVAVKMLKDDATDKDLSDLVSEMEMMKMIGKHKNIINLLGACTQGGPLYVLVEYAAKGNLREFLRARRPPGLDYSFDTCKPPEEQLTFKDLVSCAYQVARGMEYLASQKCIHRDLAARNVLVTEDNVMKIADFGLARDVHNLDYYKKTTNGRLPVKWMAPEALFDRVYTHQSDVWSFGVLLWEIFTLGGSPYPGIPVEELFKLLKEGHRMDKPANCTHDLYMIMRECWHAAPSQRPTFKQLVEDLDRVLTVTSTDEYLDLSAPFEQYSPGGQDTPSSSSSGDDSVFAHDLLPPAPPSSGGSRT

SEQ ID NO: 5 - DNA, 2847 bp, Homo sapiens
gcgtttgaaactccggcgcgccggcggccatcaagggctagaagcgcgacggcggtagcagctaggcttggcccccggcgtggagcagacgcggacccctccttcctggcggcggcggcgcgggctcagagcccggcaacgggcgggcgggcagaatgagtctgcaggtcttaaacgacaaaaatgtcagcaatgaaaaaaatacagaaaattgcgacttcctgttttcgccaccagaagttaccggaagatcgtctgttcttcgtgtgtcacagaaagaaaatgtgccacccaagaacctggccaaagctatgaaggtgacttttcagacacctctgcgggatccacagacgcacaggattctaagtcctagcatggccagcaaacttgaggctcctttcactcaggatgacacccttggactggaaaactcacacccggtctggacacagaaagagaaccaacagctcatcaaggaagtggatgccaaaactactcatggaattctacagaaaccagtggaggctgacaccgacctcctgggggatgcaagcccagcctttgggagtggcagctccagcgagtctggcccaggtgccctggctgacctggactgctcaagctcttcccagagcccaggaagttctgagaaccaaatggtgtctccaggaaaagtgtctggcagccctgagcaagccgtggaggaaaaccttagttcctattccttagacagaagagtgacacccgcctctgagaccctagaagacccttgcaggacagagtcccagcacaaagcggagactccgcacggagccgaggaagaatgcaaagcggagactccgcacggagccgaggaggaatgccggcacggtggggtctgtgctcccgcagcagtggccacttcgcctcctggtgcaatccctaaggaagcctgcggaggagcacccctgcagggtctgcctggcgaagccctgggctgccctgcgggtgtgggcacccccgtgccagcagatggcactcagacccttacctgtgcacacacctctgctcctgagagcacagccccaaccaaccacctggtggctggcagggccatgaccctgagtcctcaggaagaagtggctgcaggccaaatggccagctcctcgaggagcggacctgtaaaactagaatttgatgtatctgatggcgccaccagcaaaagggcacccccaccaaggagactgggagagaggtccggcctcaagcctcccttgaggaaagcagcagtgaggcagcaaaaggccccgcaggaggtggaggaggacgacggtaggagcggagcaggagaggacccccccatgccagcttctcggggctcttaccacctcgactgggacaaaatggatgacccaaacttcatcccgttcggaggtgacaccaagtctggttgcagtgaggcccagcccccagaaagccctgagaccaggctgggccagccagcggctgaacagttgcatgctgggcctgccacggaggagccaggtccctgtctgagccagcagctgcattcagcctcagcggaggacacgcctgtggtgcagttggcagccgagaccccaacagcagagagcaaggagagagccttgaactctgccagcacctcgcttcccacaagctgtccaggcagtgagccagtgcccacccatcagcaggggcagcctgccttggagctgaaagaggagagcttcagagaccccgctgaggttctaggcacgggcgcggaggtggattacctggagcagtttggaacttcctcgtttaaggagtcggccttgaggaagcagtccttatacctcaagttcgaccccctcctgagggacagtcctggtagaccagtgcccgtggccaccgagaccagcagcatgcacggtgcaaatgagactccctcaggacgtccgcgggaagccaagcttgtggagttcgatttcttgggagcactggacattcctgtgccaggcccacccccaggtgttcccgcgcctgggggcccacccctgtccaccggacctatagtggacctgctccagtacagccagaaggacctggatgcagtggtaaaggcgacacaggaggagaaccgggagctgaggagcaggtgtgaggagctccacgggaagaacctggaactggggaagatcatggacaggttcgaagaggttgtgtaccaggccatggaggaagttcagaagcagaaggaactttccaaagctgaaatccagaaagttctaaaagaaaaagaccaacttaccacagatctgaactccatggagaagtccttctccgacctcttcaagcgttttgagaaacagaaagaggtgatcgagggctaccgcaagaacgaagagtcactgaagaagtgcgtggaggattacctggcaaggatcacccaggagggccagaggtaccaagccctgaaggcccacgcggaggagaagctgcagctggcaaacgaggagatcgcccaggtccggagcaaggcccaggcggaagcgttggccctccaggccagcctgaggaaggagcagatgcgcatccagtcgctggagaagacagtggagcagaagactaaagagaacgaggagctgaccaggatctgcgacgacctcatctccaagatggagaagatctgacctccacggagccgctgtccccgcccccctgctcccgtctgtctgtcctgtctgattctcttaggtgtcatgttcttttttctgtcttgtcttcaacttttttaaaaactagattgctttgaaaacatgactcaataaaagtttcctttcaatttaaacactgaaaaaaaaaaaa

SEQ ID NO: 6 - protein, 838 aa, Homo sapiens
MSLQVLNDKNVSNEKNTENCDFLFSPPEVTGRSSVLRVSQKENVPPKNLAKAMKVTFQTPLRDPQTHRILSPSMASKLEAPFTQDDTLGLENSHPVWTQKENQQLIKEVDAKTTHGILQKPVEADTDLLGDASPAFGSGSSSESGPGALADLDCSSSSQSPGSSENQMVSPGKVSGSPEQAVEENLSSYSLDRRVTPASETLEDPCRTESQHKAETPHGAEEECKAETPHGAEEECRHGGVCAPAAVATSPPGAIPKEACGGAPLQGLPGEALGCPAGVGTPVPADGTQTLTCAHTSAPESTAPTNHLVAGRAMTLSPQEEVAAGQMASSSRSGPVKLEFDVSDGATSKRAPPPRRLGERSGLKPPLRKAAVRQQKAPQEVEEDDGRSGAGEDPPMPASRGSYHLDWDKMDDPNFIPFGGDTKSGCSEAQPPESPETRLGQPAAEQLHAGPATEEPGPCLSQQLHSASAEDTPVVQLAAETPTAESKERALNSASTSLPTSCPGSEPVPTHQQGQPALELKEESFRDPAEVLGTGAEVDYLEQFGTSSFKESALRKQSLYLKFDPLLRDSPGRPVPVATETSSMHGANETPSGRPREAKLVEFDFLGALDIPVPGPPPGVPAPGGPPLSTGPIVDLLQYSQKDLDAVVKATQEENRELRSRCEELHGKNLELGKIMDRFEEVVYQAMEEVQKQKELSKAEIQKVLKEKDQLTTDLNSMEKSFSDLFKRFEKQKEVIEGYRKNEESLKKCVEDYLARITQEGQRYQALKAHAEEKLQLANEEIAQVRSKAQAEALALQASLRKEQMRIQSLEKTVEQKTKENEELTRICDDLISKMEKI

SEQ ID NO: 7 - DNA, 3905 bp, Homo sapiens
gacagataccctccttccggccgcgccactcgggaggcggatcccgtgggcctgaggaggcttcccccgcccggtttgctttccctccctcgctggcgctgccgcgagtccaccgagcggcctctgaggagcagccgcaggaggaggaggaggtcgtcgggggcggcgggcggagaccgcgctctcgcttccccggcggcggcaagggcaggacaatggaggtggcggtggagaaggcggtggcggcggcggcagcggcctcggctgcggcctccggggggccctcggcggcgccgagcggggagaacgaggccgagagtcggcagggcccggactcggagcgcggcggcgaggcggcccggctcaacctgttggacacttgcgccgtgtgccaccagaacatccagagccgggcgcccaagctgctgccctgcctgcactctttctgccagcgctgcctgcccgcgccccagcgctacctcatgctgcccgcgcccatgctgggctcggccgagaccccgccacccgtccctgcccccggctcgccggtcagcggctcgtcgccgttcgccacccaagttggagtcattcgttgcccagtttgcagccaagaatgtgcagagagacacatcatagataacttttttgtgaaggacactactgaggttcccagcagtacagtagaaaagtcaaatcaggtatgtacaagctgtgaggacaacgcagaagccaatgggttttgtgtagagtgtgttgaatggctctgcaagacgtgtatcagagctcatcagagggtaaagttcacaaaagaccacactgtcagacagaaagaggaagtatctccagaggcagttggtgtcaccagccagcgaccagtgttttgtccttttcataaaaaggagcagctgaagctgtactgtgagacatgtgacaaactgacatgtcgagactgtcagttgttagaacataaagagcatagataccaatttatagaagaagcttttcagaatcagaaagtgatcatagatacactaatcaccaaactgatggaaaaaacaaaatacataaaattcacaggaaatcagatccaaaacagaattattgaagtaaatcaaaatcaaaagcaggtggaacaggatattaaagttgctatatttacactgatggtagaaataaataaaaaaggaaaagctctactgcatcagttagagagccttgcaaaggaccatcgcatgaaacttatgcaacaacaacaggaagtggctggactctctaaacaattggagcatgtcatgcatttttctaaatgggcagtttccagtggcagcagtacagcattactttatagcaaacgactgattacataccggttacggcacctccttcgtgcaaggtgtgatgcatccccagtgaccaacaacaccatccaatttcactgtgatcctagtttctgggctcaaaatatcatcaacttaggttctttagtaatcgaggataaagagagccagccacaaatgcctaagcagaatcctgtcgtggaacagaattcacagccaccaagtggtttatcatcaaaccagttatccaagttcccaacacagatcagcctagctcaattacggctccagcatatgcagcaacagcaaccgcctccacgtttgataaactttcagaatcacagccccaaacccaatggaccagttcttcctcctcatcctcaacaactgagatatccaccaaaccagaacataccacgacaagcaataaagccaaaccccctacagatggctttcttggctcaacaagccataaaacagtggcagatcagcagtggacagggaaccccatcaactaccaacagcacatcctctactccttccagccccacgattactagtgcagcaggatatgatggaaaggcttttggttcacctatgatcgatttgagctcaccagtgggagggtcttataatcttccctctcttccggatattgactgttcaagtactattatgctggacaatattgtgaggaaagatactaatatagatcatggccagccaagaccaccctcaaacagaacggtccagtcaccaaattcatcagtgccatctccaggccttgcaggacctgttactatgactagtgtacaccccccaatacgttcacctagtgcctccagcgttggaagccgaggaagctctggctcttccagcaaaccagcaggagctgactctacacacaaagtcccagtggtcatgctggagccaattcgaataaaacaagaaaacagtggaccaccggaaaattatgatttccctgttgttatagtgaagcaagaatcagatgaagaatctaggcctcaaaatgccaattatccaagaagcatactcacctccctgctcttaaatagcagtcagagctctacttctgaggagactgtgctaagatcagatgcccctgatagtacaggagatcaacctggacttcaccaggacaattcctcaaatggaaagtctgaatggttggatccttcccagaagtcacctcttcatgttggagagacaaggaaagaggatgaccccaatgaggactggtgtgcagtttgtcaaaacggaggggaactcctctgctgtgaaaagtgccccaaagtattccatctttcttgtcatgtgcccacattgacaaattttccaagtggagagtggatttgcactttctgccgagacttatctaaaccagaagttgaatatgattgtgatgctcccagtcacaactcagaaaaaaagaaaactgaaggccttgttaagttaacacctatagataaaaggaagtgtgagcgcctacttttatttctttactgccatgaaatgagcctggcttttcaagaccctgttcctctaactgtgcctgattattacaaaataattaaaaatccaatggatttgtcaaccatcaagaaaagactacaagaagattattccatgtactcaaaacctgaagattttgtagctgattttagattgatctttcaaaactgtgctgaattcaatgagcctgattcagaagtagccaatgctggtataaaacttgaaaattattttgaagaacttctaaagaacctctatccagaaaaaaggtttcccaaaccagaattcaggaatgaatcagaagataataaatttagtgatgattcagatgatgactttgtacagccccggaagaaacgcctcaaaagcattgaagaacgccagttgcttaaataatatgcagcaccactagcttgtgctggtttttagatttttttgttttcaaaaaaacatttgtcagtaatttaacatcactacaaaaagaagagtttgtgactattctcatctctgttttggacgtttactagactttgatttccttaatagcccatttctgttaacctcttatcactaagaaagaaaggaaagaaggagatgaatagaagaaagaaaatggaaagaaggaaaaaaggaggatagaaaaaggatggaagaaagaagcattgaaaacaaagacattcttcccacttcttggatttttaaaccacagtctggagtgatagctactgtagaaaggaaatagactttgtatgaactctttaagttgaaaagtaaaaaatatatgtggtttggatgtgtgctttaattcagctttagaaattaataccactacccgtgaattatatggcctgacaatatgaattaggtgtactgtactgaagaacagtactccacaaacatgggtggtaacaagagttccatcccaggaggccaaacggtgcaacagaagggtaggttagatgctattaagaaggcacttaatagtacatcatgtaagatggcaactgtattaaagaaaaatccggaaaacaaaaa

SEQ ID NO: 8 - protein, 1016 aa, Homo sapiens
MEVAVEKAVAAAAAASAAASGGPSAAPSGENEAESRQGPDSERGGEAARLNLLDTCAVCHQNIQSRAPKLLPCLHSFCQRCLPAPQRYLMLPAPMLGSAETPPPVPAPGSPVSGSSPFATQVGVIRCPVCSQECAERHIIDNFFVKDTTEVPSSTVEKSNQVCTSCEDNAEANGFCVECVEWLCKTCIRAHQRVKFTKDHTVRQKEEVSPEAVGVTSQRPVFCPFHKKEQLKLYCETCDKLTCRDCQLLEHKEHRYQFIEEAFQNQKVIIDTLITKLMEKTKYIKFTGNQIQNRIIEVNQNQKQVEQDIKVAIFTLMVEINKKGKALLHQLESLAKDHRMKLMQQQQEVAGLSKQLEHVMHFSKWAVSSGSSTALLYSKRLITYRLRHLLRARCDASPVTNNTIQFHCDPSFWAQNIINLGSLVIEDKESQPQMPKQNPVVEQNSQPPSGLSSNQLSKFPTQISLAQLRLQHMQQQQPPPRLINFQNHSPKPNGPVLPPHPQQLRYPPNQNIPRQAIKPNPLQMAFLAQQAIKQWQISSGQGTPSTTNSTSSTPSSPTITSAAGYDGKAFGSPMIDLSSPVGGSYNLPSLPDIDCSSTIMLDNIVRKDTNIDHGQPRPPSNRTVQSPNSSVPSPGLAGPVTMTSVHPPIRSPSASSVGSRGSSGSSSKPAGADSTHKVPVVMLEPIRIKQENSGPPENYDFPVVIVKQESDEESRPQNANYPRSILTSLLLNSSQSSTSEETVLRSDAPDSTGDQPGLHQDNSSNGKSEWLDPSQKSPLHVGETRKEDDPNEDWCAVCQNGGELLCCEKCPKVFHLSCHVPTLTNFPSGEWICTFCRDLSKPEVEYDCDAPSHNSEKKKTEGLVKLTPIDKRKCERLLLFLYCHEMSLAFQDPVPLTVPDYYKIIKNPMDLSTIKKRLQEDYSMYSKPEDFVADFRLIFQNCAEFNEPDSEVANAGIKLENYFEELLKNLYPEKRFPKPEFRNESEDNKFSDDSDDDFVQPRKKRLKSIEERQLLK

SEQ ID NO: 9 - DNA, 2949 bp, Homo sapiens
cgcctcccttccccctccccgcccgacagcggccgctcgggccccggctctcggttataagatggcggcgctgagcggtggcggtggtggcggcgcggagccgggccaggctctgttcaacggggacatggagcccgaggccggcgccggcgccggcgccgcggcctcttcggctgcggaccctgccattccggaggaggtgtggaatatcaaacaaatgattaagttgacacaggaacatatagaggccctattggacaaatttggtggggagcataatccaccatcaatatatctggaggcctatgaagaatacaccagcaagctagatgcactccaacaaagagaacaacagttattggaatctctggggaacggaactgatttttctgtttctagctctgcatcaatggataccgttacatcttcttcctcttctagcctttcagtgctaccttcatctctttcagtttttcaaaatcccacagatgtggcacggagcaaccccaagtcaccacaaaaacctatcgttagagtcttcctgcccaacaaacagaggacagtggtacctgcaaggtgtggagttacagtccgagacagtctaaagaaagcactgatgatgagaggtctaatcccagagtgctgtgctgtttacagaattcaggatggagagaagaaaccaattggttgggacactgatatttcctggcttactggagaagaattgcatgtggaagtgttggagaatgttccacttacaacacacaactttgtacgaaaaacgtttttcaccttagcattttgtgacttttgtcgaaagctgcttttccagggtttccgctgtcaaacatgtggttataaatttcaccagcgttgtagtacagaagttccactgatgtgtgttaattatgaccaacttgatttgctgtttgtctccaagttctttgaacaccacccaataccacaggaagaggcgtccttagcagagactgccctaacatctggatcatccccttccgcacccgcctcggactctattgggccccaaattctcaccagtccgtctccttcaaaatccattccaattccacagcccttccgaccagcagatgaagatcatcgaaatcaatttgggcaacgagaccgatcctcatcagctcccaatgtgcatataaacacaatagaacctgtcaatattgatgacttgattagagaccaaggatttcgtggtgatggaggatcaaccacaggtttgtctgctaccccccctgcctcattacctggctcactaactaacgtgaaagccttacagaaatctccaggacctcagcgagaaaggaagtcatcttcatcctcagaagacaggaatcgaatgaaaacacttggtagacgggactcgagtgatgattgggagattcctgatgggcagattacagtgggacaaagaattggatctggatcatttggaacagtctacaagggaaagtggcatggtgatgtggcagtgaaaatgttgaatgtgacagcacctacacctcagcagttacaagccttcaaaaatgaagtaggagtactcaggaaaacacgacatgtgaatatcctactcttcatgggctattccacaaagccacaactggctattgttacccagtggtgtgagggctccagcttgtatcaccatctccatatcattgagaccaaatttgagatgatcaaacttatagatattgcacgacagactgcacagggcatggattacttacacgccaagtcaatcatccacagagacctcaagagtaataatatatttcttcatgaagacctcacagtaaaaataggtgattttggtctagctacagtgaaatctcgatggagtgggtcccatcagtttgaacagttgtctggatccattttgtggatggcaccagaagtcatcagaatgcaagataaaaatccatacagctttcagtcagatgtatatgcatttggaattgttctgtatgaattgatgactggacagttaccttattcaaacatcaacaacagggaccagataatttttatggtgggacgaggatacctgtctccagatctcagtaaggtacggagtaactgtccaaaagccatgaagagattaatggcagagtgcctcaaaaagaaaagagatgagagaccactctttccccaaattctcgcctctattgagctgctggcccgctcattgccaaaaattcaccgcagtgcatcagaaccctccttgaatcgggctggtttccaaacagaggattttagtctatatgcttgtgcttctccaaaaacacccatccaggcagggggatatggtgcgtttcctgtccactgaaacaaatgagtgagagagttcaggagagtagcaacaaaaggaaaataaatgaacatatgtttgcttatatgttaaattgaataaaatactctctttttttttaaggtgaaccaaagaacacttgtgtggttaaagactagatataatttttccccaaactaaaatttatacttaacattggatttttaacatccaagggttaaaatacatagacattgctaaaaattggcagagcctcttctagaggctttactttctgttccgggtttgtatcattcacttggttattttaagtagtaaacttcagtttctcatgcaacttttgttgccagctatcacatgtccactagggactccagaagaagaccctacctatgcctgtgtttgcaggtgagaagttggcagtcggttagcctgggttagataaggcaaactgaacagatctaatttaggaagtcagtagaatttaataattctattattattcttaataatttttctataactatttctttttataacaatttggaaaatgtggatgtcttttatttccttgaagcaataaactaagtttctttttataaaaa

SEQ ID NO: 10 - protein, 766 aa, Homo sapiens [sequence omitted]

SEQ ID NO: 11 - DNA, 5522 bp, Homo sapiens
aacttgacccgttagcagccgcagccatggcggcgcgttcgcctccctcaccgcacccttcgcccccagcgcgacagctgggccccaggtccccacgtgttgggcggggagctgaagtacacgcaatgcgcagcgaggcctcgggttttgccggcgcagcgcgggaggtggtcgcggacgaaagtgataaaatctgggtgggtgaagaagggtcagggggccggcgagggcctgggggggcagctccggctcatgctcccctcctcagcgcgcccatggggtccagacggctagagggcatctcggtagaggaggcgatggtgacccggacgcagctgctggaggaagagctgagcagcctaaaggaggagttggccctgtgtcaggctgataaagaatttgtatggtctttgtggaaacgtctccaggttacaaacccagatctcacacaagtggtcagtttggttgtggaaagagaaaaacagaaatctgaagctaaagacagaaaagttctagaaattctgcaagtcaaggatgccaaaatacaagaatttgaacagagagagtcagtactgaaacaggaaataaatgaccttgtaaaacggaaaattgcagtagatgaagaaaatgctttcttaaggaaagaattcagtgacttggagaagaaatttaaagataaaagtcaagaaattaaggacactaaggagtgtgtacagaacaaagaagagcaaaacagactagttataaaaaatctggaggaggaaaacaagaaattaagtacccgctgcactgacctgctaaatgacctggagaaattgaggaagcaggaagcacatttgagaaaagaaaaatatagcactgatgcaaaaataaagacctttgaagacaatttaattgaagcaaggaaagaagttgaagtatcacagagtaaatacaatgctctatcattacagttgagtaataaacagactgaacttatccagaaggatatggatattaccctggtcaggaaggaactgcaggagctgcagaatctttacaaacagaacagtacacatacagcccagcaagcagagctgatccagcagcttcaggttctcaatatggacacacaaaaagtactgagaaatcaggaagatgttcacacagctgaaagtatatcatatcaaaaactttacaatgagttacatatttgttttgaaaccacaaaatcaaatgaagctatgctccggcaaagtgttactaatcttcaggatcagctattacaaaaagagcaagaaaatgctaagttaaaagaaaaacttcaggaatcacagggagcacctcttcctttacctcaagaaagtgatccagactactcagcacaggtacctcatcgcccatccttatcaagcttagaaacgttaatggtttcacagaagtctgaaattgagtatttacaggagaaactaaagatagcaaatgaaaaactgtcagaaaacatatctgccaacaagggtttctcccgaaagagcatcatgacaagtgctgaaggaaaacataaggaaccacctgtgaaacgttcaaggtctttgtccccaaagagctctttcacagactcagaagagctacagaagctgagaaaagctgaaagaaagattgaaaacttagagaaggcactacaactaaagagccaagaaaatgatgagctaagagatgcccatgaaaaacgcaaggaacggctacagatgttacagaccaactacagagcagtaaaagagcaattaaaacagtgggaagaaggcagtggcatgactgaaatcaggaaaataaagagagcagatccccaacaacttcgacaagaagattctgacgctgtgtggaatgaactggcatatttcaaaagggaaaaccaggagctaatgattcaaaagatgaatcttgaagaagaattagatgaacttaaagtacatatatctattgataaggcagcaatacaagaattgaatagatgtgtggcagagagaagagaagaacagctctttagatctggtgaagatgatgaggtcaagaggagtactccagagaagaatggaaaagaaatgttggagcagacattacagaaggtcactgagttggaaaatcggctgaaatcttttgagaaaaggtcgagaaaattaaaagaagggaataaaaaattaatgaaagaaaatgattttctgaaatccctcttaaaacagcaacaagaagatacagagaccagagaaaaagagctagaacagataataaaggggagtaaagatgtagaaaaagaaaatactgaacttcaagtaaaaatcagtgagctggagacagaagtcacttccctgaggagacaagtggcagaagctaatgcattgagaaatgaaaatgaagagctgatcaacccaatggagaaatcacaccagtcagcagacagagctaaatccgagatggccaccatgaaagtgagatctggacgatatgattgtaagacaactatgaccaaggttaaatttaaagctgcgaagaaaaattgctctgtgggtcgtcaccacactgttctcaatcattccatcaaggttatgagcaatgtgtttgagaacctcagcaaggacggctgggaggatgtgagtgaaagcagcagtgattctgaagcacagacctctcaaactttgggaacaattattgtagaaacatcccagaaaataagtcctacggaagatggaaaagaccagaaagaaagtgatccaacagaagacagccaaacacaaggaaaagaaatagtacagacatatttaaatatagatggcaagaccccaaaggactattttcatgataagaatgccaaaaaaccaacttttcaaaagaagaattgcaagatgcaaaagagttcacatacagcagttcctactagagtcaacagagaaaagtacaaaaatataactgcccagaaatcaagtagcaatattattttattacgagaacggattatatccttgcaacaacaaaacagtgtacttcagaatgccaagaaaacagcagaattgtctgttaaagaatataaagaagttaatgaaaagctcctccatcaacagcaagtatccgatcaacgatttcagacaagcaggcagacaataaagaagctaaatttggatttggctgggcttcggaaagaaaaagaagatttactaaagaaattggagtcctcatctgaaatcacaagtttggcagaagaaaattcccaggtaacatttccacggatacaagttacatcacttagtccttcaaggagcatggatttggaaatgaagcaattgcagtataaactaaagaatgctactaatgaactcactaaacagtcatcaaatgtgaagactttgaaatttgaactcctagcaaaagaagaacacataaaggaaatgcatgaaaagatatctcgaatggagagggatataactatgaaaagacatttgatagaggacttgaaatttcgacagaaagtaaatttggaaagtaacaagagttttagtgaaatgttacaaaatcttgataaaaaggtaaagacattaactgaagaatgttccaacaagaaggtatcaattgattcactaaagcaaagacttaacgttgctgtaaaagaaaagtcacagtatgaacagatgtatcagaaatctaaagaggagttagaaaaaaaggatctcaagcttactctcctagtatcaagaataagtgagactgaatctgcaatggcagaaattgaaacagcagcatctaagcagcttcaagaattagcattgcaaagtgaacaggtcctagaaggtgcacagaagacattgctgttagccaatgaaaaagtagaagagttcaccacatttgtgaaggctttggccaaagagttgcaaaatgatgtccatgtggtaaggcgacaaataagagagcttaaaaaaatgaagaaaaacagggacgcctgtaaaacctcaacccataaagcccagaccttggcagcttctatcctgaacatttcacggtcagatttagaggaaatattagacacagaagatcaagtggaaattgaaaaaacaaaaattgatgctgaaaatgacaaggaatggatgttgtacattcagaaacttcttgaaggacagcttccttttgcctcatatttactagaagcagtactggaaaaaataaatgaaaaaaagaaactagttgaaggatatttcacaattatgaaagatattagatgatattaaaatggagagctttattgcaaatgtgaaaactttttatgtggtgtgattggaatacatgcattgcaatcctgacacggtatctgctccaactatcaatagtcaggttcaataccaaaataagaagtctctgaaaataattaattgctgaacaagtgaaactaattaagtacatagccatttaaaaggaaatagtgtagcatctgatggtcgaatacaaatattgccacaaatcagtgcaaacttaaaaatgattttccttctagtgcattaaaagaaactgagcaggcttggtacacacaaattggcctgagcataagaagaaaaagtatcaactaaggatttaatgttttacgtttcatgaagaaactagactttttacataaaactgctatagatggccataagtggtccagggagcaacagatttgtagtatgagcaaatataaaatgaagcatcataacttgagcatttattgaaataaattgtgtggtccaattgaatctgttctcattgatgtgctggtttatgtaggagatactgtgtatttctacaactctttggcaaaaacaaaaacattttcttcttctctctcttaacttcacaatactatacgttgtgtagtcatataaatttgcagggaaccacaaacccaatgtataaaattaggctctatttaacagaactactactgtggtcagctaatttaagttacattcttaaccatgatgtcatccttatttagattcctggacattcccacctcatttcacctcttcaccgtgttcctgccataccctttttggttcctctaattcaccatactggtgcctgcctcccacatttgcccttggtcttctctctttctagaatactctgcactcaactttcctcatggctggctccttgtcatcattcagctccaccttccccggtccctcagagacacattctctgaccagcttactattttatttcctcatagcacaaaattatctatctgttcatgtatttgttttcttgtttattttcttcttttccctctttagtatgtaggtcccatgagattaaggcaagggttggcagattatagcctgcagggcgaatctggcctgccacctgttttgtatggcccacaagctaagaatggtttttgccttattaaatggtttttaaaaaatcaaaaggagaataatattttgtagcatgtgaaaattatataaaattcaaattttggtgtctgttaataaagttttattggaaaaaaaaaa

SEQ ID NO: 12 - protein, 1406 aa, Homo sapiens
MAARSPPSPHPSPPARQLGPRSPRVGRGAEVHAMRSEASGFAGAAREVVADESDKIWVGEEGSGGRRGPGGAAPAHAPLLSAPMGSRRLEGISVEEAMVTRTQLLEEELSSLKEELALCQADKEFVWSLWKRLQVTNPDLTQVVSLVVEREKQKSEAKDRKVLEILQVKDAKIQEFEQRESVLKQEINDLVKRKIAVDEENAFLRKEFSDLEKKFKDKSQEIKDTKECVQNKEEQNRLVIKNLEEENKKLSTRCTDLLNDLEKLRKQEAHLRKEKYSTDAKIKTFEDNLIEARKEVEVSQSKYNALSLQLSNKQTELIQKDMDITLVRKELQELQNLYKQNSTHTAQQAELIQQLQVLNMDTQKVLRNQEDVHTAESISYQKLYNELHICFETTKSNEAMLRQSVTNLQDQLLQKEQENAKLKEKLQESQGAPLPLPQESDPDYSAQVPHRPSLSSLETLMVSQKSEIEYLQEKLKIANEKLSENISANKGFSRKSIMTSAEGKHKEPPVKRSRSLSPKSSFTDSEELQKLRKAERKIENLEKALQLKSQENDELRDAHEKRKERLQMLQTNYRAVKEQLKQWEEGSGMTEIRKIKRADPQQLRQEDSDAVWNELAYFKRENQELMIQKMNLEEELDELKVHISIDKAAIQELNRCVAERREEQLFRSGEDDEVKRSTPEKNGKEMLEQTLQKVTELENRLKSFEKRSRKLKEGNKKLMKENDFLKSLLKQQQEDTETREKELEQIIKGSKDVEKENTELQVKISELETEVTSLRRQVAEANALRNENEELINPMEKSHQSADRAKSEMATMKVRSGRYDCKTTMTKVKFKAAKKNCSVGRHHTVLNHSIKVMSNVFENLSKDGWEDVSESSSDSEAQTSQTLGTIIVETSQKISPTEDGKDQKESDPTEDSQTQGKEIVQTYLNIDGKTPKDYFHDKNAKKPTFQKKNCKMQKSSHTAVPTRVNREKYKNITAQKSSSNIILLRERIISLQQQNSVLQNAKKTAELSVKEYKEVNEKLLHQQQVSDQRFQTSRQTIKKLNLDLAGLRKEKEDLLKKLESSSEITSLAEENSQVTFPRIQVTSLSPSRSMDLEMKQLQYKLKNATNELTKQSSNVKTLKFELLAKEEHIKEMHEKISRMERDITMKRHLIEDLKFRQKVNLESNKSFSEMLQNLDKKVKTLTEECSNKKVSIDSLKQRLNVAVKEKSQYEQMYQKSKEELEKKDLKLTLLVSRISETESAMAEIETAASKQLQELALQSEQVLEGAQKTLLLANEKVEEFTTFVKALAKELQNDVHVVRRQIRELKKMKKNRDACKTSTHKAQTLAASILNISRSDLEEILDTEDQVEIEKTKIDAENDKEWMLYIQKLLEGQLPFASYLLEAVLEKINEKKKLVEGYFTIMKDIR

SEQ ID NO: 13 - DNA, 3291 bp, Homo sapiens
agaatcggagagccggtggcgtcgcaggtcgggaggacgagcaccgagtcgagggctcgctcgtctgggccgcccgagagtcttaatcgcgggcgcttgggccgccatcttagatggcgggagtaagaggaaaacgattgtgaggcgggaacggctttctgctgccttttttgggccccgaaaagggtcagctggccgggctttggggcgcgtgccctgaggcgcggagcgcgtttgctacgatgcgggggctgctcggggctccgtcccctgggctggggacgcgccgaatgtgaccgcctcccgctccctcacccgccgcggggaggaggagcgggcgagaagctgccgccgaacgacaggacgttggggcggcctggctccctcaggtttaagaattgtttaagctgcatcaatggagcacatacagggagcttggaagacgatcagcaatggttttggattcaaagatgccgtgtttgatggctccagctgcatctctcctacaatagttcagcagtttggctatcagcgccgggcatcagatgatggcaaactcacagatccttctaagacaagcaacactatccgtgttttcttgccgaacaagcaaagaacagtggtcaatgtgcgaaatggaatgagcttgcatgactgccttatgaaagcactcaaggtgaggggcctgcaaccagagtgctgtgcagtgttcagacttctccacgaacacaaaggtaaaaaagcacgcttagattggaatactgatgctgcgtctttgattggagaagaacttcaagtagatttcctggatcatgttcccctcacaacacacaactttgctcggaagacgttcctgaagcttgccttctgtgacatctgtcagaaattcctgctcaatggatttcgatgtcagacttgtggctacaaatttcatgagcactgtagcaccaaagtacctactatgtgtgtggactggagtaacatcagacaactcttattgtttccaaattccactattggtgatagtggagtcccagcactaccttctttgactatgcgtcgtatgcgagagtctgtttccaggatgcctgttagttctcagcacagatattctacacctcacgccttcacctttaacacctccagtccctcatctgaaggttccctctcccagaggcagaggtcgacatccacacctaatgtccacatggtcagcaccaccctgcctgtggacagcaggatgattgaggatgcaattcgaagtcacagcgaatcagcctcaccttcagccctgtccagtagccccaacaatctgagcccaacaggctggtcacagccgaaaacccccgtgccagcacaaagagagcgggcaccagtatctgggacccaggagaaaaacaaaattaggcctcgtggacagagagattcaagctattattgggaaatagaagccagtgaagtgatgctgtccactcggattgggtcaggctcttttggaactgtttataagggtaaatggcacggagatgttgcagtaaagatcctaaaggttgtcgacccaaccccagagcaattccaggccttcaggaatgaggtggctgttctgcgcaaaacacggcatgtgaacattctgcttttcatggggtacatgacaaaggacaacctggcaattgtgacccagtggtgcgagggcagcagcctctacaaacacctgcatgtccaggagaccaagtttcagatgttccagctaattgacattgcccggcagacggctcagggaatggactatttgcatgcaaagaacatcatccatagagacatgaaatccaacaatatatttctccatgaaggcttaacagtgaaaattggagattttggtttggcaacagtaaagtcacgctggagtggttctcagcaggttgaacaacctactggctctgtcctctggatggccccagaggtgatccgaatgcaggataacaacccattcagtttccagtcggatgtctactcctatggcatcgtattgtatgaactgatgacgggggagcttccttattctcacatcaacaaccgagatcagatcatcttcatggtgggccgaggatatgcctccccagatcttagtaagctatataagaactgccccaaagcaatgaagaggctggtagctgactgtgtgaagaaagtaaaggaagagaggcctctttttccccagatcctgtcttccattgagctgctccaacactctctaccgaagatcaaccggagcgcttccgagccatccttgcatcgggcagcccacactgaggatatcaatgcttgcacgctgaccacgtccccgaggctgcctgtcttctagttgactttgcacctgtcttcaggctgccaggggaggaggagaagccagcaggcaccacttttctgctccctttctccagaggcagaacacatgttttcagagaagctgctgctaaggaccttctagactgctcacagggccttaacttcatgttgccttcttttctatccctttgggccctgggagaaggaagccatttgcagtgctggtgtgtcctgctccctccccacattccccatgctcaaggcccagccttctgtagatgcgcaagtggatgttgatggtagtacaaaaagcaggggcccagccccagctgttggctacatgagtatttagaggaagtaaggtagcaggcagtccagccctgatgtggagacacatgggattttggaaatcagcttctggaggaatgcatgtcacaggcgggactttcttcagagagtggtgcagcgccagacattttgcacataaggcaccaaacagcccaggactgccgagactctggccgcccgaaggagcctgctttggtactatggaacttttcttaggggacacgtcctcctttcacagcttctaaggtgtccagtgcattgggatggttttccaggcaaggcactcggccaatccgcatctcagccctctcagggagcagtcttccatcatgctgaattttgtcttccaggagctgcccctatggggcggggccgcagggccagccttgtttctctaacaaacaaacaaacaaacagccttgtttctctagtcacatcatgtgtatacaaggaagccaggaatacaggttttcttgatgatttgggttttaattttgtttttattgcacctgacaaaatacagttatctgatggtccctcaattatgttattttaataaaataaattaaatttaggtgtaaaaaaaaaaaaaaaaaa

SEQ ID NO: 14 - protein, 648 aa, Homo sapiens [sequence omitted]

SEQ ID NO: 15 - DNA, 8339 bp, Homo sapiens
ctgcggctggggctgggggcggcggcggcggcgacgcgggcggcgggcggcgcggggcggtccggcgggttcaaagaggaaaacatggcggaaaacaaaggcggcggcgaggctgagagcggcggcgggggcagcggcagcgcgccggtaactgccggggccgccgggcccgccgcgcaggaggcggagccgcctctcaccgcggtgctggtggaggaggaggaggaggaaggcggcagggccggcgctgagggcggcgcggccgggcccgacgacgggggggtggccgcggcctcctcgggctcggcccaggctgcttcatctcctgcggcctcagtgggcactggagttgccgggggcgcagtatcgacgccggctccagctccagcctcggctcccgctccgggtccctcggcagggccgcctcctggaccgccagcctcgctcctggacacctgcgccgtgtgtcagcagagcttgcagagccggcgtgaggcggagcccaagctgctgccctgtcttcactccttctgcctgcgctgcctgcccgagccggagcgccagctcagcgtgcccatcccggggggcagcaacggcgacatccagcaagttggtgtaatacggtgcccagtatgccgccaagaatgcagacagatagaccttgtggataattattttgtgaaagacacatctgaagctcctagcagttctgatgaaaaatcagaacaggtatgtactagttgtgaagacaatgcaagtgcagttggcttttgtgtagaatgtggagagtggctatgtaagacatgtatcgaagcacatcaaagagtaaaatttactaaagatcacttgatcaggaagaaagaagatgtctcagagtctgttggagcatctggtcaacgccctgttttctgccctgtacacaaacaagaacagttgaaacttttctgtgaaacatgtgatagattgacatgtagagactgtcagctattggaacacaaagaacataggtatcagtttttggaagaagcttttcaaaatcagaagggtgcaattgagaatctactggcgaaacttcttgagaagaagaattatgttcattttgcagctactcaggtgcagaataggataaaagaagtaaatgagactaacaaacgagtagaacaggaaattaaagtggccattttcacccttatcaatgaaattaataagaaaggaaaatctctcttacaacagctagagaatgttacaaaggaaagacagatgaagttactacagcagcagaatgacatcacaggcctttcccggcaggtgaagcatgttatgaacttcacaaattgggcaattgcaagtggcagcagcacagcactactatacagcaagcgactgattactttccagttgcgtcatattttgaaagcacggtgtgatcctgtccctgctgctaatggagcaatacgtttccattgtgatcccaccttctgggcaaagaatgtagtcaatttaggtaatctagtaatagagagtaaaccagctcctggttatactcctaatgttgtagttgggcaagttcctccagggacaaaccacattagtaaaacccctggacagattaacttagcacagcttcgactccagcacatgcaacaacaagtatatgcacagaaacatcagcagttgcaacagatgaggatgcagcaaccaccagcacctgtaccaactacaacaacaacaacacaacagcatcctagacaagcagcccctcagatgttacaacaacagcctcctcgattgatcagtgtgcaaacaatgcaaagaggcaacatgaactgtggagcttttcaagcccatcagatgagactggctcagaatgctgccagaataccagggatacccaggcacagcggccctcaatattccatgatgcagccacacctccaaagacaacactcaaacccagggcatgctggaccctttcccgtagtatcggtacacaacaccacaatcaacccaacgagccctactacagcaactatggcaaatgcaaaccgaggtcccaccagcccatctgttacagcaatagagctaatcccctcagttaccaatccagaaaaccttccatcgctgccagatattccacccatacagttggaagatgctggctcaagtagtttagataatctactaagtagatacatctcaggcagtcacctacccccacagcctacaagcaccatgaatccttctccaggtccctctgccctttctccgggatcatcaggtttatccaattctcacacacctgtgagacccccaagtacttctagtactggcagtcgaggcagctgtgggtcatcaggaagaactgctgagaagacaagtcttagtttcaaatctgatcaggtgaaggtcaagcaagaacctgggactgaagatgaaatatgtagcttttcaggaggtgtaaaacaagaaaaaacagaggatggcaggaggagtgcttgcatgttgagcagtcctgagagtagcttgacaccacctctctcaaccaacctgcatctagaaagtgaattggatgcattggcaagcctggaaaaccatgtgaaaattgaacctgcagatatgaatgaaagctgcaaacagtcagggctcagcagccttgttaatggaaagtccccaattcgaagcctcatgcacaggtcggcaaggattggaggagatggcaacaataaagatgatgacccaaatgaagactggtgtgctgtctgccaaaacggaggagatctcttgtgctgcgaaaaatgtccaaaggtctttcatctaacttgtcatgttccaacactacttagctttccaagtggggactggatatgcacattttgtagagatattggaaagccagaagttgaatatgattgtgataatttgcaacatagtaagaaggggaaaactgcgcaggggttaagccccgtggaccaaaggaaatgtgaacgtcttctgctttacctctattgccatgaattaagtattgaattccaggagcctgttcctgcttcgataccaaactactataaaattataaagaaaccaatggatttatccaccgtgaaaaagaagcttcagaaaaaacattcccaacactaccaaatcccggatgactttgtggccgatgtccgtttgatcttcaagaactgtgaaaggtttaatgaaatgatgaaagttgttcaagtttatgcagacacacaagagattaatttgaaggctgattcagaagtagctcaggcagggaaagcagttgcattgtactttgaagataaactcacagagatctactcagacaggaccttcgcacctttgccagagtttgagcaggaagaggatgatggtgaggtaactgaggactctgatgaagactttatacagccccgcagaaaacgcctaaagtcagatgagagaccagtacatataaagtaaaatgacatggatttaaatcaattgtttaaaaaaaaaaaaacgaaaaaaaaaaaaaaaacacaaaaaacccagaaaacttttaagtgttgctggaatatcctgcctacagtgggcacctccttgaagaagctgatagcttttacacagtattagattgaaataatggacagaaacacattcttgtcaagaaagggggagagaagtctgtttgcaagtttcaaagcaaaaagcaaaagtgaaatgatttgaggatttctgttctaatggagatgattctctgattgttagaaatggcaaatattgatgattgtgtgctattgattggtgcaggatacttggtatacgagtaaatacttgagactcgtgtcacttgataaattttctttttggactaggtcgcacagttattaaaacaacttttaaccctcccccttcacacacatacatatcaggttgttttctagttaaaaacccaagtagctcagattctactttaatgtcagtgcagatttgcattgaatcatgccattatgttttttctcatttttatgctgttgggtcttagtttttaaattgatataaagaactcagcaatggttttattttctactcatacttagggtttaggaaacactaccactagttatcatttaatcaacttcaatggtctactgaaacaaaaatggtaacttttcattagtggattatttagagttatagtagttgtttccagaaaacacttcctcacaattgtacttcccaatcaaatcatgtgatcatacagttattcccatgaaaggcagaatgtttgtttcaaaattaatctagttttctgtacatttaaatttgagaaggtgacaactggctcttttccagtcttccttcatgtcagttttctgatagaccactattggcaaacagtatctgtcaactaccaaatgtgtaaaattttctgtatttcactttgtcttatttgtaaatagtgaactaaaacttttggcagatcagcaacatttgctgagcctgttttttaagctaatgtgtattcttactaatgttcctatcaagaatggatttgtaatatatgctgtctatttctaatgttcacattcatattttgaggttctatcttattttaatagagaacagacttctcaaaaaatcttcagaagcagcttattattgaaatatcgaaatattgaaataaacccggtggggttagattactcatctgtccaccaagtgggacatttgcatggactgggggcttaaaggacttagaagagacctgtaagtaaatcctgaaaatgagccaatccccacttgaatggttactggagtaaacccacctttaccaccccaattacagcacccgaggccgataaaccaacttggctctggttcatttttcttttcttcatttgtgatgctcagattcaaaatgtgtgttctacactgttacaggcttctcttttgtttgattaaagattttagtcctacttttgtatggacacattagaatattcagagaccaaaatagaagaatttgctgttagatatttttcagaagtcagcagatttgtggcaaatcatttatttgcctttttaaaaattcatttaagcagttcagagagtagactactcagaaaattatttcacgtaattgtctaagaggtcaatattttttaatgcatattgaatcaaataaagtgctctaaagaaattattatacaaattcctttgggttgtttttcttttcttaacaaggggtgggggtaaacaggaatatgattcaggctttctggttgtgtatttaaagagtattgattttattattactattgatttactttattcctggcttccttttcacttttctttcaatttttaaaaaataatttaagccgttgaaaatataccaaactgttgaaacattttactcaaattttaaattcctaaaaatgttttttaataagagggagaaaattatttaaaaatacttatgcctatgccaatttccctcttttttcacaaaatccatgatttcagtttgtaagtagacatatatctaagggcacatttttggaaagtgaggaatagcagcagtataacttcattttgtcaggcctttgagttctaatattttgtattgctcttcaaatggatccttttaaaaaaattgtagataatgagtcataaatagattctgccaactgaggggagaaacattttaagtaaatatttttcagtatttggggccttaaaaaataattgtgtttccttaaaattacatgttagatagagtttttaggtttttttggttttaagattggttaaagcaatttaaaagccacttttttgtcaacatttaatagcctccacttctgttaagataatgtatactgctgaggaattactattaatagctatcaacataccaccattaaattaaggtattcactttagattttttattaaagcttttttcttgcacactgatcgttgtgtttctaagctgattttttcagctctaatatacctatggttaaaaagtataaaaacttaaattgatatttagatatatgttttcctattagtttatgttttaaaaagacaaaattgtatctgtcagtccctgaaggcagtttgtttttatactctctcacatttgtatttgttttttaaatggcagtattttagaagatttggagaaaagtccacataataatgttttcttaaaagcttttaaagtttttgctgtacttcaatttacttcttccatcagaaaactaagaacaaagtgttgctcagtctgttccgctgacctaaatttgtgttttcagcacttggctcagccaattcactgagtgaaggaattgctttatgaggcaaagcatgtgaaagttctaaagtatggttagattgtaggtcgtgctctatatggaaacatcaaaccattactacagagaaatgataaggcattggatccactattgaaattattatttttggatcaacaagttggtactttctgacttctgtatcttaacataagggaattttaggtaatgctaagtcagttgtctcattttttgtgataagttttggaatttttagttaattgaaataaataatgcttttaaatagaagtaaaaggtttataagtgtgcaaattgtagatttatcaattacctcagcaggtatcctgccatgtaattattagtgattagtgttaataagataatagattcaggtcttccaactatgcccttggattgtggcctactgtatgttattaaatggtctcttactatccaaaatgggagtagatgctgtggccccgtctcccttggcttttacgtcccatatccacccccattcatgtacaacatgtgaaatataaaaatctcatttcttgtcaaaatcagcactgcttatttgcatactcagcatcggatcagtgagtagttttataaaaaatccacgcacccaactcccttagttaaaacagattcttaattcataccatgaattcttaatttctgtaccatctatgttaatgatctgctgaaggtgactcaagattttcaaggtgtaatacagtttgatcatgtaccggacctggatatttaattttttttccctcacagttaatctcctccttgataaagcaataacactgctttgagtctgttgcctaatagcatgtcagaatcctctcctggatggtgattttataggaaagtttgtatgcatatcacccagtctatcttttaaaaattaagaaatttaaatgtatgctggaagtaatgacactatattgtggcattttattttaaaaattggggaaagttgcatatttttttaaaagtaagtgtttgagtaaaaaaattgaaggtacttttttaaggaaaaaaatttatatgccacagtttacatagacatttcagattcaacacgtactcttgaatataatggtttcttttacttggtcaaaatgcatgtatagcatttctttcatcttagttccttgtgtttgcctatgtggtcctttatatattttttattgtatcgaagaaacaaaactatcttcaaaaataagttaatttggatatatttgtcatatcaaactacaaagtgtacaaagttaagtttagcccttttctagaaagtgatctttaaaattaaaaatgctcctcttttaaattcaccaaatttatgtgtgggaaggcaccaaaatgattttgtaagtgccactgcaatattccctttcaagtgtggcctaaatttcaatcttaaggatggaatgcatgtctgctccttgttctgaaaaatgtaggcatctactacattttaaaacacagtgaaacatatacataagcctataaaaaaagatttgtgcaatttgaaagcctgttaattttttatgtagacatacctacacacgaaagggttaaattcacagccttactagttccttgcttccagtatttcaattggtctcctcccctcattattattattactactagtactattatttttgcacatagttaactgcccttcaatatgattcttaaaaagtgctgtttctgtggtatcgtattctctaaataatcatatttaattttttaaaacaaggttgcagtttctaattgtttcgttcctgtgtttttgctggtgtgtaataaaagcaagttttttcttttcatggttatttaatacattagctgcctgtaaataattcttgttataatgctctggaatgtgttgtagaagttgtattagattagttttaaacccttgtttgaaagccacattgttttggttatttctattaaattagaaaattgaaaaagttttcaaatgaa

SEQ ID NO: 16 - protein, 1127 aa, Homo sapiens
MAENKGGGEAESGGGGSGSAPVTAGAAGPAAQEAEPPLTAVLVEEEEEEGGRAGAEGGAAGPDDGGVAAASSGSAQAASSPAASVGTGVAGGAVSTPAPAPASAPAPGPSAGPPPGPPASLLDTCAVCQQSLQSRREAEPKLLPCLHSFCLRCLPEPERQLSVPIPGGSNGDIQQVGVIRCPVCRQECRQIDLVDNYFVKDTSEAPSSSDEKSEQVCTSCEDNASAVGFCVECGEWLCKTCIEAHQRVKFTKDHLIRKKEDVSESVGASGQRPVFCPVHKQEQLKLFCETCDRLTCRDCQLLEHKEHRYQFLEEAFQNQKGAIENLLAKLLEKKNYVHFAATQVQNRIKEVNETNKRVEQEIKVAIFTLINEINKKGKSLLQQLENVTKERQMKLLQQQNDITGLSRQVKHVMNFTNWAIASGSSTALLYSKRLITFQLRHILKARCDPVPAANGAIRFHCDPTFWAKNVVNLGNLVIESKPAPGYTPNVVVGQVPPGTNHISKTPGQINLAQLRLQHMQQQVYAQKHQQLQQMRMQQPPAPVPTTTTTTQQHPRQAAPQMLQQQPPRLISVQTMQRGNMNCGAFQAHQMRLAQNAARIPGIPRHSGPQYSMMQPHLQRQHSNPGHAGPFPVVSVHNTTINPTSPTTATMANANRGPTSPSVTAIELIPSVTNPENLPSLPDIPPIQLEDAGSSSLDNLLSRYISGSHLPPQPTSTMNPSPGPSALSPGSSGLSNSHTPVRPPSTSSTGSRGSCGSSGRTAEKTSLSFKSDQVKVKQEPGTEDEICSFSGGVKQEKTEDGRRSACMLSSPESSLTPPLSTNLHLESELDALASLENHVKIEPADMNESCKQSGLSSLVNGKSPIRSLMHRSARIGGDGNNKDDDPNEDWCAVCQNGGDLLCCEKCPKVFHLTCHVPTLLSFPSGDWICTFCRDIGKPEVEYDCDNLQHSKKGKTAQGLSPVDQRKCERLLLYLYCHELSIEFQEPVPASIPNYYKIIKKPMDLSTVKKKLQKKHSQHYQIPDDFVADVRLIFKNCERFNEMMKVVQVYADTQEINLKADSEVAQAGKAVALYFEDKLTEIYSDRTFAPLPEFEQEEDDGEVTEDSDEDFIQPRRKRLKSDERPVHIK

SEQ ID NO: 17 - DNA, 4161 bp, Homo sapiens
gcgcgcgggcggcgtagccggcctgtctgggccgcctcgtggggagggagggggcgcccggccgcccggcggcgaccccggggcctggccgccaccatgggcttcgagctggaccgcttcgacggcgacgtggacccggacctgaagtgcgcgctgtgccacaaggtcctggaggacccgctgaccacgccgtgcggccacgtcttctgcgccggctgcgtgctgccctgggtggtgcaggagggcagctgcccggcgcgctgccgcggtcgcctgtcggccaaagagctcaaccacgtcctgccgctcaagcgccttatcctcaagctggacatcaagtgcgcgtacgcgacgcgcggctgcggccgggtggtcaagctgcagcagctgccggagcacctcgagcgctgcgacttcgcgcccgcgcgctgtcgccacgcgggttgcggccaggtgctgctgcggcgcgacgtggaggcgcacatgcgcgacgcgtgcgacgcgcggccagtgggccgctgccaggagggctgcgggctacccttgacgcacggcgagcagcgcgcgggcggccactgctgcgcgcgagcgctgcgggcgcacaacggcgcgctccaggcccgcctgggcgcgctgcacaaggcgctcaagaaggaggcgctgcgcgctgggaagcgcgagaagtcgctggtggcccagctggccgcggcgcagcttgagctgcagatgaccgcgctgcgctaccagaagaaattcaccgaatacagcgcgcgcctcgactcgctcagccgctgcgtggccgcgccgcccggcggcaagggcgaagaaaccaaaagtctgactcttgtcctgcatcgggactccggctccctgggattcaatattattggtggccggccgagtgtggataaccacgatggatcatccagtgaaggaatctttgtatccaagatagttgacagtgggcctgcagccaaggaaggaggcctgcaaattcatgacaggattattgaggtcaacggcagagacttatccagagcaactcatgaccaggctgtggaagctttcaagacagccaaggagcccatagtggtgcaggtgttgagaagaacaccaaggaccaaaatgttcacgcctccatcagagtctcagctggtggacacgggaacccaaaccgacatcacctttgaacatatcatggccctcactaagatgtcctctcccagcccacccgtgctggatccctatctcttgccagaggagcatccctcagcccatgaatactacgatccaaatgactacattggagacatccatcaggagatggacagggaggagctggagctggaggaagtggacctctacagaatgaacagccaggacaagctgggcctcactgtgtgctaccggacggacgatgaagacgacattgggatttatatcagtgagattgaccctaacagcattgcagccaaggatgggcgcatccgagaaggagaccgcattatccagattaatgggatagaggtgcagaaccgtgaagaggctgtggctcttctaaccagtgaagaaaataaaaacttttcattgctgattgcaaggcctgaactccagctggatgagggctggatggatgatgacaggaacgactttctggatgacctgcacatggacatgctggaggagcagcaccaccaggccatgcaattcacagctagcgtgctgcagcagaagaagcacgacgaagacggtgggaccacagatacagccaccatcttgtccaaccagcacgagaaggacagcggtgtggggcggaccgacgagagcacccgtaatgacgagagctcggagcaagagaacaatggcgacgacgccaccgcatcctccaacccgctggcggggcagaggaagctcacctgcagccaggacaccttgggcagcggcgacctgcccttcagcaacgagtctttcatttcggccgactgcacggacgccgactacctggggatcccggtggacgagtgcgagcgcttccgcgagctcctggagctcaagtgccaggtgaagagcgccaccccttacggcctgtactaccctagcggccccctggacgccggcaagagtgaccctgagagcgtggacaaggagctggagctgctgaacgaagagctgcgcagcatcgagctggagtgcctgagcatcgtgcgcgcccacaagatgcagcagctcaaggagcagtaccgcgagtcctggatgctgcacaacagcggcttccgcaactacaacaccagcatcgacgtgcgcagacacgagctctcagatatcaccgagctcccggagaaatccgacaaggacagctcgagcgcctacaacacaggcgagagctgccgcagcaccccgctcaccctggagatctcccccgacaactccttgaggagagcggcggagggcatcagctgcccgagcagcgaaggggctgtggggaccacggaagcctacgggccagcctccaagaatctgctctccatcacggaagatcccgaagtgggcacccctacctatagcccgtccctgaaggagctggaccccaaccagcccctggaaagcaaagagcggagagccagcgacgggagccggagccccacgcccagccagaagctgggcagcgcctacctgccctcctatcaccactccccatacaagcacgcgcacatcccggcgcacgcccagcactaccagagctacatgcagctgatccagcagaagtcggccgtggagtacgcgcaaagccagatgagcctggtgagcatgtgcaaggacctgagctctcccaccccgtcggagccgcgcatggagtggaaggtgaagatccgcagcgacgggacgcgctacatcaccaagaggcccgtgcgggaccgcctgctgcgggagcgcgccctgaagatccgggaagagcgcagcggcatgaccaccgacgacgacgcggtgagcgagatgaagatggggcgctactggagcaaggaggagaggaagcagcacctggtgaaggccaaggagcagcggcggcggcgcgagttcatgatgcagagcaggttggattgtctcaaggagcagcaagcagccgatgacaggaaggagatgaacattctcgaactgagccacaaaaagatgatgaagaagaggaataagaaaatcttcgataactggatgacgatccaagaactcttaacccacggcacaaaatccccggacggcactagagtatacaattccttcctatcggtgactactgtataattttcacttctgcattatgtacataaaggagaccactaccactggggtagaaattcctgcctcgttcaatgcggcaagtttttgtatataagataagtacggtcttcatgtttatagtccaaatttgcaaaccctacaactctgggtgtcataggtctattttaagggaagagagagaaaaacacccttactatcttggaaggcaatattaacaaacagagcttttttcaaatagcaattgtacttttctacctgtacccttttacataaagtgtttaaatttcagaaagatcttttattaagcatactttcacagaataacttgtttaaactatattcatataaaaaagttaaacacgctttttttcctgcctaaaacacaaatacaactgccagtatgtatttttaatggaaccctattttataatggtacgttactgaatgtgtttcatatgcgtgaccgttaagatattatcatttaggtgaaggtttcaactcaaaaccacccaacccggtggttaacgatttaatacatataaccaaaccggcagcgtttagagttgggatatacatttaaacattttcctggttaaggttcccaagagagtgtaaaggttttagcagaaagcaaaatatcttgcatctttatggaagtttaaagcatgtttgcaaatattgcagcccattgaaagaatttgcatgtacaggaaagttgtggatggagacggtttgtggaattttaagtgctcattgtagtaaacttttgctttgtagatttgaaggtacagacttatacaggcaagttcacaaaatcatgattagttacaaacagtaaaatgaagttaaaataaattattattttct

SEQ ID NO: 18 - protein, 1066 aa, Homo sapiens
MGFELDRFDGDVDPDLKCALCHKVLEDPLTTPCGHVFCAGCVLPWVVQEGSCPARCRGRLSAKELNHVLPLKRLILKLDIKCAYATRGCGRVVKLQQLPEHLERCDFAPARCRHAGCGQVLLRRDVEAHMRDACDARPVGRCQEGCGLPLTHGEQRAGGHCCARALRAHNGALQARLGALHKALKKEALRAGKREKSLVAQLAAAQLELQMTALRYQKKFTEYSARLDSLSRCVAAPPGGKGEETKSLTLVLHRDSGSLGFNIIGGRPSVDNHDGSSSEGIFVSKIVDSGPAAKEGGLQIHDRIIEVNGRDLSRATHDQAVEAFKTAKEPIVVQVLRRTPRTKMFTPPSESQLVDTGTQTDITFEHIMALTKMSSPSPPVLDPYLLPEEHPSAHEYYDPNDYIGDIHQEMDREELELEEVDLYRMNSQDKLGLTVCYRTDDEDDIGIYISEIDPNSIAAKDGRIREGDRIIQINGIEVQNREEAVALLTSEENKNFSLLIARPELQLDEGWMDDDRNDFLDDLHMDMLEEQHHQAMQFTASVLQQKKHDEDGGTTDTATILSNQHEKDSGVGRTDESTRNDESSEQENNGDDATASSNPLAGQRKLTCSQDTLGSGDLPFSNESFISADCTDADYLGIPVDECERFRELLELKCQVKSATPYGLYYPSGPLDAGKSDPESVDKELELLNEELRSIELECLSIVRAHKMQQLKEQYRESWMLHNSGFRNYNTSIDVRRHELSDITELPEKSDKDSSSAYNTGESCRSTPLTLEISPDNSLRRAAEGISCPSSEGAVGTTEAYGPASKNLLSITEDPEVGTPTYSPSLKELDPNQPLESKERRASDGSRSPTPSQKLGSAYLPSYHHSPYKHAHIPAHAQHYQSYMQLIQQKSAVEYAQSQMSLVSMCKDLSSPTPSEPRMEWKVKIRSDGTRYITKRPVRDRLLRERALKIREERSGMTTDDDAVSEMKMGRYWSKEERKQHLVKAKEQRRRREFMMQSRLDCLKEQQAADDRKEMNILELSHKKMMKKRNKKIFDNWMTIQELLTHGTKSPDGTRVYNSFLSVTTV

SEQ ID NO: 19 - DNA, 3239 bp, Homo sapiens
aggaggacctattagagcctttgccccggcgtcggtgactcagtgttcgcgggagcgccgcacctacaccagccaacccagatcccgaggtccgacagcgcccggcccagatccccacgcctgccaggagcaagccgagagccagccggccggcgcactccgactccgagcagtctctgtccttcgacccgagccccgcgccctttccgggacccctgccccgcgggcagcgctgccaacctgccggccatggagaccccgtcccagcggcgcgccacccgcagcggggcgcaggccagctccactccgctgtcgcccacccgcatcacccggctgcaggagaaggaggacctgcaggagctcaatgatcgcttggcggtctacatcgaccgtgtgcgctcgctggaaacggagaacgcagggctgcgccttcgcatcaccgagtctgaagaggtggtcagccgcgaggtgtccggcatcaaggccgcctacgaggccgagctcggggatgcccgcaagacccttgactcagtagccaaggagcgcgcccgcctgcagctggagctgagcaaagtgcgtgaggagtttaaggagctgaaagcgcgcaataccaagaaggagggtgacctgatagctgctcaggctcggctgaaggacctggaggctctgctgaactccaaggaggccgcactgagcactgctctcagtgagaagcgcacgctggagggcgagctgcatgatctgcggggccaggtggccaagcttgaggcagccctaggtgaggccaagaagcaacttcaggatgagatgctgcggcgggtggatgctgagaacaggctgcagaccatgaaggaggaactggacttccagaagaacatctacagtgaggagctgcgtgagaccaagcgccgtcatgagacccgactggtggagattgacaatgggaagcagcgtgagtttgagagccggctggcggatgcgctgcaggaactgcgggcccagcatgaggaccaggtggagcagtataagaaggagctggagaagacttattctgccaagctggacaatgccaggcagtctgctgagaggaacagcaacctggtgggggctgcccacgaggagctgcagcagtcgcgcatccgcatcgacagcctctctgcccagctcagccagctccagaagcagctggcagccaaggaggcgaagcttcgagacctggaggactcactggcccgtgagcgggacaccagccggcggctgctggcggaaaaggagcgggagatggccgagatgcgggcaaggatgcagcagcagctggacgagtaccaggagcttctggacatcaagctggccctggacatggagatccacgcctaccgcaagctcttggagggcgaggaggagaggctacgcctgtcccccagccctacctcgcagcgcagccgtggccgtgcttcctctcactcatcccagacacagggtgggggcagcgtcaccaaaaagcgcaaactggagtccactgagagccgcagcagcttctcacagcacgcacgcactagcgggcgcgtggccgtggaggaggtggatgaggagggcaagtttgtccggctgcgcaacaagtccaatgaggaccagtccatgggcaattggcagatcaagcgccagaatggagatgatcccttgctgacttaccggttcccaccaaagttcaccctgaaggctgggcaggtggtgacgatctgggctgcaggagctggggccacccacagcccccctaccgacctggtgtggaaggcacagaacacctggggctgcgggaacagcctgcgtacggctctcatcaactccactggggaagaagtggccatgcgcaagctggtgcgctcagtgactgtggttgaggacgacgaggatgaggatggagatgacctgctccatcaccaccacggctcccactgcagcagctcgggggaccccgctgagtacaacctgcgctcgcgcaccgtgctgtgcgggacctgcgggcagcctgccgacaaggcatctgccagcggctcaggagcccaggtgggcggacccatctcctctggctcttctgcctccagtgtcacggtcactcgcagctaccgcagtgtggggggcagtgggggtggcagcttcggggacaatctggtcacccgctcctacctcctgggcaactccagcccccgaacccagagcccccagaactgcagcatcatgtaatctgggacctgccaggcaggggtgggggtggaggcttcctgcgtcctcctcacctcatgcccaccccctgccctgcacgtcatgggagggggcttgaagccaaagaaaaataaccctttggtttttttcttctgtatttttttttctaagagaagttattttctacagtggttttatactgaaggaaaaacacaagcaaaaaaaaaaaaaagcatctatctcatctatctcaatcctaatttctcctcccttccttttccctgcttccaggaaactccacatctgccttaaaaccaaagagggcttcctctagaagccaagggaaaggggtgcttttatagaggctagcttctgcttttctgccctggctgctgcccccaccccggggaccctgtgacatggtgcctgagaggcaggcatagaggcttctccgccagcctcctctggacggcaggctcactgccaggccagcctccgagagggagagagagagagagaggacagcttgagccgggcccctgggcttggcctgctgtgattccactacacctggctgaggttcctctgcctgccccgcccccagtccccacccctgcccccagccccggggtgagtccattctcccaggtaccagctgcgcttgcttttctgtattttatttagacaagagatgggaatgaggtgggaggtggaagaagggagaagaaaggtgagtttgagctgccttccctagctttagaccctgggtgggctctgtgcagtcactggaggttgaagccaagtggggtgctgggaggagggagagggaggtcactggaaaggggagagcctgctggcacccaccgtggaggaggaaggcaagagggggtggaggggtgtggcagtggttttggcaaacgctaaagagcccttgcctccccatttcccatctgcaccccttctctcctccccaaatcaatacactagttgtttctacccctggcaaaaaaaaaaaa

SEQ ID NO: 20 - protein, 664 aa, Homo sapiens
METPSQRRATRSGAQASSTPLSPTRITRLQEKEDLQELNDRLAVYIDRVRSLETENAGLRLRITESEEVVSREVSGIKAAYEAELGDARKTLDSVAKERARLQLELSKVREEFKELKARNTKKEGDLIAAQARLKDLEALLNSKEAALSTALSEKRTLEGELHDLRGQVAKLEAALGEAKKQLQDEMLRRVDAENRLQTMKEELDFQKNIYSEELRETKRRHETRLVEIDNGKQREFESRLADALQELRAQHEDQVEQYKKELEKTYSAKLDNARQSAERNSNLVGAAHEELQQSRIRIDSLSAQLSQLQKQLAAKEAKLRDLEDSLARERDTSRRLLAEKEREMAEMRARMQQQLDEYQELLDIKLALDMEIHAYRKLLEGEEERLRLSPSPTSQRSRGRASSHSSQTQGGGSVTKKRKLESTESRSSFSQHARTSGRVAVEEVDEEGKFVRLRNKSNEDQSMGNWQIKRQNGDDPLLTYRFPPKFTLKAGQVVTIWAAGAGATHSPPTDLVWKAQNTWGCGNSLRTALINSTGEEVAMRKLVRSVTVVEDDEDEDGDDLLHHHHGSHCSSSGDPAEYNLRSRTVLCGTCGQPADKASASGSGAQVGGPISSGSSASSVTVTRSYRSVGGSGGGSFGDNLVTRSYLLGNSSPRTQSPQNCSIM

SEQ ID NO: 21 - DNA, 2663 bp, Homo sapiens
tgcagctgggagcgcacagacggctgccccgcctgagcgaggcgggcgccgccgcgatgctgcgaggcggacggcgcgggcagcttggctggcacagctgggctgcggggccgggcagcctgctggcttggctgatactggcatctgcgggcgccgcaccctgccccgatgcctgctgcccccacggctcctcgggactgcgatgcacccgggatggggccctggatagcctccaccacctgcccggcgcagagaacctgactgagctctacatcgagaaccagcagcatctgcagcatctggagctccgtgatctgaggggcctgggggagctgagaaacctcaccatcgtgaagagtggtctccgtttcgtggcgccagatgccttccatttcactcctcggctcagtcgcctgaatctctccttcaacgctctggagtctctctcctggaaaactgtgcagggcctctccttacaggaactggtcctgtcggggaaccctctgcactgttcttgtgccctgcgctggctacagcgctgggaggaggagggactgggcggagtgcctgaacagaagctgcagtgtcatgggcaagggcccctggcccacatgcccaatgccagctgtggtgtgcccacgctgaaggtccaggtgcccaatgcctcggtggatgtgggggacgacgtgctgctgcggtgccaggtggaggggcggggcctggagcaggccggctggatcctcacagagctggagcagtcagccacggtgatgaaatctgggggtctgccatccctggggctgaccctggccaatgtcaccagtgacctcaacaggaagaacgtgacgtgctgggcagagaacgatgtgggccgggcagaggtctctgttcaggtcaacgtctccttcccggccagtgtgcagctgcacacggcggtggagatgcaccactggtgcatccccttctctgtggatgggcagccggcaccgtctctgcgctggctcttcaatggctccgtgctcaatgagaccagcttcatcttcactgagttcctggagccggcagccaatgagaccgtgcggcacgggtgtctgcgcctcaaccagcccacccacgtcaacaacggcaactacacgctgctggctgccaaccccttcggccaggcctccgcctccatcatggctgccttcatggacaaccctttcgagttcaaccccgaggaccccatccctgtctccttctcgccggtggacactaacagcacatctggagacccggtggagaagaaggacgaaacaccttttggggtctcggtggctgtgggcctggccgtctttgcctgcctcttcctttctacgctgctccttgtgctcaacaaatgtggacggagaaacaagtttgggatcaaccgcccggctgtgctggctccagaggatgggctggccatgtccctgcatttcatgacattgggtggcagctccctgtcccccaccgagggcaaaggctctgggctccaaggccacatcatcgagaacccacaatacttcagtgatgcctgtgttcaccacatcaagcgccgggacatcgtgctcaagtgggagctgggggagggcgcctttgggaaggtcttccttgctgagtgccacaacctcctgcctgagcaggacaagatgctggtggctgtcaaggcactgaaggaggcgtccgagagtgctcggcaggacttccagcgtgaggctgagctgctcaccatgctgcagcaccagcacatcgtgcgcttcttcggcgtctgcaccgagggccgccccctgctcatggtctttgagtatatgcggcacggggacctcaaccgcttcctccgatcccatggacctgatgccaagctgctggctggtggggaggatgtggctccaggccccctgggtctggggcagctgctggccgtggctagccaggtcgctgcggggatggtgtacctggcgggtctgcattttgtgcaccgggacctggccacacgcaactgtctagtgggccagggactggtggtcaagattggtgattttggcatgagcagggatatctacagcaccgactattaccgtgtgggaggccgcaccatgctgcccattcgctggatgccgcccgagagcatcctgtaccgtaagttcaccaccgagagcgacgtgtggagcttcggcgtggtgctctgggagatcttcacctacggcaagcagccctggtaccagctctccaacacggaggcaatcgactgcatcacgcagggacgtgagttggagcggccacgtgcctgcccaccagaggtctacgccatcatgcggggctgctggcagcgggagccccagcaacgccacagcatcaaggatgtgcacgcccggctgcaagccctggcccaggcacctcctgtctacctggatgtcctgggctagggggccggcccaggggctgggagtggttagccggaatactggggcctgccctcagcatcccccatagctcccagcagccccagggtgatctcaaagtatctaattcaccctcagcatgtgggaagggacaggtgggggctgggagtagaggatgttcctgcttctctaggcaaggtcccgtcatagcaattatatttattatcccttgaaaaaaaa

SEQ ID NO: 22 - protein, 796 aa, Homo sapiens
MLRGGRRGQLGWHSWAAGPGSLLAWLILASAGAAPCPDACCPHGSSGLRCTRDGALDSLHHLPGAENLTELYIENQQHLQHLELRDLRGLGELRNLTIVKSGLRFVAPDAFHFTPRLSRLNLSFNALESLSWKTVQGLSLQELVLSGNPLHCSCALRWLQRWEEEGLGGVPEQKLQCHGQGPLAHMPNASCGVPTLKVQVPNASVDVGDDVLLRCQVEGRGLEQAGWILTELEQSATVMKSGGLPSLGLTLANVTSDLNRKNVTCWAENDVGRAEVSVQVNVSFPASVQLHTAVEMHHWCIPFSVDGQPAPSLRWLFNGSVLNETSFIFTEFLEPAANETVRHGCLRLNQPTHVNNGNYTLLAANPFGQASASIMAAFMDNPFEFNPEDPIPVSFSPVDTNSTSGDPVEKKDETPFGVSVAVGLAVFACLFLSTLLLVLNKCGRRNKFGINRPAVLAPEDGLAMSLHFMTLGGSSLSPTEGKGSGLQGHIIENPQYFSDACVHHIKRRDIVLKWELGEGAFGKVFLAECHNLLPEQDKMLVAVKALKEASESARQDFQREAELLTMLQHQHIVRFFGVCTEGRPLLMVFEYMRHGDLNRFLRSHGPDAKLLAGGEDVAPGPLGLGQLLAVASQVAAGMVYLAGLHFVHRDLATRNCLVGQGLVVKIGDFGMSRDIYSTDYYRVGGRTMLPIRWMPPESILYRKFTTESDVWSFGVVLWEIFTYGKQPWYQLSNTEAIDCITQGRELERPRACPPEVYAIMRGCWQREPQQRHSIKDVHARLQALAQAPPVYLDVLG

SEQ ID NO: 23 - DNA, 3022 bp, Homo sapiens
tggacgagcgcgcttccgacccgccgccaccgcctcctcccctccttctcggcccgccccctccctcgcctcttcctgccaggcggcccttctcccctcccctctcagttccctccgccctcctcgggctccagcggtggcggagcgaacgggaccggcccggcttcagagcgcgaggtggagggtggaacgcgggcgcctgaaggagttgttgtctcggcagcgcccgcggagacgtgaagaggtggttgtgggaagagaagtttgcagaactgaaatggaggtcagagcttcattacagaaggttagtggatcatctgattctgtggctacaatgaacagtgaagaatttgttttggttcctcagtatgcagatgataattctacaaaacatgaagaaaaacctcaactgaagatagtttctaatggtgatgaacaattggaaaaagccatggaagagattttgagagattccgagaaaaggccaagcagtcttcttgttgattgtcaaagttccagtgagatttcagaccattcgtttggagatattccagccagccaaacaaataagccatctcttcagttaattttggatccgtctaacacagaaatttctacacccagaccatcttctccaggtggactacctgaagaagatagtgttttatttaataaactgacctacttaggatgtatgaaggtttcttccccacgtaatgaagtagaggctttacgggcaatggcaaccatgaaatcttccagtcaatacccctttcctgttaccctgtatgtaccaaatgttccagaaggttctgtgagaattatagaccaatccagcaatgtggagatagcatcttttccaatctataaggtgttattctgtgcacgtggacatgacggaacaacagagagcaattgctttgcatttacagagagttcccatggttcggaagaatttcagatacatgttttctcctgtgaaattaaagaggcagtaagcagaattttgtacagtttctgtacagcattcaaacgttcttccagacaagtgtctgatgttaaagactcagttattcctacccccgacagtgatgtgtttaccttcagtgtctccttggaggtaaaagaagacgatggaaaaggaaactttagccctgtgcctaaggatagagataaattttatttcaaattaaagcaaggaatagagaagaaggttgtgattacagtgcagcaactttctaacaaagaattagctattgaaagatgttttggaatgttattaagcccaggtcgaaacgtgaagaacagtgacatgcatttactggatatggaatccatgggaaagagctatgatgggagagcttatgtcatcactggcatgtggaaccccaatgcaccagtatttctggcacttaacgaggaaaccccaaaagataagcaagtatacatgactgtggcagtggatatggtagtcacagaggtggtggagcctgttcgctttctcctggagacagtagtccgtgtgtaccctgcaaatgagcgattttggtatttcagcagaaagactttcacagagactttcttcatgagattgaaacagtctgagggaaaaggccataccaatgctggagatgcaatatatgaggtggtgagtctacagcgagagtctgacaaggaggaaccagtcactcctactagtggagggggtccaatgtcaccccaggatgatgaagcagaagaggagagtgataatgaactctcaagtggaacaggtgatgtgtctaaggattgtcctgagaagatcctgtattcttggggagagttgctaggaaaatggcacagtaaccttggtgcacgaccgaaagggctgtctactctggtgaagagtggtgtccctgaagcattgagggcagaggtatggcagttattggcaggctgccatgacaaccaggcaatgctggatagataccgaattcttatcacaaaggactcagcccaggagagtgttattactcgagatattcatcgtacatttcccgcacatgattactttaaagatactggaggagatggtcaagaatcgctctataagatctgcaaggcctactctgtgtatgatgaagacattgggtactgtcaagggcagtcttttcttgctgctgtattactgctgcatatgccagaggaacaagcattctgtgttttggtgaaaatcatgtacgactatggtttgagagacctctacagaaacaacttcgaagatcttcattgcaaattctaccagttggagagactaatgcaggaacagctaccggacctgcatagccatttttctgatctgaacctggaagctcatatgtatgcatcccagtggtttctcactctttttactgccaagttcccactctgcatggtgttccacatcattgacttactgctttgtgagggtttgaacataatctttcatgtagctttggctctcctaaagacctcaaaggaagaccttctgcaggctgattttgaaggtgctttaaagttctttagagttcagcttccaaagagatacagggcagaggaaaatgcaagaagactgatggagcaggcttgcaatattaaagtaccaaccaagaagctgaagaaatatgagaaagaatatcagacaatgcgagagagtcagctgcaacaggaagacccaatggatagatacaagtttgtatatttgtaggtaactccagctgttgcatttatactgggaatcttcataagaagctgagagaaagagaggggaaaaagaaagtggctttctactttcaaaaatgaaacaaaaaggaaaaatggcaaagtactgttttagctgtgcatgtcatatccacaaagacttttagcaggtgaactgttccaagactgacacaaggatgtttcaaacttgcctctgtctgtagaaaatgttaaaaataccaactcacttggaaggaaaaataaaaatcacaaaggtatattgagcacagtaaaaaaaaaaaaa

SEQ ID NO: 24 - protein, 815 aa, Homo sapiens
MEVRASLQKVSGSSDSVATMNSEEFVLVPQYADDNSTKHEEKPQLKIVSNGDEQLEKAMEEILRDSEKRPSSLLVDCQSSSEISDHSFGDIPASQTNKPSLQLILDPSNTEISTPRPSSPGGLPEEDSVLFNKLTYLGCMKVSSPRNEVEALRAMATMKSSSQYPFPVTLYVPNVPEGSVRIIDQSSNVEIASFPIYKVLFCARGHDGTTESNCFAFTESSHGSEEFQIHVFSCEIKEAVSRILYSFCTAFKRSSRQVSDVKDSVIPTPDSDVFTFSVSLEVKEDDGKGNFSPVPKDRDKFYFKLKQGIEKKVVITVQQLSNKELAIERCFGMLLSPGRNVKNSDMHLLDMESMGKSYDGRAYVITGMWNPNAPVFLALNEETPKDKQVYMTVAVDMVVTEVVEPVRFLLETVVRVYPANERFWYFSRKTFTETFFMRLKQSEGKGHTNAGDAIYEVVSLQRESDKEEPVTPTSGGGPMSPQDDEAEEESDNELSSGTGDVSKDCPEKILYSWGELLGKWHSNLGARPKGLSTLVKSGVPEALRAEVWQLLAGCHDNQAMLDRYRILITKDSAQESVITRDIHRTFPAHDYFKDTGGDGQESLYKICKAYSVYDEDIGYCQGQSFLAAVLLLHMPEEQAFCVLVKIMYDYGLRDLYRNNFEDLHCKFYQLERLMQEQLPDLHSHFSDLNLEAHMYASQWFLTLFTAKFPLCMVFHIIDLLLCEGLNIIFHVALALLKTSKEDLLQADFEGALKFFRVQLPKRYRAEENARRLMEQACNIKVPTKKLKKYEKEYQTMRESQLQQEDPMDRYKFVYL

SEQ ID NO: 25 - DNA, 10960 bp, Homo sapiens
gcggccgcgctgagcccctagcccgccgggagcgccaggccggccaggcctgcgccgccgccgccgccgccgtcgccgccgcgccgaccatgtcggcagccaaggagaacccgtgcaggaaattccaggccaacatcttcaacaagagcaagtgtcagaactgcttcaagccccgcgagtcgcatctgctcaacgacgaggacctgacgcaggcaaaacccatttatggcggttggctgctcctggctccagatgggaccgactttgacaacccagtgcaccggtctcggaaatggcagcgacggttcttcatcctttacgagcacggcctcttgcgctacgccctggatgagatgcccacgacccttcctcagggcaccatcaacatgaaccagtgcacagatgtggtggatggggagggccgcacgggccagaagttctccctgtgtattctgacgcctgagaaggagcatttcatccgggcggagaccaaggagatcgtcagtgggtggctggagatgctcatggtctatccccggaccaacaagcagaatcagaagaagaaacggaaagtggagccccccacaccacaggagcctgggcctgccaaggtggctgttaccagcagcagcagcagcagcagcagcagcagcagcatccccagtgctgagaaagtccccaccaccaagtccacactctggcaggaagaaatgaggaccaaggaccagccagatggcagcagcctgagtccagctcagagtcccagccagagccagcctcctgctgccagctccctgcgggaacctgggctagagagcaaagaagaggagagcgccatgagtagcgaccgcatggactgtggccgcaaagtccgggtggagagcggctacttctctctggagaagaccaaacaggacttgaaggctgaagaacagcagctgcccccgccgctctcccctcccagccccagcacccccaaccacaggaggtcccaggtgattgaaaagtttgaggccttggacattgagaaggcagagcacatggagaccaatgcagtggggccctcaccatccagcgacacacgccagggccgcagcgagaagagggcgttccctaggaagcgggacttcaccaatgaagcccccccagctcctctcccagacgcctcggcttcccccctgtctccacaccgaagagccaagtcactggacaggaggtccacggagccctccgtgacgcccgacctgctgaatttcaagaaaggctggctgactaagcagtatgaggacggccagtggaagaaacactggtttgtcctcgccgatcaaagcctgagatactacagggattcagtggctgaggaggcagccgacttggatggagaaattgacttgtccgcatgttacgatgtcacagagtatccagttcagagaaactatggcttccagatacatacaaaggagggcgagtttaccctgtcggccatgacatctgggattcggcggaactggatccagaccatcatgaagcacgtgcacccgaccactgccccggatgtgaccagctcgttgccagaggaaaaaaacaagagcagctgctcttttgagacctgcccgaggcctactgagaagcaagaggcagagctgggggagccggaccctgagcagaagaggagccgcgcacgggagcggaggcgagagggccgctccaagacctttgactgggctgagttccgtcccatccagcaggccctggctcaggagcgggtgggcggcgtggggcctgctgacacccacgagcccctgcgccctgaggcggagcctggggagctggagcgggagcgtgcacggaggcgggaggagcgccgcaagcgcttcgggatgctcgacgccacagacgggccaggcactgaggatgcagccctgcgcatggaggtggaccggagcccagggctgcctatgagcgacctcaaaacgcataacgtccacgtggagattgagcagcggtggcatcaggtggagaccacacctctccgggaagagaagcaggtgcccatcgcccccgtccacctgtcttctgaagatgggggtgaccggctctccacacacgagctgacctctctgctcgagaaggagctggagcagagccagaaggaggcctcagaccttctggagcagaaccggctcctgcaggaccagctgagggtggccctgggccgggagcagagcgcccgtgagggctacgtgctgcaggccacgtgcgagcgagggtttgcagcaatggaagaaacgcaccagaagaagattgaagatctccagaggcagcaccagcgggagctagagaaacttcgagaagagaaagaccgcctcctagccgaggagacagcggccaccatctcagccatcgaagccatgaagaacgcccaccgggaggaaatggagcgggagctggagaagagccagcggtcccagatcagcagcgtcaactcggatgttgaggccctgcggcgccagtacctggaggagctgcagtcggtgcagcgggaactggaggtcctctcggagcagtactcgcagaagtgcctggagaatgcccatctggcccaggcgctggaggccgagcggcaggccctgcggcagtgccagcgtgagaaccaggagctcaatgcccacaaccaggagctgaacaaccgcctggctgcagagatcacacggttgcggacgctgctgactggggacggcggtggggaggccactgggtcaccccttgcacagggcaaggatgcctatgaactagaggtcttattgcgggtaaaggaatcggaaatacagtacctgaaacaggagattagctccctcaaggatgagctgcagacggcactgcgggacaagaagtacgcaagtgacaagtacaaagacatctacacagagctcagcatcgcgaaggctaaggctgactgtgacatcagcaggttgaaggagcagctcaaggctgcaacggaagcactgggggagaagtcccctgacagtgccacggtgtccggatatgatataatgaaatctaaaagcaaccctgacttcttgaagaaagacagatcctgtgtcacccggcaactcagaaacatcaggtccaagagtctgaaggaaggcctgacggtgcaagaacggttgaagctctttgaatccagggacttgaagaaagactaggtgtgtcccatccaagttgagcacgcgccttccccagcttgcagcagcacaccccaagcgctgcttttcacctgtacctttgttttattattattattattattgctgttgttgtcatcgttaactgtgggcatggaatgcgtgaggctggcttctgggttgtccacaccactctctgctgtgttgacttcctgttgtcttcatcaaagcttttttccgtggtattctaaaattaggccagcagtgggggctgggagggcatctgtgttagtcctttcctggctgtgacccgccacactcactgtcagtattaaggcccagcagcctgttgataagctaccctgtctcaccatgtgctggtgtggaaacggggcccagccagcacgcctcaaggtagatggaatccccactggtcagagaaaaagctatgcggacactccagcttggcctgggtcacagcactgactcctcacccgctagtctggctgttaagaggagaaagtgcactgccttccagcccaggaggaggacagcattttgtatttgttccactgatgcagcttagaaccacacccctgagagtcgtggcaaacctttcacaacctggaaaatgttgaaagcaaccattcctatttttgtttgttttttattaaatcttgcacaaaatccccggcccctctccttccttccttccttccttcctccgctcgttcctttcttggtctccagtaaccctggtcttttcataactgctcgagattgttgacctgcagcccaggtttcagactctgattgcaaaaaacaaatgaattccccccaggaatcattcaaaatgggggaaggtttgggggtttgggttttttttttaccttttggaaaagaaaccgtcacattgctttggaaaaggttgagaggagacccctgttaagtcaagaagaaagtacagaggatgtcagaatctgatgagaacagcacattagtgtttattgagactccgatcttaactctcatttaattaatctgagctctgaaaacctatcttgcagcatttatctttaaaagagcctggttaaagtaaacctatactaacaattttgctttttctaacagtttgaggaagacctttttaaccaccacaaaacattctatggcaattcttgaaaatctcttaaattggagtctattatggccccatgaaaaccattaatcccattaagatagggagtataaacccctggctggtggaacaggttctgctactttaggagcaaggtggggtgtgagtagatggttttcatgccaagaacatgctttcactttgtattcatgcttgtgttggtgtgatggtctctgtgggtgggtggatgctttgggcgttgaaatctagaaatcctgttgctcagtttctagatgaagtcatgagcaaggccatcagtggagctctggccccgcccccaatgtgcagaagggccgggagcaaggcctggagttttcatgtgttttcagacccaggtttaggtgctctcttctcactgaaataactaagtgctctccactggcatcgagccctttccacaagtttttaaggctcttaacccacactttcactcctctgctactagtcttcagtgttgttaacagcaagagaaaattgggtttgtttaaaaatctacttctctgaggtggcacagttgcgtagctgtagtcccagctactcaggaggctgaggtagtaggattgcttgagcccgggaggtcgaggctgcaatcagtcatgatcgtgtcactgcactccagcctgggtgacaaagcaaggccccatatcagatatagatatacttatcagaccccccctgaccatttagattggcagtgctttgagaaatgcactatgacctttctgtgtcaatgggaatatacagaaggaacattcgggaccccgctgtcccccacagcctcattgttgtctccaggacactgctgggtcacacgaatgctccaggacagacagggacctggagtgcatcaggatctgaccagataggagtttttgcctcgtgtctgggtgctacgattttgtgccgttctctgaggtccaccacctgcccttcctggcatggtttccttcgtgaccatccctgctgcccctgggggtggaccccactggcccttctgcagacagctccctgccttctgccctccagggggttctggccagagtccatgcttggagacaggatcatctgccttcagccctcacagtgctttaaattaaagcaagtttgcccataggacaaaagagcatttgattcccttttttctgtcacatatcccttgaggctggacttcaggaatcctggaaaattaatatgagtgcagcatgtgaggggtcagagacaggccagcagggcgtctgcattcctccctgccacaggtctctccccagaggctggtttagtgtagggtattgccaggaaacggactgaggctgctttgctaagagctcctgaaaatgccctgggcctgtcctggcgtttctgaagagccctcatacagggacagccaccatctgggtcaaggaagtctgggttccctgctggtgggctccatcctgcgatggagtgaaccaggcgagaaaggatgacgatgttcttcatgttgcacctggacatgccccaggaacagagacttgcccaggtggcaacactggcacagatgttgacggctgcccaactggtgccacactgagcagggagccttgtgctgcacagggctgggccctctctccagtttccttcctgcaggcatccaaataccctggaagggatttaacccctgaattccagagggaagaaagaagaacagtgaagaagtagaactggtttctgtatggggagaggaaagtcttagggacagctgcaggcggggtctcaggctgctccttggcaccagctacacagtagtgagctttcccagctttaccgatgaggaagaagttcaaatagatagacttcagcattttaattattttcctataaatgtatttatgtgtagtatgctagcaccagccagtaagctgtgccacacatatgaatgggaaagcgaggcagttgtgctcgtgtgagtttctgcaggcttgtgggtaattaccttgtgtgcacgcctgcacgtgcagaatagtcactttctgctggtcagtttctttatccacccatggtgccccagccccaggcaggtgtggagaccagcatttcagaggacgcgctgtccacagcctcccgggtctgagtggatcattgggcaggggtggagacagtgcgctgccctctgagctggaagcctgtgcttcagggagtcataatgggcctgtgctaagtgggtgatgcagtggacatcccagggcgactagaggtggcagtatcgcgaatttgcaggtttattgaacaagaggtaacatcggagaggatcttgccttcggattcagcaagtatgaaggcagaagagcatggagagcaaggccccacagcctgcttagtgagttggaaggcccagcaagaacctgtttctgcagcagccaccagctcccatcaccccttgaccctccagctcatgctggagaagagggaattttggctgtttaaagaacacagttgtgaatctcagaatgtgcctgaaaggaatactgacagataaggccggaaacaaaactgatggcttgaaaaacatttttatggaatgtatttactatcattttgttttactatagaggtagatgggactcttaacttttgggtacatggaaacatgctgaaaactgaacacaatcctgatcatcactcctgcctggctgtctcctgggaggctgccgggtgccacggagctgggacacagcagagcccgctaggtgttgcagggccctggaggccaaggccaccctgtgtggggtccctgttggcagccaggtccctacacaaacaagtaatcctgtttggcctcctaggttttgcatatgacctgcagcctaatttggggtgtaggggaagctctgctggcccctgctcctttgtatgttgggtgactttaatggctggccacatacccctttctcccagctactcattcactgacttgggtaagttctaagacagttcgcacttagaaaagaatgtgacacatcaacattaacttttcctgaaaagaagagtttgcctaacatggtcctaaagaagcttggaatttataagactttcctttataagatatagtgggggtttttttgggtggaggggggttgttttttgttttttgttttcaagacagagtctcgctctgttgtccaggctggagtgtagtggcatgatctcggctcactgcaacctctgcctcccaggttcatgccattctcctgcctcagcctcccgagtagctgggactacaggtgtctgccgccacgcctggctaatttttttgtatttttagtagagacggggtttcaccatgttggtcaggatggtctcgatttcctgacctcgtgatccgcctgtctcggcctcccaaagtgctgggattacaggcgtgagccaccacgcctggcctataagatacggtaaaaaaaaaaaactgtgacccctttgtcactaagggagaaagaaattaagtattgtcaaagttctataaagaatggaaatgtatgatattatacttcaaaggaatttgatgttgaaattttaaagaaaatttgtcatgttgatgagaagcttcactttcctgggaacttcattcgttttagggcatgagataaaagtcctggctaggggagccataggtctgttgtacaaggaatttgctttctaaacaagttgtaacttgccctaaggtccctgttggagcactaagaggtgacacaggccagagacaacgtttcgtttccccttccctgcaagctgggatcagccctgtgttttctcctttcagctgaagtgagcgaaggttctcagtgctggcaaaagagcccactttctaaaaggacttgggaagaaagctgctgggaacttgcttattaaaaagttccttagaattaaggtatctacccactgttttcgcacctttcaccttcctgggctttcctgccctccagcattcttctctagagaggttcctagcccgctcagcgcgagcgtctccagtaggtaatagcagctgaacgtgggttttccacggacttcaggcttggaggtgccatatacaagcacacttcttccttcccctggcttctccatgccaccacccactttaaagatgtaaactcagtagatttttcatccagtgaacggtcatcttcacatcgaaaggtgaaggccaccactgttctcaatgccaagcaacagaacgttctgagatggccgttcttccttgcacagcagctacggcaggttgttctgcagccaccccttagagggggctcttcgttttacctttgtacagttcttgtgtttacacatttgggccaaacagctttcagcaagggcatgtgtccacagctgatgggcagttaagaaccagcctgagctgaaggctagtaataccgtgctgtaggctctttaaaaggaaagcctggcataaacccagcatggaaaggaacattatcagttatctcaaattttgtctgccagggacaagaccctgttcattcttttgcccttttcagaactgtgagcttcaagtattcttgcttctctgtaaagggaagacatctcccttctctgaaatccttcaacaaaagaaaaggctcttggcagggtaggggagtcagtagctcaacactagatcatccctagagatggggcaagtttctgtctgaacacgtcttgggtccgagtccttaggtgttcggatgcagtactttgtgaatacttaagctactgcatgcttggtgtagcttgcaatttctctgtatttaaaagcagctgtgtttattttcttcaaaataacctgtatattatttagagcaagcaatgtaaatattactgagaagttactgcagggatttttgtgacagagtttgtatgggtttttaaaaaaatcttagacacccctttttaagatggggagaacagggttgactgcaccgttgaagcccgcccagcattataaggaaatgtttttaatgactgctgcatctttgtaaaacgtttggtcatctaacagatggttttaaagtgtacaatatccaaaataacgatagccctgtatccatacattgtttcattgaaagaattctctattgcctcttcttggtagagccagagtccttaaggaaaatcaggaaaattaagaaaatgatggtgccatcttgaccagacttctgcacagtaatttaacgctatcctagggagacttggttgaaggcacagttctgggatcagggtctaaatgtgcagtttctgagaaccttcaagaccactcactgggcagggctctgtggagcactggagctgtttggattccccagccctttggtcatatcctggaattccgtggaggctgcagaacttagatgcagctgttttttacagcacctatttttgtcagattggtaaggaaacactgagtcacagaatacttaagaattggagactccagtaatgtaggatggcctgagaggacgtccaagtcccaaggggtggacacggcatgttcctcgggcacagcctcagtgggggccttccccaggcgcagctcggccacctgaggaaagggtgtttcggaggcgcagccacacacacagcgctggcagcctcacggtcacgcccatcactccctgccccccactgcccttgagaagttagtggtgtcacatccttagttttatagacagctaggaatagattgtgaagaacactcagttcactactgtgttacatttatatcacaagcttcaattaaaatggattttaaaggattttaggatttacctttagtattaacaacgtatctactgacatactgttaggattcaaaaccagttaagtataagaattacttcatgtggttttcctagggtacaatttataaaaggtagaaagcatccaagtggctcctcaacaattacaattcttaatgatttttctcacagctgtgcccttctgtcagggtcagtgtcaaaattcgttatcaaaggcaaaacctactgtgccaagctggggcgctatatgtgaacggagtggaaatgcttcagtcacctctgccgcagcttgtgattccagcagttctcacaaacgttctgtcacatgatgaaaagaagcagcttgtataattccaactggtgtttcatttctgttctaatgctaagtggtaacgcttaacaaacagactaaaagctgtgtgcagaagaaagggctgaatgagtaccgcctccctaggttccagcacagcgctcgggtctaagaagtagagccccggggtagggtgggccatccactgtcaggccagtgtctcaagaaagcctgaccagctgagctgctgctttttttttgggggggggggggggaggggcgtcttgaggctttttttttttttacaaagttagtttgtgatcaacgattcactacaattgaagtgttactttgtcagaatatttattcctttgtgtgacatgctagattccctggatgtagctgatcatttttattttgtaaatattacctaactttacataaactatatcataataaactatttttgcatcaccctttg

SEQ ID NO: 26 - protein, 1038 aa, Homo sapiens
MSAAKENPCRKFQANIFNKSKCQNCFKPRESHLLNDEDLTQAKPIYGGWLLLAPDGTDFDNPVHRSRKWQRRFFILYEHGLLRYALDEMPTTLPQGTINMNQCTDVVDGEGRTGQKFSLCILTPEKEHFIRAETKEIVSGWLEMLMVYPRTNKQNQKKKRKVEPPTPQEPGPAKVAVTSSSSSSSSSSSIPSAEKVPTTKSTLWQEEMRTKDQPDGSSLSPAQSPSQSQPPAASSLREPGLESKEEESAMSSDRMDCGRKVRVESGYFSLEKTKQDLKAEEQQLPPPLSPPSPSTPNHRRSQVIEKFEALDIEKAEHMETNAVGPSPSSDTRQGRSEKRAFPRKRDFTNEAPPAPLPDASASPLSPHRRAKSLDRRSTEPSVTPDLLNFKKGWLTKQYEDGQWKKHWFVLADQSLRYYRDSVAEEAADLDGEIDLSACYDVTEYPVQRNYGFQIHTKEGEFTLSAMTSGIRRNWIQTIMKHVHPTTAPDVTSSLPEEKNKSSCSFETCPRPTEKQEAELGEPDPEQKRSRARERRREGRSKTFDWAEFRPIQQALAQERVGGVGPADTHEPLRPEAEPGELERERARRREERRKRFGMLDATDGPGTEDAALRMEVDRSPGLPMSDLKTHNVHVEIEQRWHQVETTPLREEKQVPIAPVHLSSEDGGDRLSTHELTSLLEKELEQSQKEASDLLEQNRLLQDQLRVALGREQSAREGYVLQATCERGFAAMEETHQKKIEDLQRQHQRELEKLREEKDRLLAEETAATISAIEAMKNAHREEMERELEKSQRSQISSVNSDVEALRRQYLEELQSVQRELEVLSEQYSQKCLENAHLAQALEAERQALRQCQRENQELNAHNQELNNRLAAEITRLRTLLTGDGGGEATGSPLAQGKDAYELEVLLRVKESEIQYLKQEISSLKDELQTALRDKKYASDKYKDIYTELSIAKAKADCDISRLKEQLKAATEALGEKSPDSATVSGYDIMKSKSNPDFLKKDRSCVTRQLRNIRSKSLKEGLTVQERLKLFESRDLKKD

SEQ ID NO: 27 - DNA, 11941 bp, Homo sapiens
cacgcgcgcccggctgggggatctcctccgcgtgcccgaaagggggatatgccatttggacatgtaattgtcagcacgggatctgagacttccaaaaaatgaagccggcgacaggactttgggtctgggtgagccttctcgtggcggcggggaccgtccagcccagcgattctcagtcagtgtgtgcaggaacggagaataaactgagctctctctctgacctggaacagcagtaccgagccttgcgcaagtactatgaaaactgtgaggttgtcatgggcaacctggagataaccagcattgagcacaaccgggacctctccttcctgcggtctgttcgagaagtcacaggctacgtgttagtggctcttaatcagtttcgttacctgcctctggagaatttacgcattattcgtgggacaaaactttatgaggatcgatatgccttggcaatatttttaaactacagaaaagatggaaactttggacttcaagaacttggattaaagaacttgacagaaatcctaaatggtggagtctatgtagaccagaacaaattcctttgttatgcagacaccattcattggcaagatattgttcggaacccatggccttccaacttgactcttgtgtcaacaaatggtagttcaggatgtggacgttgccataagtcctgtactggccgttgctggggacccacagaaaatcattgccagactttgacaaggacggtgtgtgcagaacaatgtgacggcagatgctacggaccttacgtcagtgactgctgccatcgagaatgtgctggaggctgctcaggacctaaggacacagactgctttgcctgcatgaatttcaatgacagtggagcatgtgttactcagtgtccccaaacctttgtctacaatccaaccacctttcaactggagcacaatttcaatgcaaagtacacatatggagcattctgtgtcaagaaatgtccacataactttgtggtagattccagttcttgtgtgcgtgcctgccctagttccaagatggaagtagaagaaaatgggattaaaatgtgtaaaccttgcactgacatttgcccaaaagcttgtgatggcattggcacaggatcattgatgtcagctcagactgtggattccagtaacattgacaaattcataaactgtaccaagatcaatgggaatttgatctttctagtcactggtattcatggggacccttacaatgcaattgaagccatagacccagagaaactgaacgtctttcggacagtcagagagataacaggtttcctgaacatacagtcatggccaccaaacatgactgacttcagtgttttttctaacctggtgaccattggtggaagagtactctatagtggcctgtccttgcttatcctcaagcaacagggcatcacctctctacagttccagtccctgaaggaaatcagcgcaggaaacatctatattactgacaacagcaacctgtgttattatcataccattaactggacaacactcttcagcacaatcaaccagagaatagtaatccgggacaacagaaaagctgaaaattgtactgctgaaggaatggtgtgcaaccatctgtgttccagtgatggctgttggggacctgggccagaccaatgtctgtcgtgtcgccgcttcagtagaggaaggatctgcatagagtcttgtaacctctatgatggtgaatttcgggagtttgagaatggctccatctgtgtggagtgtgacccccagtgtgagaagatggaagatggcctcctcacatgccatggaccgggtcctgacaactgtacaaagtgctctcattttaaagatggcccaaactgtgtggaaaaatgtccagatggcttacagggggcaaacagtttcattttcaagtatgctgatccagatcgggagtgccacccatgccatccaaactgcacccaagggtgtaacggtcccactagtcatgactgcatttactacccatggacgggccattccactttaccacaacatgctagaactcccctgattgcagctggagtaattggtgggctcttcattctggtcattgtgggtctgacatttgctgtttatgttagaaggaagagcatcaaaaagaaaagagccttgagaagattcttggaaacagagttggtggaaccattaactcccagtggcacagcacccaatcaagctcaacttcgtattttgaaagaaactgagctgaagagggtaaaagtccttggctcaggtgcttttggaacggtttataaaggtatttgggtacctgaaggagaaactgtgaagattcctgtggctattaagattcttaatgagacaactggtcccaaggcaaatgtggagttcatggatgaagctctgatcatggcaagtatggatcatccacacctagtccggttgctgggtgtgtgtctgagcccaaccatccagctggttactcaacttatgccccatggctgcctgttggagtatgtccacgagcacaaggataacattggatcacaactgctgcttaactggtgtgtccagatagctaagggaatgatgtacctggaagaaagacgactcgttcatcgggatttggcagcccgtaatgtcttagtgaaatctccaaaccatgtgaaaatcacagattttgggctagccagactcttggaaggagatgaaaaagagtacaatgctgatggaggaaagatgccaattaaatggatggctctggagtgtatacattacaggaaattcacccatcagagtgacgtttggagctatggagttactatatgggaactgatgacctttggaggaaaaccctatgatggaattccaacgcgagaaatccctgatttattagagaaaggagaacgtttgcctcagcctcccatctgcactattgacgtttacatggtcatggtcaaatgttggatgattgatgctgacagtagacctaaatttaaggaactggctgctgagttttcaaggatggctcgagaccctcaaagatacctagttattcagggtgatgatcgtatgaagcttcccagtccaaatgacagcaagttctttcagaatctcttggatgaagaggatttggaagatatgatggatgctgaggagtacttggtccctcaggctttcaacatcccacctcccatctatacttccagagcaagaattgactcgaataggagtgaaattggacacagccctcctcctgcctacacccccatgtcaggaaaccagtttgtataccgagatggaggttttgctgctgaacaaggagtgtctgtgccctacagagccccaactagcacaattccagaagctcctgtggcacagggtgctactgctgagatttttgatgactcctgctgtaatggcaccctacgcaagccagtggcaccccatgtccaagaggacagtagcacccagaggtacagtgctgaccccaccgtgtttgccccagaacggagcccacgaggagagctggatgaggaaggttacatgactcctatgcgagacaaacccaaacaagaatacctgaatccagtggaggagaacccttttgtttctcggagaaaaaatggagaccttcaagcattggataatcccgaatatcacaatgcatccaatggtccacccaaggccgaggatgagtatgtgaatgagccactgtacctcaacacctttgccaacaccttgggaaaagctgagtacctgaagaacaacatactgtcaatgccagagaaggccaagaaagcgtttgacaaccctgactactggaaccacagcctgccacctcggagcacccttcagcacccagactacctgcaggagtacagcacaaaatatttttataaacagaatgggcggatccggcctattgtggcagagaatcctgaatacctctctgagttctccctgaagccaggcactgtgctgccgcctccaccttacagacaccggaatactgtggtgtaagctcagttgtggttttttaggtggagagacacacctgctccaatttccccacccccctctctttctctggtggtcttccttctaccccaaggccagtagttttgacacttcccagtggaagatacagagatgcaatgatagttatgtgcttacctaacttgaacattagagggaaagactgaaagagaaagataggaggaaccacaatgtttcttcatttctctgcatgggttggtcaggagaatgaaacagctagagaaggaccagaaaatgtaaggcaatgctgcctactatcaaactagctgtcactttttttctttttctttttctttctttgtttctttcttcctcttcttttttttttttttttttaaagcagatggttgaaacacccatgctatctgttcctatctgcaggaactgatgtgtgcatatttagcatccctggaaatcataataaagtttccattagaacaaaagaataacattttctataacatatgatggtgtctgaaattgagaatccagtttctttccccagcagtttctgtcctagcaagtaagaatggccaactcaactttcataatttaaaaatctccattaaagttataactagtaattatgttttcaacactttttggtttttttcattttgttttgctctgaccgattcctttatatttgctcccctatttttggctttaatttctaattgcaaagatgtttacatcaaagcttcttcacagaatttaagcaagaaatattttaatatagtgaaatggccactactttaagtatacaatctttaaaataagaaagggaggctaatatttttcatgctatcaaattatcttcaccctcatcctttacatttttcaacatttttttttctccataaatgacactacttgataggccgttggttgtctgaagagtagaagggaaactaagagacagttctctgtggttcaggaaaactactgatactttcaggggtggcccaatgagggaatccattgaactggaagaaacacactggattgggtatgtctacctggcagatactcagaaatgtagtttgcacttaagctgtaattttatttgttctttttctgaactccattttggattttgaatcaagcaatatggaagcaaccagcaaattaactaatttaagtacatttttaaaaaaagagctaagataaagactgtggaaatgccaaaccaagcaaattaggaaccttgcaacggtatccagggactatgatgagaggccagcacattatcttcatatgtcacctttgctacgcaaggaaatttgttcagttcgtatacttcgtaagaaggaatgcgagtaaggattggcttgaattccatggaatttctagtatgagactatttatatgaagtagaaggtaactctttgcacataaattggtataataaaaagaaaaacacaaacattcaaagcttagggataggtccttgggtcaaaagttgtaaataaatgtgaaacatcttctcatgcaattattttattatccaacacactaatcttttgatactttatataattccctttcttcatatactgcatccagtactagaaccatcattattatgtatcattttgaaagaatacctgatgagatgaaggatgagaacaaatgacagagatgagtctccaagtaaagggggcctcacatcaataattaggaaacttagatataagtcgcccttttctgaaaattctaccccaagtcatttagatttttaaaaaatatttctaatgttaaaatattgggaccaaattagaatcaatagtataagattaattaattagagtaaaaatatctattaaggcagagaaagtttagagaaaaaaatccaaagaaatttgtgtttcttcctattctgaacaagtaaatccatccatccatccatccaaacctcctttatctaactgtgtctactaaaagcaccatgttttgtggggaacactcagataaatggaatatcatcctcaacttcaaaattctatgatctaggagatttaattaaaatgacattttaatttttctatgcgttccaacaatcagattgcatagtctcttttgtgaatagctgtcatataatcagttgtactgtaagatatctcctttaaactcatttgggatataagttaaacatccttcaaattgttgatgttgacaaacaggataatttcaataatattattcaaacataaactggtctaggagaatattgcatcactgactaattagcctatctagagtctaacttcaccattaaaccaaaagcagatggtggtccttggccaagaatattggagacattggagttggtttttttctaagctataagaagtgaggcgagctgaaaaagtatggtagagcaggagaagggtttgtgagattccttctagtgaagttcaccctcaaacttttcaggggtaaagacacagagtgattcaggggccacaatctaatagctcagggctctcctatccattcagagaagtctctaggaaaagggatctcatatcagtacttatgaaaaattgaatataagcctccctttctaaataaatctgcatcgagtcatcacagccctctttttggatactataccttgattttttttttctgatttacaatatgcatatggtttctactgggctatagaaagcagaatcactcattttggagaaggaaaaaatgaatagttaaaacaaacttttaactgttaaggtaacagaaatgtatttagtgaatgtctctttcctcctaagaacacaagacttctacatgttgggtaatacctagagatgcatgtaggaataatccaaaatgacccaaatgctttataatagcaccactttataattcttttgaatgatttctgtagtatataattgacttcagttgtttgagtgttttttgttttatttttgtcccccctgggaaaacatatttcagcatgtataagagggagaaaaaaagtttcattccttccagagaataacttatttagtccagtagggtagaattttaaaatgtcagttaaagtcttcaaagtgcttggggggatatcagattccagaggccaattgtagcaattgaaatttgcagaatcaattatgtaaatctgagacaaattagtattaaaattacacggagtatattttttaaatcacccaactttgtagattatacctattttgggcaggtatggaaaaattttgcagttaaatgattgcctaaagaaagtggtaaacaggtgaggaaagatggcctctgatctaggatagatccagaaccacaaagcatctgcaccacaaaaggtgttagactaccaagcagctcctggttttctgcatagtattagtagcacagcttaggatgagaatcctttctccagtaacattcttaaaatagcatgaaaaacaacgcaaaactcaaatttctattaaaacacacaaactaaaatcaagtgattcttttttgtagattagggagaaggactgaatatctaatttaagagaaggaatagtgtttaagtgttatagtgtgtgagctaataccttctaaaggaaagacatggcatgaagattgtgcatacttacaatgctaaggaaaaatcaagaaaaggactgtgtgaggctctgctactagatgaagttggaaggactattaatgtgcttcttgaagtatcaaaaatgaaaagaaaattaaaattgtttaagcctgacagggaaggatgtaaatacaagtttttctagagctctctaacctttatttcaaaactggaattattcatccatctgtaattgttgataatttaactagtatatgtagttcataaggtaatagaaaaggtgatcatgaaagcatgtatataactggacagaaccacgataatgctataagatgtagatttagttaggttatcagatgttaaatgattttaatattattaaataaatcaaactagaaaactaaccacaagtataatgtaacaaagttaaatgcaggatataaaaatgtaggatggattttgcatagtaaaaagataagtttgccatttaaaattgttgtttgttgggtttagctgaaagtaggcatatatggttccacttgggaaaacttgctttaaagcattacaatgaacaattttttctcattctcttattcctttatcactttttaaatgtaaagaaaattgtatttatttatttttttaaataaacaccaccttgcagaatttaataggcaaacatgttacatatgactaagtaagggtcttcaagatgaagtaaagaaaatgtaaatgttctattaccttatgcagagacaaaaaaaaaaaggagtggtgtcatttagctagcaaacaaacaaaatacagttaattggtgatatgtcctttcttttctcactatgccctcttgcctccaaaaatgacaacaaagaatcacaatttttctgataaataaatgctaaaccaagcgtttcaaactattgcattgccattcttttggactttagttattagaatgatgattgttatagggcaaatgagaaatccatgtgcatcagcttctagttgttaaaaaaaccagataaattaacttctactgtatactgtgggcagaggatcctagagctgatcctacaacatcagcttctagttgttaaaaaaaaaaaaagaaacagataaattaacttctactgtatatactgtgggcagaggatcttactgtgcctctgtttgtgtacatggacttcggtgtgtatcagtttgaaggacagccttgccccatgtaaacatataaatgcagattggtatcgcctggttgctatttgcttaagaacaaatattatacagatgagatcaggcataattttaaaagatcattatcagtggagacctcattattactgatattacaatggggccagtttttatacttctgggtagaattaataaaatttttctgatcccagagatctgagttctctctgcagttggaaacaagaagctgttgtgggcattgtgtcgggccaggggcccttgtgtttgtgtgggcaaatatcttttagcagtgtgagctgcttttttcttttcattaaaagtctctctaaaataatagaaatttcagatactcggttcaagtctcactgattttgtagaggtccaaaaatgtaggatctgtcacttttgcaggcccctgcctcacctaattcctggccaggtgacattttgggcagaagtaaatgcttctatagtcacaagctaaaatgactctaagccccaatttcacggggggtattcacatgcttcctctggaaaatactctttgacagtcagctttgcaagtaagtgattaccttgttaggaatcaaagaaaaatgtatttctctctgacctttagaggaaaatagaatccttcccttttttgcccattgacacaactggcactgctctcttccctttctaccaccctggttcaaagtagtcccccgatgctgtcctgttcctttcttaagccatagtggatctctgagatcctacaccccactttgtgaaacactgacttcatctttgccctcgaatgcctgattttttcataagagattctagcaatttggacactgtttaagtgaactatcaaactaccgcatagagaatatttaagctattaaaattatggtttcccatgaagatcaattctctgtgtccttccctataggaatttgagacgagttagccctgtgatgaatcttgaaactcacatatgtccacatacacttggtagaacttcgatttaatctttacataaaagctgtacatataaccaagaagttatttttgccagtaaattaacttatttgctttattcatcttatttggttcctaatcgtaaatattttgtagctgctgtaaatttttttctcccaaatgaggagtcttattatcataaaggtaaaggctattcagctttgataaccacctgcaattcttttttggatcattcatccatctaacaaatacataatgaggacagttcatgttaatgaaaatccatgttgtttaatagaatgccatcctttacctacttttgctctttatggacgtttttcttttcatgctctagtgagctttccctatatcatgagaagtggttatatttgtgcaaatatacaaatataggaaaacaaagattcatacctgtaggcaatagtctaacttgtccaaaccactttgcctttactgctatttttatccccaatgcgtagatatttcccccaggcctatagcctttgtgaaggaaagcaaatcatacctcctgtatattgacacgaatctggttttcaaatgtcatttccagattttttagttaattgggggttgtccttttcccttaatgtgagagtcattttcctgtatatttctggatctctcaggggctgggaggggggagtgaggggactacaaccatagcactccaagaacccttttgggattactccagtaatcaactacgaaagttattttctaaatgtagatatgtaaggtgttcttttaaagtaaggtactttgaaatatgtagcataaactggtactgctgttaaatgggtcgattattaaacggagcagctgtgtgagggcagctaactttgaatgcctgtctccctggctggtgtgtctccttctcatgttgagagcaccagggattgcgtggctgcatgctgaaaccgcattttcccatggtgtatgactagttcatctctttcttgagcaccattacaagaagatcaaatgaaaatgagatcaatgtggaagacaattcatagcacaaaaaaagtcatcttaaatctactctcaaacattcatcttatacatgcatcaaagtaatttactgacatcagtttgggtgagagagggagtcactttactgaaaaggcagaggcttaaggtgtatacatttgtactcacttccttattttcttaacttgtaagcagaaaacaagccctctctcttgtgaagtatcttcaaaggattggggtgcaaaaataccttgctggtaagccatcaatgttttatttaaatccctgcattcaaagttagctgcctttttgaaataaacaaacaaaaaatactactgtatgtttgaaaatgtgaatagtatttttatagcttgttaaagacatggctagttgcatttgtaaataagtataatgttgctttgattttcttttgtggacatctttatttggaacataattgtctttagggttgatttgtatataagtaattggcctgtgattgtttcttttttggttggaagttatcattttgacattacttgtgattctgtgttcagcactattgtgatgtgttcaacctctgcactcgcttacacaataggatatgccaattgtgtgtggtgtaatgttattttgatttttttccatgttattgatgaaggatcatgcacctaacacatactaacttttttaatgttaggcatatttttagtatactttctcttattctttcttctcctccaaccttttacccatcctccttcctttccctcattcctgttgttatttgagaatgagggagaaacagtattttacatttatgtaattaggcttttccgttagttctcaaggatcctcttttggctcttgggaaagaattgtacctgtacaaggcaattatagaatgcgaactgctttgcctcattccatactgatcatcccagctgaacaatttgaaaactgttctgcctttttgttacatgaatctgtcagaaatatatttttaatttaatataaatgaaattcaataaaatatgaaacaaacgttaaaaaaaaaaaaaaaaaa

SEQ ID NO: 28 - protein, 1308 aa, Homo sapiens
MKPATGLWVWVSLLVAAGTVQPSDSQSVCAGTENKLSSLSDLEQQYRALRKYYENCEVVMGNLEITSIEHNRDLSFLRSVREVTGYVLVALNQFRYLPLENLRIIRGTKLYEDRYALAIFLNYRKDGNFGLQELGLKNLTEILNGGVYVDQNKFLCYADTIHWQDIVRNPWPSNLTLVSTNGSSGCGRCHKSCTGRCWGPTENHCQTLTRTVCAEQCDGRCYGPYVSDCCHRECAGGCSGPKDTDCFACMNFNDSGACVTQCPQTFVYNPTTFQLEHNFNAKYTYGAFCVKKCPHNFVVDSSSCVRACPSSKMEVEENGIKMCKPCTDICPKACDGIGTGSLMSAQTVDSSNIDKFINCTKINGNLIFLVTGIHGDPYNAIEAIDPEKLNVFRTVREITGFLNIQSWPPNMTDFSVFSNLVTIGGRVLYSGLSLLILKQQGITSLQFQSLKEISAGNIYITDNSNLCYYHTINWTTLFSTINQRIVIRDNRKAENCTAEGMVCNHLCSSDGCWGPGPDQCLSCRRFSRGRICIESCNLYDGEFREFENGSICVECDPQCEKMEDGLLTCHGPGPDNCTKCSHFKDGPNCVEKCPDGLQGANSFIFKYADPDRECHPCHPNCTQGCNGPTSHDCIYYPWTGHSTLPQHARTPLIAAGVIGGLFILVIVGLTFAVYVRRKSIKKKRALRRFLETELVEPLTPSGTAPNQAQLRILKETELKRVKVLGSGAFGTVYKGIWVPEGETVKIPVAIKILNETTGPKANVEFMDEALIMASMDHPHLVRLLGVCLSPTIQLVTQLMPHGCLLEYVHEHKDNIGSQLLLNWCVQIAKGMMYLEERRLVHRDLAARNVLVKSPNHVKITDFGLARLLEGDEKEYNADGGKMPIKWMALECIHYRKFTHQSDVWSYGVTIWELMTFGGKPYDGIPTREIPDLLEKGERLPQPPICTIDVYMVMVKCWMIDADSRPKFKELAAEFSRMARDPQRYLVIQGDDRMKLPSPNDSKFFQNLLDEEDLEDMMDAEEYLVPQAFNIPPPIYTSRARIDSNRSEIGHSPPPAYTPMSGNQFVYRDGGFAAEQGVSVPYRAPTSTIPEAPVAQGATAEIFDDSCCNGTLRKPVAPHVQEDSSTQRYSADPTVFAPERSPRGELDEEGYMTPMRDKPKQEYLNPVEENPFVSRRKNGDLQALDNPEYHNASNGPPKAEDEYVNEPLYLNTFANTLGKAEYLKNNILSMPEKAKKAFDNPDYWNHSLPPRSTLQHPDYLQEYSTKYFYKQNGRIRPIVAENPEYLSEFSLKPGTVLPPPPYRHRNTVV

SEQ ID NO: 29 - DNA, 4174 bp, Homo sapiens
agtcccgcgaccgaagcagggcgcgcagcagcgctgagtgccccggaacgtgcgtcgcgcccccagtgtccgtcgcgtccgccgcgccccgggcggggatggggcggccagactgagcgccgcacccgccatccagacccgccggccctagccgcagtccctccagccgtggccccagcgcgcacgggcgatggcgaaggcgacgtccggtgccgcggggctgcgtctgctgttgctgctgctgctgccgctgctaggcaaagtggcattgggcctctacttctcgagggatgcttactgggagaagctgtatgtggaccaggcggccggcacgcccttgctgtacgtccatgccctgcgggacgcccctgaggaggtgcccagcttccgcctgggccagcatctctacggcacgtaccgcacacggctgcatgagaacaactggatctgcatccaggaggacaccggcctcctctaccttaaccggagcctggaccatagctcctgggagaagctcagtgtccgcaaccgcggctttcccctgctcaccgtctacctcaaggtcttcctgtcacccacatcccttcgtgagggcgagtgccagtggccaggctgtgcccgcgtatacttctccttcttcaacacctcctttccagcctgcagctccctcaagccccgggagctctgcttcccagagacaaggccctccttccgcattcgggagaaccgacccccaggcaccttccaccagttccgcctgctgcctgtgcagttcttgtgccccaacatcagcgtggcctacaggctcctggagggtgagggtctgcccttccgctgcgccccggacagcctggaggtgagcacgcgctgggccctggaccgcgagcagcgggagaagtacgagctggtggccgtgtgcaccgtgcacgccggcgcgcgcgaggaggtggtgatggtgcccttcccggtgaccgtgtacgacgaggacgactcggcgcccaccttccccgcgggcgtcgacaccgccagcgccgtggtggagttcaagcggaaggaggacaccgtggtggccacgctgcgtgtcttcgatgcagacgtggtacctgcatcaggggagctggtgaggcggtacacaagcacgctgctccccggggacacctgggcccagcagaccttccgggtggaacactggcccaacgagacctcggtccaggccaacggcagcttcgtgcgggcgaccgtacatgactataggctggttctcaaccggaacctctccatctcggagaaccgcaccatgcagctggcggtgctggtcaatgactcagacttccagggcccaggagcgggcgtcctcttgctccacttcaacgtgtcggtgctgccggtcagcctgcacctgcccagtacctactccctctccgtgagcaggagggctcgccgatttgcccagatcgggaaagtctgtgtggaaaactgccaggcattcagtggcatcaacgtccagtacaagctgcattcctctggtgccaactgcagcacgctaggggtggtcacctcagccgaggacacctcggggatcctgtttgtgaatgacaccaaggccctgcggcggcccaagtgtgccgaacttcactacatggtggtggccaccgaccagcagacctctaggcaggcccaggcccagctgcttgtaacagtggaggggtcatatgtggccgaggaggcgggctgccccctgtcctgtgcagtcagcaagagacggctggagtgtgaggagtgtggcggcctgggctccccaacaggcaggtgtgagtggaggcaaggagatggcaaagggatcaccaggaacttctccacctgctctcccagcaccaagacctgccccgacggccactgcgatgttgtggagacccaagacatcaacatttgccctcaggactgcctccggggcagcattgttgggggacacgagcctggggagccccgggggattaaagctggctatggcacctgcaactgcttccctgaggaggagaagtgcttctgcgagcccgaagacatccaggatccactgtgcgacgagctgtgccgcacggtgatcgcagccgctgtcctcttctccttcatcgtctcggtgctgctgtctgccttctgcatccactgctaccacaagtttgcccacaagccacccatctcctcagctgagatgaccttccggaggcccgcccaggccttcccggtcagctactcctcttccggtgcccgccggccctcgctggactccatggagaaccaggtctccgtggatgccttcaagatcctggaggatccaaagtgggaattccctcggaagaacttggttcttggaaaaactctaggagaaggcgaatttggaaaagtggtcaaggcaacggccttccatctgaaaggcagagcagggtacaccacggtggccgtgaagatgctgaaagagaacgcctccccgagtgagcttcgagacctgctgtcagagttcaacgtcctgaagcaggtcaaccacccacatgtcatcaaattgtatggggcctgcagccaggatggcccgctcctcctcatcgtggagtacgccaaatacggctccctgcggggcttcctccgcgagagccgcaaagtggggcctggctacctgggcagtggaggcagccgcaactccagctccctggaccacccggatgagcgggccctcaccatgggcgacctcatctcatttgcctggcagatctcacaggggatgcagtatctggccgagatgaagctcgttcatcgggacttggcagccagaaacatcctggtagctgaggggcggaagatgaagatttcggatttcggcttgtcccgagatgtttatgaagaggattcctacgtgaagaggagccagggtcggattccagttaaatggatggcaattgaatccctttttgatcatatctacaccacgcaaagtgatgtatggtcttttggtgtcctgctgtgggagatcgtgaccctagggggaaacccctatcctgggattcctcctgagcggctcttcaaccttctgaagaccggccaccggatggagaggccagacaactgcagcgaggagatgtaccgcctgatgctgcaatgctggaagcaggagccggacaaaaggccggtgtttgcggacatcagcaaagacctggagaagatgatggttaagaggagagactacttggaccttgcggcgtccactccatctgactccctgatttatgacgacggcctctcagaggaggagacaccgctggtggactgtaataatgcccccctccctcgagccctcccttccacatggattgaaaacaaactctatggtagaatttcccatgcatttactagattctagcaccgctgtcccctctgcactatccttcctctctgtgatgctttttaaaaatgtttctggtctgaacaaaaccaaagtctgctctgaacctttttatttgtaaatgtctgactttgcatccagtttacatttaggcattattgcaactatgtttttctaaaaggaagtgaaaataagtgtaattaccacattgcccagcaacttaggatggtagaggaaaaaacagatcagggcggaactctcaggggagaccaagaacaggttgaataaggcgcttctggggtgggaatcaagtcatagtacttctactttaactaagtggataaatatacaaatctggggaggtattcagttgagaaaggagccaccagcaccactcagcctgcactgggagcacagccaggttcccccagacccctcctgggcaggcaggtgcctctcagaggccacccggcactggcgagcagccactggccaagcctcagccccagtcccagccacatgtcctccatcaggggtagcgaggttgcaggagctggctggccctgggaggacgcacccccactgctgttttcacatcctttcccttacccaccttcaggacggttgtcacttatgaagtcagtgctaaagctggagcagttgctttttgaaagaacatggtctgtggtgctgtggtcttacaatggacagtaaatatggttcttgccaaaactccttcttttgtctttgattaaatactagaaatttaaaaaaaaaaaaaaa

SEQ ID NO: 30 - protein, 1072 aa, Homo sapiens
MAKATSGAAGLRLLLLLLLPLLGKVALGLYFSRDAYWEKLYVDQAAGTPLLYVHALRDAPEEVPSFRLGQHLYGTYRTRLHENNWICIQEDTGLLYLNRSLDHSSWEKLSVRNRGFPLLTVYLKVFLSPTSLREGECQWPGCARVYFSFFNTSFPACSSLKPRELCFPETRPSFRIRENRPPGTFHQFRLLPVQFLCPNISVAYRLLEGEGLPFRCAPDSLEVSTRWALDREQREKYELVAVCTVHAGAREEVVMVPFPVTVYDEDDSAPTFPAGVDTASAVVEFKRKEDTVVATLRVFDADVVPASGELVRRYTSTLLPGDTWAQQTFRVEHWPNETSVQANGSFVRATVHDYRLVLNRNLSISENRTMQLAVLVNDSDFQGPGAGVLLLHFNVSVLPVSLHLPSTYSLSVSRRARRFAQIGKVCVENCQAFSGINVQYKLHSSGANCSTLGVVTSAEDTSGILFVNDTKALRRPKCAELHYMVVATDQQTSRQAQAQLLVTVEGSYVAEEAGCPLSCAVSKRRLECEECGGLGSPTGRCEWRQGDGKGITRNFSTCSPSTKTCPDGHCDVVETQDINICPQDCLRGSIVGGHEPGEPRGIKAGYGTCNCFPEEEKCFCEPEDIQDPLCDELCRTVIAAAVLFSFIVSVLLSAFCIHCYHKFAHKPPISSAEMTFRRPAQAFPVSYSSSGARRPSLDSMENQVSVDAFKILEDPKWEFPRKNLVLGKTLGEGEFGKVVKATAFHLKGRAGYTTVAVKMLKENASPSELRDLLSEFNVLKQVNHPHVIKLYGACSQDGPLLLIVEYAKYGSLRGFLRESRKVGPGYLGSGGSRNSSSLDHPDERALTMGDLISFAWQISQGMQYLAEMKLVHRDLAARNILVAEGRKMKISDFGLSRDVYEEDSYVKRSQGRIPVKWMAIESLFDHIYTTQSDVWSFGVLLWEIVTLGGNPYPGIPPERLFNLLKTGHRMERPDNCSEEMYRLMLQCWKQEPDKRPVFADISKDLEKMMVKRRDYLDLAASTPSDSLIYDDGLSEEETPLVDCNNAPLPRALPSTWIENKLYGRISHAFTRF

SEQ ID NO: 31 - DNA, 5911 bp, Homo sapiens
agatgcaggggcgcaaacgccaaaggagaccaggctgtaggaagagaagggcagagcgccggacagctcggcccgctccccgtcctttggggccgcggctggggaactacaaggcccagcaggcagctgcagggggcggaggcggaggagggaccagcgcgggtgggagtgagagagcgagccctcgcgccccgccggcgcatagcgctcggagcgctcttgcggccacaggcgcggcgtcctcggcggcgggcggcagctagcgggagccgggacgccggtgcagccgcagcgcgcggaggaacccgggtgtgccgggagctgggcggccacgtccggacgggaccgagacccctcgtagcgcattgcggcgacctcgccttccccggccgcgagcgcgccgctgcttgaaaagccgcggaacccaaggacttttctccggtccgagctcggggcgccccgcagggcgcacggtacccgtgctgcagtcgggcacgccgcggcgccggggcctccgcagggcgatggagcccggtctgcaaggaaagtgaggcgccgccgctgcgttctggaggaggggggcacaaggtctggagaccccgggtggcggacgggagccctccccccgccccgcctccggggcaccagctccggctccattgttcccgcccgggctggaggcgccgagcaccgagcgccgccgggagtcgagcgccggccgcggagctcttgcgaccccgccaggacccgaacagagcccgggggcggcgggccggagccggggacgcgggcacacgcccgctcgcacaagccacggcggactctcccgaggcggaacctccacgccgagcgagggtcagtttgaaaaggaggatcgagctcactgtggagtatccatggagatgtggagccttgtcaccaacctctaactgcagaactgggatgtggagctggaagtgcctcctcttctgggctgtgctggtcacagccacactctgcaccgctaggccgtccccgaccttgcctgaacaagcccagccctggggagcccctgtggaagtggagtccttcctggtccaccccggtgacctgctgcagcttcgctgtcggctgcgggacgatgtgcagagcatcaactggctgcgggacggggtgcagctggcggaaagcaaccgcacccgcatcacaggggaggaggtggaggtgcaggactccgtgcccgcagactccggcctctatgcttgcgtaaccagcagcccctcgggcagtgacaccacctacttctccgtcaatgtttcagatgctctcccctcctcggaggatgatgatgatgatgatgactcctcttcagaggagaaagaaacagataacaccaaaccaaaccccgtagctccatattggacatccccagaaaagatggaaaagaaattgcatgcagtgccggctgccaagacagtgaagttcaaatgcccttccagtgggaccccaaaccccacactgcgctggttgaaaaatggcaaagaattcaaacctgaccacagaattggaggctacaaggtccgttatgccacctggagcatcataatggactctgtggtgccctctgacaagggcaactacacctgcattgtggagaatgagtacggcagcatcaaccacacataccagctggatgtcgtggagcggtcccctcaccggcccatcctgcaagcagggttgcccgccaacaaaacagtggccctgggtagcaacgtggagttcatgtgtaaggtgtacagtgacccgcagccgcacatccagtggctaaagcacatcgaggtgaatgggagcaagattggcccagacaacctgccttatgtccagatcttgaagactgctggagttaataccaccgacaaagagatggaggtgcttcacttaagaaatgtctcctttgaggacgcaggggagtatacgtgcttggcgggtaactctatcggactctcccatcactctgcatggttgaccgttctggaagccctggaagagaggccggcagtgatgacctcgcccctgtacctggagatcatcatctattgcacaggggccttcctcatctcctgcatggtggggtcggtcatcgtctacaagatgaagagtggtaccaagaagagtgacttccacagccagatggctgtgcacaagctggccaagagcatccctctgcgcagacaggtaacagtgtctgctgactccagtgcatccatgaactctggggttcttctggttcggccatcacggctctcctccagtgggactcccatgctagcaggggtctctgagtatgagcttcccgaagaccctcgctgggagctgcctcgggacagactggtcttaggcaaacccctgggagagggctgctttgggcaggtggtgttggcagaggctatcgggctggacaaggacaaacccaaccgtgtgaccaaagtggctgtgaagatgttgaagtcggacgcaacagagaaagacttgtcagacctgatctcagaaatggagatgatgaagatgatcgggaagcataagaatatcatcaacctgctgggggcctgcacgcaggatggtcccttgtatgtcatcgtggagtatgcctccaagggcaacctgcgggagtacctgcaggcccggaggcccccagggctggaatactgctacaaccccagccacaacccagaggagcagctctcctccaaggacctggtgtcctgcgcctaccaggtggcccgaggcatggagtatctggcctccaagaagtgcatacaccgagacctggcagccaggaatgtcctggtgacagaggacaatgtgatgaagatagcagactttggcctcgcacgggacattcaccacatcgactactataaaaagacaaccaacggccgactgcctgtgaagtggatggcacccgaggcattatttgaccggatctacacccaccagagtgatgtgtggtctttcggggtgctcctgtgggagatcttcactctgggcggctccccataccccggtgtgcctgtggaggaacttttcaagctgctgaaggagggtcaccgcatggacaagcccagtaactgcaccaacgagctgtacatgatgatgcgggactgctggcatgcagtgccctcacagagacccaccttcaagcagctggtggaagacctggaccgcatcgtggccttgacctccaaccaggagtacctggacctgtccatgcccctggaccagtactcccccagctttcccgacacccggagctctacgtgctcctcaggggaggattccgtcttctctcatgagccgctgcccgaggagccctgcctgccccgacacccagcccagcttgccaatggcggactcaaacgccgctgactgccacccacacgccctccccagactccaccgtcagctgtaaccctcacccacagcccctgctgggcccaccacctgtccgtccctgtcccctttcctgctggcaggagccggctgcctaccaggggccttcctgtgtggcctgccttcaccccactcagctcacctctccctccacctcctctccacctgctggtgagaggtgcaaagaggcagatctttgctgccagccacttcatcccctcccagatgttggaccaacacccctccctgccaccaggcactgcctggagggcagggagtgggagccaatgaacaggcatgcaagtgagagcttcctgagctttctcctgtcggtttggtctgttttgccttcacccataagcccctcgcactctggtggcaggtgccttgtcctcagggctacagcagtagggaggtcagtgcttcgtgcctcgattgaaggtgacctctgccccagataggtggtgccagtggcttattaattccgatactagtttgctttgctgaccaaatgcctggtaccagaggatggtgaggcgaaggccaggttgggggcagtgttgtggccctggggcccagccccaaactgggggctctgtatatagctatgaagaaaacacaaagtgtataaatctgagtatatatttacatgtctttttaaaagggtcgttaccagagatttacccatcgggtaagatgctcctggtggctgggaggcatcagttgctatatattaaaaacaaaaaagaaaaaaaaggaaaatgtttttaaaaaggtcatatattttttgctacttttgctgttttatttttttaaattatgttctaaacctattttcagtttaggtccctcaataaaaattgctgctgcttcatttatctatgggctgtatgaaaagggtgggaatgtccactggaaagaagggacacccacgggccctggggctaggtctgtcccgagggcaccgcatgctcccggcgcaggttccttgtaacctcttcttcctaggtcctgcacccagacctcacgacgcacctcctgcctctccgctgcttttggaaagtcagaaaaagaagatgtctgcttcgagggcaggaaccccatccatgcagtagaggcgctgggcagagagtcaaggcccagcagccatcgaccatggatggtttcctccaaggaaaccggtggggttgggctggggagggggcacctacctaggaatagccacggggtagagctacagtgattaagaggaaagcaagggcgcggttgctcacgcctgtaatcccagcactttgggacaccgaggtgggcagatcacttcaggtcaggagtttgagaccagcctggccaacttagtgaaaccccatctctactaaaaatgcaaaaattatccaggcatggtggcacacgcctgtaatcccagctccacaggaggctgaggcagaatcccttgaagctgggaggcggaggttgcagtgagccgagattgcgccattgcactccagcctgggcaacagagaaaacaaaaaggaaaacaaatgatgaaggtctgcagaaactgaaacccagacatgtgtctgccccctctatgtgggcatggttttgccagtgcttctaagtgcaggagaacatgtcacctgaggctagttttgcattcaggtccctggcttcgtttcttgttggtatgcctccccagatcgtccttcctgtatccatgtgaccagactgtatttgttgggactgtcgcagatcttggcttcttacagttcttcctgtccaaactccatcctgtccctcaggaacggggggaaaattctccgaatgtttttggttttttggctgcttggaatttacttctgccacctgctggtcatcactgtcctcactaagtggattctggctcccccgtacctcatggctcaaactaccactcctcagtcgctatattaaagcttatattttgctggattactgctaaatacaaaagaaagttcaatatgttttcatttctgtagggaaaatgggattgctgctttaaatttctgagctagggattttttggcagctgcagtgttggcgactattgtaaaattctctttgtttctctctgtaaatagcacctgctaacattacaatttgtatttatgtttaaagaaggcatcatttggtgaacagaactaggaaatgaatttttagctcttaaaagcatttgctttgagaccgcacaggagtgtctttccttgtaaaacagtgatgataatttctgccttggccctaccttgaagcaatgttgtgtgaagggatgaagaatctaaaagtcttcataagtccttgggagaggtgctagaaaaatataaggcactatcataattacagtgatgtccttgctgttactactcaaatcacccacaaatttccccaaagactgcgctagctgtcaaataaaagacagtgaaattgacctgaaaaaaaaaaaaaaaaa

SEQ ID NO: 32 - protein, 820 aa, Homo sapiens
MWSWKCLLFWAVLVTATLCTARPSPTLPEQAQPWGAPVEVESFLVHPGDLLQLRCRLRDDVQSINWLRDGVQLAESNRTRITGEEVEVQDSVPADSGLYACVTSSPSGSDTTYFSVNVSDALPSSEDDDDDDDSSSEEKETDNTKPNPVAPYWTSPEKMEKKLHAVPAAKTVKFKCPSSGTPNPTLRWLKNGKEFKPDHRIGGYKVRYATWSIIMDSVVPSDKGNYTCIVENEYGSINHTYQLDVVERSPHRPILQAGLPANKTVALGSNVEFMCKVYSDPQPHIQWLKHIEVNGSKIGPDNLPYVQILKTAGVNTTDKEMEVLHLRNVSFEDAGEYTCLAGNSIGLSHHSAWLTVLEALEERPAVMTSPLYLEIIIYCTGAFLISCMVGSVIVYKMKSGTKKSDFHSQMAVHKLAKSIPLRRQVTVSADSSASMNSGVLLVRPSRLSSSGTPMLAGVSEYELPEDPRWELPRDRLVLGKPLGEGCFGQVVLAEAIGLDKDKPNRVTKVAVKMLKSDATEKDLSDLISEMEMMKMIGKHKNIINLLGACTQDGPLYVIVEYASKGNLREYLQARRPPGLEYCYNPSHNPEEQLSSKDLVSCAYQVARGMEYLASKKCIHRDLAARNVLVTEDNVMKIADFGLARDIHHIDYYKKTTNGRLPVKWMAPEALFDRIYTHQSDVWSFGVLLWEIFTLGGSPYPGVPVEELFKLLKEGHRMDKPSNCTNELYMMMRDCWHAVPSQRPTFKQLVEDLDRIVALTSNQEYLDLSMPLDQYSPSFPDTRSSTCSSGEDSVFSHEPLPEEPCLPRHPAQLANGGLKRR

SEQ ID NO: 33 - DNA, 3381 bp, Homo sapiens
gcggccgcagcgcgcatttgggctccgaggaagttgaccgaggcggctgccgcaggatcccgggcccggatcgcacgaagcccgcgcggccgtctcctccgcgcgccacccctgcgcctcccgcgagctccacttcccatctgctattgtttccgattgttttccggtggcgagcccggctccgaaacttacaaagtgttggatgtcccccgttcgaactgagggactgcagaccgcctctgggtagctggatgaagcccaccccgtccccttctggtaccaaagtgcttactcctctccaaagtgccgtgtctgaactgccgctgggaagaagcggctcctgagacgcgcccacacctttcacctgccgcgcgcttccccctcctcggccaccttcccggcggaagcagcgaggagggagccccctttggccgtcctccgtggaaccggttttccgaggctggcaaaagccgaggctggatttgggggaggaatattagactcggaggagtctgcgcgcttttctcctccccgcgcctcccggtcgccgcgggttcaccgctcagtccccgcgctcgctccgcaccccacccacttcctgtgctcgcccggggggcgtgtgccgtgcggctgccggagttcggggaagttgtggctgtcgagaatgggggtctgtgggtacctgttcctgccctggaagtgcctcgtggtcgtgtctctcaggctgctgttccttgtacccacaggagtgcccgtgcgcagcggagatgccaccttccccaaagctatggacaacgtgacggtccggcagggggagagcgccaccctcaggtgcactattgacaaccgggtcacccgggtggcctggctaaaccgcagcaccatcctctatgctgggaatgacaagtggtgcctggatcctcgcgtggtccttctgagcaacacccaaacgcagtacagcatcgagatccagaacgtggatgtgtatgacgagggcccttacacctgctcggtgcagacagacaaccacccaaagacctctagggtccacctcattgtgcaagtatctcccaaaattgtagagatttcttcagatatctccattaatgaagggaacaatattagcctcacctgcatagcaactggtagaccagagcctacggttacttggagacacatctctcccaaagcggttggctttgtgagtgaagacgaatacttggaaattcagggcatcaccagggagcagtcaggggactacgagtgcagtgcctccaatgacgtggccgcgcccgtggtacggagagtaaaggtcaccgtgaactatccaccatacatttcagaagccaagggtacaggtgtccccgtgggacaaaaggggacactgcagtgtgaagcctcagcagtcccctcagcagaattccagtggtacaaggatgacaaaagactgattgaaggaaagaaaggggtgaaagtggaaaacagacctttcctctcaaaactcatcttcttcaatgtctctgaacatgactatgggaactacacttgcgtggcctccaacaagctgggccacaccaatgccagcatcatgctatttggtccaggcgccgtcagcgaggtgagcaacggcacgtcgaggagggcaggctgcgtctggctgctgcctcttctggtcttgcacctgcttctcaaattttgatgtgagtgccacttccccacccgggaaaggctgccgccaccaccaccaccaacacaacagcaatggcaacaccgacagcaaccaatcagatatatacaaatgaaattagaagaaacacagcctcatgggacagaaatttgagggaggggaacaaagaatactttggggggaaaaaagttttaaaaaagaaattgaaaattgccttgcagatatttaggtacaatggagttttcttttcccaaacgggaagaacacagcacacccggcttggacccactgcaagctgcatcgtgcaacctctttggtgccagtgtgggcaagggctcagcctctctgcccacagagtgcccccacgtggaacattctggagctggccatcccaaattcaatcagtccatagagacgaacagaatgagaccttccggcccaagcgtggcgctgcgggcactttggtagactgtgccaccacggcgtgtgttgtgaaacgtgaaataaaaagagcaagaaagaaaaaggaaacaaaataagaccgtctgacagcaacaacggtcccacaaacaagtcacaaaagataccgttaaacttttttttttttttatcattttactacatgaacatcatggataacaagggattctgattcattattaatttcattaattatattttctgatatgagtctagaacttactgcaaaaacaagacaaaactaaaaaaatacaactgagaagggtgaagagaagtatgtttgttaaacagtaaaaatgaatagtatacttcttaactaggtttacaactggtggaccacacaccaggcactaatcacctggtgaggatttggcatatccaccaaaaaatgcatccgatttaaccaacatctccaccagcgctacggactcctcccaattctgacatctcttgcagacaatactatgctctctacacactgtttagaaatggaaaggtgatctgcactgtatcttgggtttgttggctatgcttcctttgatgacatatattatacagtatatatatacatatattttttttgttagagttctagccattttatttctccgcagggtcctttctcagacattactgcatgctgtatatggcgttagctgtgtgttgatcttctaaaagatgatagagtttactggtaattgtgtaatcagctcctgcctttttattttcttgggttatttacatgtcagagacatttataaaaagtgaaaggataaaaaaaaaaaaaaacaactaataccgggcgcagcatctttccaggtgtggctctgcgctaggccaccccaggtggccccgctttctccattctgccctgtggcgttaacagacagcaagcagctgaacaagcagtaccgtcagtacccacttgctttagcccattatgggaatctctgatgcctttgtgaccactggagagtttaatcctcttggtttattttatttcccacctttgtgtgagtgtgtatgaaagagaagaaaatgcaatttttaggtaatcttttttttttttcccctcccctgaaagtctgggaacctgagagtcctcggggaggggtcctggatgtgatgagggaaagggggattgggggatccgggagggtggggttgtctctgacttgacattaaaaagtgttccatgtccctcttcaaaaaaa

SEQ ID NO: 34 - protein, 344 aa, Homo sapiens
MGVCGYLFLPWKCLVVVSLRLLFLVPTGVPVRSGDATFPKAMDNVTVRQGESATLRCTIDNRVTRVAWLNRSTILYAGNDKWCLDPRVVLLSNTQTQYSIEIQNVDVYDEGPYTCSVQTDNHPKTSRVHLIVQVSPKIVEISSDISINEGNNISLTCIATGRPEPTVTWRHISPKAVGFVSEDEYLEIQGITREQSGDYECSASNDVAAPVVRRVKVTVNYPPYISEAKGTGVPVGQKGTLQCEASAVPSAEFQWYKDDKRLIEGKKGVKVENRPFLSKLIFFNVSEHDYGNYTCVASNKLGHTNASIMLFGPGAVSEVSNGTSRRAGCVWLLPLLVLHLLLKF

SEQ ID NO: 35 - DNA, 3562 bp, Homo sapiens
atcattcattcttttgcctggagttttgtgaggtacccgcttgctttatgggaaaaggctgctccggaactgccctactttagactttttcatggttatcaatctgtacaaagaatcaccaaactgataaagcaggaaccagagggcaaatcacgctgccaagacaactgtgtaattcgctcgaaaaagaaacgatggagtctcgctctgtcacccaggctggagtatagtggtgtgatcttggctcactgcaacctctgcctcccaggttcaagcgattctcctgcctcagcctctcgagtagctggaattacaggtctggcagaaggaacagtatcaactgactgagtaggtctcattggcagttgtgattcagagacctagaaagctgaacccacggctggcaagaagaggatggtttgtgggacctgggctgatgtctgatgaaattttaagccccagctatagctactacaaagaaaagtggctgatgataagcatgtaactcaaaaagacaatgtatataaaaatatgcaagaatcacaggaaacccacatatccaaccacctagatgaagttgttgctgctgttagcatcactcatagaaagaagttccaaaacaagctgcttcagacagcactattccagcctcctcgagagaaactccacctctgtgaagagaaagcaaagtcctattccaacagtcatgagtacaaacaggccgtccatgagcttgtgcgttgcgtagcactgacaagaatttgctatggagactcacattggaaactagcagaggcacatgttaatctggctcaaggctacctccagctgaaaggactgtcactgcaagcaaaacaacatgcagaaaaagccagacaaatcctcgccaactccattgtgcctccctatagtgagaatacagatgttttcaagttttccattgagcttttccataccatgggcagagctttactctcccttcaaaaatttaaggaagctgcagagaatttgacaaaagcagagagactttcaaaggagctgctacaatgtggaagaattataaaggaagaatggatagaaattgaagcacggatcagattatcatttgcacaggtgtatcaaggtcagaagaagtcaaaagaagctttgtcccactatcaagcagctttggaatatgttgagatcagtaaaggtgaaacaagtcgtgagtgtgtacccatattgagagaattagcaggtgtagagcaagccctgggactccacgatgtatccatcaaccacttcctccaggcacatcttatcatcctgagtagaagcccctctcaagtggaggcagcagactcggcacacatcgtcgcccatgctgctgtcgcttcagggagacacgagcaccatgatgtagctgagcagtattttcaagagagcatggctcatcttaaggattctgaagggatgggaagaaccaaatttctttcaattcaagatgaattttgccattttctacaaatgactggacaaaaagagagagcaacctcgatcctgagagagtccctggaagccaaagtggaagcatttggcgatttcagtcccgaggtggcagagacataccggctcctgggaggagcagacctggcgcaggggaaccacagtggggcccgcaagaaactgaagaagtgtctccagatccagaccctcttatatggaccgcaggacaaaaggactctggccacccagcaggccatgggcatgctgtccacggcccccaaggttgcttcgaagccaaggcaggcatcaaaagccaaagtggccttctgcaccagcatccctcaggacaccctgctggggaaggcccggcccggcacaacagcagactgaggcccccaccctgaaaaagcctaggacattcctgggcactgtcatttagggtgctgtacaaatcacctccgcctagaaaatggaattcaacagtcaggatacagatttccaaggccaactgttggccccaacatgcaacagtgagaccataagcctcccgtgggccacattttgacagtggatgcccttcagggtgatatatgctataaagcagttttctatcacctaagtggtttttcttgccaacaagaatttttacccatcagcactactgtggctgaaaaacttctcttcaacagttcagtgcgccctgtgcaggagtcagcccggcatctgcttgtacacacagctccttgcataggtgtggagttagatctggacagtgaacttcaggaagtcctttcttataggaggctaatagggattgagaataacatgagaagaaaacgctaataaagggaaacctgaacacgctgctgtcagcatgtgttttcaaagtgcagcctgcctcagagttcttcggagcctgaaaaggggtttgagaaagagcccagtaggaggggcaggaggccgacacacctgacttggcctggggcccaggaggcaggtgtaagggagtgaaaagaaaggctagccggaggctgcggggggaagaccgcagactccctgctgcttcgcatccctcctgtggcctccactgcaggcaggacaaacctggatgccacctggagctgcttcctgagttggcacactatcgtgtacacagcagtcttcagccccctggaaggaggccatagtcgtgtgaggatggcaaagtcgaacaggaagctttgagtgccttcctccacgatgtcaacgaggagatccagtgccagatcgaggtggatggaacacccaggggtaggggtgcaggtgtgggcagtgatgtcccttcccctccctcccctggtcccacagactgtggccatgaggctgcaggctggtgctatgacagcagattgcagcacagggccctcccctccagcccccagtgggacatcaaaaccaccctggggccatttgtgcagggcaccacctccagtattgatggggaaaataaactcagtagagccacgacagggtggagagaagcagggaccattgtcttcctcaggagcgtgacagctgaccccacagaccatgcttgctggtacacactggtcccagacccaggcctgtcggacatcagcagtgtgctaaaaacgtgtaagatgtcactactcaccgtgtgtcctatctagttgacatgggtggagtcagctaaggggtgaatgttcatatgctcccaattcacgttgaagccctaatccccaaagggatggtattgggggtggggtcttggagaggtgattaggttatgagggtggagccctgatgaatgggattagtgctttataaggagagacaccagagagatgatctctctctccaccatgtgaggacacagtgagaagacagccgtctgcaggcccggaagagagccctcaccaggaaatgaaactgttggcaccttgagacttcccagcttccagaactgtaagaaataaatgtttgttgtttaagcctttcaggctacggctttctgttacagcagcctgaactgagagtccatgccgagtttttgaaataaatgtgaattctgatgtta

SEQ ID NO: 36 - protein, 447 aa, Homo sapiens
MQESQETHISNHLDEVVAAVSITHRKKFQNKLLQTALFQPPREKLHLCEEKAKSYSNSHEYKQAVHELVRCVALTRICYGDSHWKLAEAHVNLAQGYLQLKGLSLQAKQHAEKARQILANSIVPPYSENTDVFKFSIELFHTMGRALLSLQKFKEAAENLTKAERLSKELLQCGRIIKEEWIEIEARIRLSFAQVYQGQKKSKEALSHYQAALEYVEISKGETSRECVPILRELAGVEQALGLHDVSINHFLQAHLIILSRSPSQVEAADSAHIVAHAAVASGRHEHHDVAEQYFQESMAHLKDSEGMGRTKFLSIQDEFCHFLQMTGQKERATSILRESLEAKVEAFGDFSPEVAETYRLLGGADLAQGNHSGARKKLKKCLQIQTLLYGPQDKRTLATQQAMGMLSTAPKVASKPRQASKAKVAFCTSIPQDTLLGKARPGTTAD

SEQ ID NO: 37 - DNA, 11242 bp, Homo sapiens
ttttttttttttttttttgagaaaggggaatttcatcccaaataaaaggaatgaagtctggctccggaggagggtccccgacctcgctgtgggggctcctgtttctctccgccgcgctctcgctctggccgacgagtggagaaatctgcgggccaggcatcgacatccgcaacgactatcagcagctgaagcgcctggagaactgcacggtgatcgagggctacctccacatcctgctcatctccaaggccgaggactaccgcagctaccgcttccccaagctcacggtcattaccgagtacttgctgctgttccgagtggctggcctcgagagcctcggagacctcttccccaacctcacggtcatccgcggctggaaactcttctacaactacgccctggtcatcttcgagatgaccaatctcaaggatattgggctttacaacctgaggaacattactcggggggccatcaggattgagaaaaatgctgacctctgttacctctccactgtggactggtccctgatcctggatgcggtgtccaataactacattgtggggaataagcccccaaaggaatgtggggacctgtgtccagggaccatggaggagaagccgatgtgtgagaagaccaccatcaacaatgagtacaactaccgctgctggaccacaaaccgctgccagaaaatgtgcccaagcacgtgtgggaagcgggcgtgcaccgagaacaatgagtgctgccaccccgagtgcctgggcagctgcagcgcgcctgacaacgacacggcctgtgtagcttgccgccactactactatgccggtgtctgtgtgcctgcctgcccgcccaacacctacaggtttgagggctggcgctgtgtggaccgtgacttctgcgccaacatcctcagcgccgagagcagcgactccgaggggtttgtgatccacgacggcgagtgcatgcaggagtgcccctcgggcttcatccgcaacggcagccagagcatgtactgcatcccttgtgaaggtccttgcccgaaggtctgtgaggaagaaaagaaaacaaagaccattgattctgttacttctgctcagatgctccaaggatgcaccatcttcaagggcaatttgctcattaacatccgacgggggaataacattgcttcagagctggagaacttcatggggctcatcgaggtggtgacgggctacgtgaagatccgccattctcatgccttggtctccttgtccttcctaaaaaaccttcgcctcatcctaggagaggagcagctagaagggaattactccttctacgtcctcgacaaccagaacttgcagcaactgtgggactgggaccaccgcaacctgaccatcaaagcagggaaaatgtactttgctttcaatcccaaattatgtgtttccgaaatttaccgcatggaggaagtgacggggactaaagggcgccaaagcaaaggggacataaacaccaggaacaacggggagagagcctcctgtgaaagtgacgtcctgcatttcacctccaccaccacgtcgaagaatcgcatcatcataacctggcaccggtaccggccccctgactacagggatctcatcagcttcaccgtttactacaaggaagcaccctttaagaatgtcacagagtatgatgggcaggatgcctgcggctccaacagctggaacatggtggacgtggacctcccgcccaacaaggacgtggagcccggcatcttactacatgggctgaagccctggactcagtacgccgtttacgtcaaggctgtgaccctcaccatggtggagaacgaccatatccgtggggccaagagtgagatcttgtacattcgcaccaatgcttcagttccttccattcccttggacgttctttcagcatcgaactcctcttctcagttaatcgtgaagtggaaccctccctctctgcccaacggcaacctgagttactacattgtgcgctggcagcggcagcctcaggacggctacctttaccggcacaattactgctccaaagacaaaatccccatcaggaagtatgccgacggcaccatcgacattgaggaggtcacagagaaccccaagactgaggtgtgtggtggggagaaagggccttgctgcgcctgccccaaaactgaagccgagaagcaggccgagaaggaggaggctgaataccgcaaagtctttgagaatttcctgcacaactccatcttcgtgcccagacctgaaaggaagcggagagatgtcatgcaagtggccaacaccaccatgtccagccgaagcaggaacaccacggccgcagacacctacaacatcaccgacccggaagagctggagacagagtaccctttctttgagagcagagtggataacaaggagagaactgtcatttctaaccttcggcctttcacattgtaccgcatcgatatccacagctgcaaccacgaggctgagaagctgggctgcagcgcctccaacttcgtctttgcaaggactatgcccgcagaaggagcagatgacattcctgggccagtgacctgggagccaaggcctgaaaactccatctttttaaagtggccggaacctgagaatcccaatggattgattctaatgtatgaaataaaatacggatcacaagttgaggatcagcgagaatgtgtgtccagacaggaatacaggaagtatggaggggccaagctaaaccggctaaacccggggaactacacagcccggattcaggccacatctctctctgggaatgggtcgtggacagatcctgtgttcttctatgtccaggccaaaacaggatatgaaaacttcatccatctgatcatcgctctgcccgtcgctgtcctgttgatcgtgggagggttggtgattatgctgtacgtcttccatagaaagagaaataacagcaggctggggaatggagtgctgtatgcctctgtgaacccggagtacttcagcgctgctgatgtgtacgttcctgatgagtgggaggtggctcgggagaagatcaccatgagccgggaacttgggcaggggtcgtttgggatggtctatgaaggagttgccaagggtgtggtgaaagatgaacctgaaaccagagtggccattaaaacagtgaacgaggccgcaagcatgcgtgagaggattgagtttctcaacgaagcttctgtgatgaaggagttcaattgtcaccatgtggtgcgattgctgggtgtggtgtcccaaggccagccaacactggtcatcatggaactgatgacacggggcgatctcaaaagttatctccggtctctgaggccagaaatggagaataatccagtcctagcacctccaagcctgagcaagatgattcagatggccggagagattgcagacggcatggcatacctcaacgccaataagttcgtccacagagaccttgctgcccggaattgcatggtagccgaagatttcacagtcaaaatcggagattttggtatgacgcgagatatctatgagacagactattaccggaaaggagggaaagggctgctgcccgtgcgctggatgtctcctgagtccctcaaggatggagtcttcaccacttactcggacgtctggtccttcggggtcgtcctctgggagatcgccacactggccgagcagccctaccagggcttgtccaacgagcaagtccttcgcttcgtcatggagggcggccttctggacaagccagacaactgtcctgacatgctgtttgaactgatgcgcatgtgctggcagtataaccccaagatgaggccttccttcctggagatcatcagcagcatcaaagaggagatggagcctggcttccgggaggtctccttctactacagcgaggagaacaagctgcccgagccggaggagctggacctggagccagagaacatggagagcgtccccctggacccctcggcctcctcgtcctccctgccactgcccgacagacactcaggacacaaggccgagaacggccccggccctggggtgctggtcctccgcgccagcttcgacgagagacagccttacgcccacatgaacgggggccgcaagaacgagcgggccttgccgctgccccagtcttcgacctgctgatccttggatcctgaatctgtgcaaacagtaacgtgtgcgcacgcgcagcggggtggggggggagagagagttttaacaatccattcacaagcctcctgtacctcagtggatcttcagaactgcccttgctgcccgcgggagacagcttctctgcagtaaaacacatttgggatgttccttttttcaatatgcaagcagctttttattccctgcccaaacccttaactgacatgggcctttaagaaccttaatgacaacacttaatagcaacagagcacttgagaaccagtctcctcactctgtccctgtccttccctgttctccctttctctctcctctctgcttcataacggaaaaataattgccacaagtccagctgggaagccctttttatcagtttgaggaagtggctgtccctgtggccccatccaaccactgtacacacccgcctgacaccgtgggtcattacaaaaaaacacgtggagatggaaatttttacctttatctttcacctttctagggacatgaaatttacaaagggccatcgttcatccaaggctgttaccattttaacgctgcctaattttgccaaaatcctgaactttctccctcatcggcccggcgctgattcctcgtgtccggaggcatgggtgagcatggcagctggttgctccatttgagagacacgctggcgacacactccgtccatccgactgcccctgctgtgctgctcaaggccacaggcacacaggtctcattgcttctgactagattattatttgggggaactggacacaataggtctttctctcagtgaaggtggggagaagctgaaccggcttccctgccctgcctccccagccccctgcccaacccccaagaatctggtggccatgggccccgaagcagcctggcggacaggcttggagtcaaggggccccatgcctgcttctctcccagccccagctcccccgcccgcccccaaggacacagatgggaaggggtttccagggactcagccccactgttgatgcaggtttgcaaggaaagaaattcaaacaccacaacagcagtaagaagaaaagcagtcaatggattcaagcattctaagctttgttgacattttctctgttcctaggacttcttcatgggtcttacagttctatgttagaccatgaaacatttgcatacacatcgtctttaatgtcacttttataacttttttacggttcagatattcatctatacgtctgtacagaaaaaaaaaagctgctattttttttgttcttgatctttgtggatttaatctatgaaaaccttcaggtccaccctctcccctttctgctcactccaagaaacttcttatgctttgtactagagtgcgtgactttcttcctcttttcccggtaatggatacttctatcacataatttgccatgaactgttggatgcctttttataaatacatcccccatccctgctcccacctgcccctttagttgttttctaacccgtaggctctctgggcacgaggcagaaagcaggccgggcacccatcctgagagggccgcgctcctctccccagcctgccctcacagcattggagcctgttacagtgcaagacatgatacaaactcaggtcagaaaaacaaaggttaaatatttcacacgtctttgttcagtgtttccactcaccgtggttgagaagcctcaccctctctttcccttgcctttgcttaggttgtgacacacatatatatatatttttttaattcttgggtacaacagcagtgttaaccgcagacactaggcatttggattactatttttcttaatggctatttaatccttccatcccacgaaaaacagctgctgagtccaagggagcagcagagcgtggtccggcagggcctgttgtggccctcgccacccccctcaccggaccgactgacctgtctttggaaccagaacatcccaagggaactccttcgcactggcgttgagtgggaccccgggatccaggctggcccagggcggcaccctcagggctgtgcccgctggagtgctaggtggaggcagcacagacgccacggtggcccaagagcccctttgcttcttgctgggggaccagggctgtggtgctggcccactttccctcggccaggaatccaggtccttggggcccaggggtcttgtcttgtttcatttttagcacttctcaccagagagatgacagcacaagagttgcttctgggatagaaatgtttaggagtaagaacaaagctgggatacggtgattgctagttgtgactgaagattcaacacagaaaagaaagtttatacggcttttttgctggtcagcagtttgtcccactgctttctctagtctctatcccatagcgtgttccctttaaaaaaaaaaaaaaggtattatatgtaggagttttcttttaatttattttgtgataaattaccagtttcaatcactgtagaaaagccccattatgaatttaaatttcaaggaaagggtgtgtgtgtgtgtatgtgtggggtgtgtgtgtgtgagagtgatgggacagttcttgattttttgggttttttttcccccaaacatttatctacctcactcttattttttatatgtgtatatagacaaaagaatacatctcacctttctcagcacctgacaataggccgttgatactggtaacctcatccacgccacaggcgccacacccaggtgatgcagggggaagccaggctgtattccggggtcaaagcaacactaactcacctctctgctcatttcagacagcttgcctttttctgagatgtcctgttttgtgttgctttttttgttttgttttctatcttggtttccaccaaggtgttagatttctcctcctcctagccaggtggccctgtgaggccaacgagggcaccagagcacacctgggggagccaccaggctgtccctggctggttgtctttggaacaaactgcttctgtgcagatggaatgaccaacacatttcgtccttaagagagcagtggttcctcaggttctgaggagaggaaggtgtccaggcagcaccatctctgtgcgaatccccagggtaaaggcgtggggcattgggtttgctccccttgctgctgctccatccctgcaggaggctcgcgctgaggcaggaccgtgcggccatggctgctgcattcattgagcacaaaggtgcagctgcagcagcagctggagagcaagagtcacccagcctgtgcgccagaatgcagaggctcctgacctcacagccagtccctgatagaacacacgcaggagcagagtcccctccccctccaggctgccctctcaacttctccctcacctccttccctaggggtagacagagatgtaccaaaccttccggctggaaagcccagtggccggcgccgaggctcgtggcgtcacgccccccccgccagggctgtacctccgtctccctggtcctgctgctcacaggacagacggctcgctcccctcttccagcagctgctcttacaggcactgatgatttcgctgggaagtgtggcgggcagctttgcctaagcgtggatggctcctcggcaattccagcctaagtgaaggcgctcaggagcctcctgctggaacgcgacccatctctcccaggaccccggggatcttaaggtcattgagaaatactgttggatcagggttttgttcttccacactgtaggtgaccccttggaataacggcctctcctctcgtgcacatacctaccggtttccacaactggatttctacagatcattcagctggttataagggttttgtttaaactgtccgagttactgatgtcattttgtttttgttttatgtaggtagcttttaagtagaaaacactaacagtgtagtgcccatcatagcaaatgcttcagaaacacctcaataaaagagaaaacttggcttgtgtgatggtgcagtcactttactggaccaacccacccaccttgactataccaaggcatcatctatccacagttctagcctaacttcatgctgatttctctgcctcttgatttttctctgtgtgttccaaataatcttaagctgagttgtggcattttccatgcaacctccttctgccagcagctcacactgcttgaagtcatatgaaccactgaggcacatcatggaattgatgtgagcattaagacgttctcccacacagcccttccctgaggcagcaggagctggtgtgtactggagacactgttgaacttgatcaagacccagaccaccccaggtctccttcgtgggatgtcatgacgtttgacatacctttggaacgagcctcctccttggaagatggaagaccgtgttcgtggccgacctggcctctcctggcctgtttcttaagatgcggagtcacatttcaatggtacgaaaagtggcttcgtaaaatagaagagcagtcactgtggaactaccaaatggcgagatgctcggtgcacattggggtgctttgggataaaagatttatgagccaactattctctggcaccagattctaggccagtttgttccactgaagcttttcccacagcagtccacctctgcaggctggcagccgaatggcttgccagtggctctgtggcaagatcacactgagatcgatgggtgagaaggctaggatgcttgtctagtgttcttagctgtcacgttggctccttccagggtggccagacggtgttggccactcccttctaaaacacaggcgccctcctggtgacagtgacccgccgtggtatgccttggcccattccagcagtcccagttatgcatttcaagtttggggtttgttcttttcgttaatgttcctctgtgttgtcagctgtcttcatttcctgggctaagcagcattgggagatgtggaccagagatccactccttaagaaccagtggcgaaagacactttctttcttcactctgaagtagctggtggtacaaatgagaacttcaagagaggatgttatttagactgaacctctgttgccagagatgctgaagatacagaccttggacaggtcagagggtttcatttttggccttcatcttagatgactggttgcgtcatttggagaagtgagtgctccttgatggtggaatgaccgggtggtgggtacagaaccattgtcacagggatcctggcacagagaagagttacgagcagcagggtgcagggcttggaaggaatgtgggcaaggttttgaacttgattgttcttgaagctatcagaccacatcgaggctcagcagtcatccgtgggcatttggtttcaacaaagaaacctaacatcctactctggaaactgatctcggagttaaggcgaattgttcaagaacacaaactacatcgcactcgtcagttgtcagttctggggcatgactttagcgttttgtttctgcgagaacataacgatcactcatttttatgtcccacgtgtgtgtgtccgcatctttctggtcaacattgttttaactagtcactcattagcgttttcaatagggctcttaagtccagtagattacgggtagtcagttgacgaagatctggtttacaagaactaattaaatgtttcattgcatttttgtaagaacagaataattttataaaatgtttgtagtttataattgccgaaaataatttaaagacactttttttttctctgtgtgtgcaaatgtgtgtttgtgatccattttttttttttttttttaggacacctgtttactagctagctttacaatatgccaaaaaaggatttctccctgaccccatccgtggttcaccctcttttccccccatgctttttgccctagtttataacaaaggaatgatgatgatttaaaaagtagttctgtatcttcagtatcttggtcttccagaaccctctggttgggaaggggatcattttttactggtcatttccctttggagtgtagctactttaacagatggaaagaacctcattggccatggaaacagccgaggtgttggagcccagcagtgcatggcaccgttcggcatctggcttgattggtctggctgccgtcattgtcagcacagtgccatggacatgggaagacttgactgcacagccaatggttttcatgatgattacagcatacacagtgatcacataaacgatgacagctatggggcacacaggccatttgcttacatgcctcgtatcatgactgattactgctttgttagaacacagaagagaccctattttatttaaggcagaaccccgaagatacgtatttccaatacagaaaagaatttttaataaaaactataacatacacaaaaattggttttaaagttgactccacttcctctaactccagtggattgttggccatgtctccccaactccacaatatctctatcatgggaaacacctggggtttttgcgctacataggagaaagatctggaaactatttgggttttgttttcaacttttcatttggatgtttggcgttgcacacacacatccaccggtggaagagacgcccggtgaaaacacctgtctgctttctaagccagtgaggttgaggtgagaggtttgccagagtttgtctacctctgggtatccctttgtctgggataaaaaaaatcaaaccagaaggcgggatggaatggatgcaccgcaaataatgcattttctgagttttcttgttaaaaaaaaatttttttaagtaagaaaaaaaaaggtaataacatggccaatttgttacataaaatgactttctgtgtataaattattcctaaaaaatcctgtttatataaaaaatcagtagatgaaaaaaatttcaaaatgtttttgtatattctgttgtaagaatttattcctgttattgcgatatactctggattctttacataatggaaaaaagaaactgtctattttgaatggctgaagctaaggcaacgttagtttctcttactctgcttttttctagtaaagtactacatggtttaagttaaataaaataattctgtatgca

SEQ ID NO: 38 - protein, 1367 aa, Homo sapiens
MKSGSGGGSPTSLWGLLFLSAALSLWPTSGEICGPGIDIRNDYQQLKRLENCTVIEGYLHILLISKAEDYRSYRFPKLTVITEYLLLFRVAGLESLGDLFPNLTVIRGWKLFYNYALVIFEMTNLKDIGLYNLRNITRGAIRIEKNADLCYLSTVDWSLILDAVSNNYIVGNKPPKECGDLCPGTMEEKPMCEKTTINNEYNYRCWTTNRCQKMCPSTCGKRACTENNECCHPECLGSCSAPDNDTACVACRHYYYAGVCVPACPPNTYRFEGWRCVDRDFCANILSAESSDSEGFVIHDGECMQECPSGFIRNGSQSMYCIPCEGPCPKVCEEEKKTKTIDSVTSAQMLQGCTIFKGNLLINIRRGNNIASELENFMGLIEVVTGYVKIRHSHALVSLSFLKNLRLILGEEQLEGNYSFYVLDNQNLQQLWDWDHRNLTIKAGKMYFAFNPKLCVSEIYRMEEVTGTKGRQSKGDINTRNNGERASCESDVLHFTSTTTSKNRIIITWHRYRPPDYRDLISFTVYYKEAPFKNVTEYDGQDACGSNSWNMVDVDLPPNKDVEPGILLHGLKPWTQYAVYVKAVTLTMVENDHIRGAKSEILYIRTNASVPSIPLDVLSASNSSSQLIVKWNPPSLPNGNLSYYIVRWQRQPQDGYLYRHNYCSKDKIPIRKYADGTIDIEEVTENPKTEVCGGEKGPCCACPKTEAEKQAEKEEAEYRKVFENFLHNSIFVPRPERKRRDVMQVANTTMSSRSRNTTAADTYNITDPEELETEYPFFESRVDNKERTVISNLRPFTLYRIDIHSCNHEAEKLGCSASNFVFARTMPAEGADDIPGPVTWEPRPENSIFLKWPEPENPNGLILMYEIKYGSQVEDQRECVSRQEYRKYGGAKLNRLNPGNYTARIQATSLSGNGSWTDPVFFYVQAKTGYENFIHLIIALPVAVLLIVGGLVIMLYVFHRKRNNSRLGNGVLYASVNPEYFSAADVYVPDEWEVAREKITMSRELGQGSFGMVYEGVAKGVVKDEPETRVAIKTVNEAASMRERIEFLNEASVMKEFNCHHVVRLLGVVSQGQPTLVIMELMTRGDLKSYLRSLRPEMENNPVLAPPSLSKMIQMAGEIADGMAYLNANKFVHRDLAARNCMVAEDFTVKIGDFGMTRDIYETDYYRKGGKGLLPVRWMSPESLKDGVFTTYSDVWSFGVVLWEIATLAEQPYQGLSNEQVLRFVMEGGLLDKPDNCPDMLFELMRMCWQYNPKMRPSFLEIISSIKEEMEPGFREVSFYYSEENKLPEPEELDLEPENMESVPLDPSASSSSLPLPDRHSGHKAENGPGPGVLVLRASFDERQPYAHMNGGRKNERALPLPQSSTC

SEQ ID NO: 39 - DNA, 7455 bp, Homo sapiens
cccgcctagcatggtgcggcggccgcgcgcgcggacatgggggagaagctggagctgagactgaagtcgcccgtgggggctgagcccgccgtctacccgtggccgctgccggtctacgataaacatcacgatgctgctcatgaaatcatcgagaccatccgatgggtctgtgaagaaatcccggatctcaagctcgctatggagaattacgttttaattgactatgacaccaaaagcttcgagagcatgcagaggctctgcgacaagtacaaccgtgccatcgacagcatccaccagctgtggaagggcaccacgcagcccatgaagctgaacacgcggccgtccactggactcctgcgccatatcctgcagcaggtctacaaccactcggtgaccgaccccgagaagctcaacaactacgagcccttctcccccgaggtgtacggggagacctccttcgacctggtggcccagatgattgatgagatcaagatgaccgacgacgacctgtttgtggacttggggagcggtgtgggccaggtcgtgctccaggttgctgctgccaccaactgcaaacatcactatggcgtcgagaaagcagacatcccggccaagtatgcggagaccatggaccgcgagttcaggaagtggatgaaatggtatggaaaaaagcatgcagaatacacattggagagaggcgatttcctctcagaagagtggagggagcgaatcgccaacacgagtgttatatttgtgaataattttgcctttggtcctgaggtggatcaccagctgaaggagcggtttgcaaacatgaaggaaggtggcagaatcgtgtcctcgaaaccctttgcacctctgaacttcagaataaacagtagaaacttgagtgacatcggcaccatcatgcgcgtggtggagctctcgcccctgaagggctcggtgtcgtggacggggaagccagtctcctactacctgcacactatcgaccgcaccatacttgaaaactatttttctagtctgaaaaacccaaaactcagggaggaacaggaggcagcccggcgccgccagcagcgcgagagcaagagcaacgcggccacgcccactaagggcccagagggcaaggtggccggccccgccgacgcccccatggactctggtgctgaggaagagaaggcgggagcagccaccgtgaagaagccgtctccctccaaagcccgcaagaagaagctaaacaagaaggggaggaagatggctggccgcaagcgcgggcgccccaagaagatgaacactgcgaaccccgagcggaagcccaagaagaaccaaactgcactggatgccctgcacgctcagaccgtgtctcagacggcggcctcctcaccccaggatgcctacagatcccctcacagcccgttctaccagctacctccgagcgtgcagcggcactcccccaacccgctgctggtggcgcccaccccgcccgcgctgcagaagcttctagagtccttcaagatccagtacctgcagttcctggcatacacaaagaccccccagtacaaggccagcctgcaggagctgctgggccaggagaaggagaagaacgcccagctcctgggtgcggctcagcagctcctcagccactgccaggcccagaaggaggagatcaggaggctgtttcagcaaaaattggatgagctgggtgtgaaggcgctgacctacaacgacctgattcaagcgcagaaggagatctccgcccataaccagcagctgcgggagcagtcggagcagctggagcaggacaaccgcgcgctccgcggccagagcttgcagctgctcaaggctcgctgcgaggagctgcagctggactgggccacgctgtcgctggagaagctgttgaaggagaagcaggccctgaagagccagatctcggagaagcagaggcactgcctggagctgcagatcagcattgtggagctagagaagagccagcggcagcaggagctcctgcagctcaagtcctgtgtgccgcctgacgacgccctgtccctgcacctgcgtgggaagggcgccctgggccgcgagctggagcctgacgccagccggctgcacctggagctggactgcaccaagttctcgctgcctcacttgagcagcatgagcccggagctctccatgaacggccaggctgctggctatgagctctgcggtgtgctgagccggccttcgtcgaagcagaacacgccccagtacctggcctcacccctggaccaggaggtggtgccctgtacccctagccacgtcggccggccgcgcctggagaagctgtctggcctagccgcacccgactacactaggctgtccccggccaagattgtgctgaggcggcacctgagccaggaccacacggtgcccggcaggccggctgccagtgagctgcattcgagagctgagcacaccaaggagaacggccttccctaccagagccccagcgtgcctggcagcatgaagctgagccctcaggacccgcggcccctgtcccctggggccttgcagcttgctggagagaagagcagtgagaagggcctgagagagcgcgcctacggcagcagcggggagctcatcaccagcctgcccatcagcatcccgctcagcaccgtgcagcccaacaagctcccggtcagcattcccctggccagcgtggtgctgcccagccgcgccgagagggcgaggagcacccccagtcccgtgctgcagccccgtgacccctcgtccacacttgaaaagcagattggtgctaatgcccacggtgctgggagcagaagccttgccctggcccccgcaggcttctcctacgctggctcggtggccatcagcggggccttggcgggcagcccggcctctctcacacctggagccgagccggccaccttggatgagtcctccagctctgggagcctttttgccaccgtggggtcccgcagctccacgccacagcaccccctgctgctggcacagccccggaactcgcttcctgcctctcccgcccaccagctctcctccagtccccggcttggtggggccgcccagggcccgttgcccgaggccagcaagggagacctgccctccgattccggcttctcagatcctgagagtgaagccaagaggaggattgtgttcaccatcaccactggtgcgggcagtgccaagcagtcgccctccagcaagcacagccccctgaccgccagcgcccgtggggactgtgtgccgagccacgggcaggacagtcgcaggcgcggccggcggaagcgagcatctgcggggacgcccagcttgagcgcaggcgtgtcccccaagcgccgagccctgccgtccgtcgctggccttttcacacagccttcggggtctcccctcaacctcaactccatggtcagtaacatcaaccagcccctggagattacagccatctcgtccccggagacctccctgaagagctcccctgtgccctaccaggaccacgaccagccccccgtgctcaagaaggagcggcctctgagccagaccaatggggcacactactccccactcacctcagacgaggagccaggctctgaggacgagcccagcagtgctcgaattgagagaaaaattgcaacaatctccttagaaagcaaatctcccccgaaaaccttggaaaatggtggtggcttggcgggaaggaagcccgcgcccgccggcgagccagtcaatagcagcaagtggaagtccaccttctcgcccatctccgacatcggcctggccaagtcggcggacagcccgctgcaggccagctccgccctcagccagaactccctgttcacgttccggcccgccctggaggagccctctgccgatgccaagctggccgctcaccccaggaaaggctttcccggctccctgtcgggggctgacggactcagcccgggcaccaaccctgccaacggctgcaccttcggcgggggcctggccgcggacctgagtttacacagcttcagtgatggtgcttctcttccccacaagggccccgaggcggccggcctgagctccccgctgagcttcccctcgcagcgcggcaaggagggctcggacgccaaccctttcctgagcaagaggcagctggacggcctggctgggctgaagggcgagggcagccgcggcaaggaggcaggggagggcggcctaccgctgtgcgggcccacggacaagaccccactgctgagcggcaaggccgccaaggcccgggaccgcgaggtcgacctcaagaatggccacaacctcttcatctctgcggcggccgtgcctcccggaagcctcctcagcggccccggcctggccccggcggcgtcctccgcaggcggcgcggcgtcctccgcccagacgcaccggtccttcctgggccccttcccgccgggaccgcagttcgcgctcggccccatgtccctgcaggccaacctcggctccgtggccggctcctccgtgctgcagtcgctgttcagctctgtgccggccgccgcaggcctggtgcacgtgtcgtccgctgccaccagactgaccaactcgcacgccatgggcagcttttccggggtggcaggcggcacagttggaggtaactaggatttctacctcaaccgcgagacctatgcaaggacggtgtggaccaactcgcgcccgcggcatggtgcccgccggcctgccgggctcccacccctggacggcagaggcaaggacggacgggagctccactgtgaatcggcggcacgcgccgcaggaggctgggactggtccagtttgtactgtcgatagttttagataaagtatttatcattttttaaaaagtataaacaattctgacttattttattccatctaagtggtaaaaggcaacttattgagaaatataaatatctatatatgagagctctatataaagacacgtgtctgcagggcgggcccgccagcggattcgccacagcctgccccggtgctatctcgtccccaggcccgcgcctgcctccacccgcttggtgctgactagacgctgacaacgccgaaccccgttctcggaaacgccgcccggccggctcccccgacgcgctgctcccgtaccaaaggcaggcccgtcgccaccacattcctcggaggcctccccgcggcctgagccccttcctgagcgccctggcgcctgccctgagctcttcacctttaccccggcactgtgaacccccagactgttcaccctccggggcgtgggttgcgcccttgcatgtgaaggggcctgcgcggtgacgcagctggccatgtgctgcgcgatggtgctgtgaggacggcgcgggcacgttgaacaagtgcatttacttttgtatttctcggctgtccatggctcgcagcatgccctgcgatgcggggcaggcctgtcgtgggtcccttggtgtttctgtacaggagagagtcacactaatgagtggcagtattttatagagatgtgatgagaatttataaatttcatagatttgacagcttttatttttagatggtataatgcacagtgaagaggaaagaaaagcgaggggaaaaaaccttatttattcaaacagtgcacaaaatggccccagcgtcagccccgaccctagacccctcagttgcagctcccagcagcccagacagagctgccggcgcccctgcctgccccacatcccttcctgtcagggccacgcctggcacccatcccttggagcctgtgctggttctcccagctgctgtgggtgtgctggggccagggtgcactgctgaaacctggcctctctggccctaggccccagggtgacgtcggccccccactctgcagccttggcgggtgcctgggactgggtgtggaaggagaggagctgaggccggggtgtagcaggcaggcagggccactccagtgcttctggagccctgagcagtcagggcctgggttgtctgagcagtggtggctctgtgccctccctggaggatgggatctgggagtctgagctccccgcatctggccctgggctgtgtggcacttgctgagcccaccttctcaagtgcttgctcctgtgagatggcatcggggagccccttccccaaggtgccacagatccaccctccagggagctgccagccctgtgttctggttcccaagggcaggatggacacacgtcacatccctaccacgtggcctccaaagggagccacggaggaaaggcttctgtggttgctaggtgggggagtcctgtgtgggagggcctgaagacccctgcttgtgcctggtgaggggggtgctgcctcccccagcccccaacaacctctcagacccccaccctccaacatagctgagttctgaagatggtgctccggacctgtcctcttaagtggtgcccagtgccctccccaccccacgttggtgctctcagctagaaggtgctgtgcctctgcctgagccccaagccccgagcctggccttcaggacaggcagcctgctctgtgtcgccacgggccggatacgccacagggttgatggcagagacggccgagtccctggtctagaacaagacacattctttaaacactgtattacttctgcctccctctaggtgacagtggcagtccgggtgccatcacgggtcctgcagatggccatgcagggctcctgcccacgcaggccaccgtatgttcaggacacgcactgggtctcagagccactggcccaggcagaagtctccttgagcccactgggtcatatgcgtgtcaccacacgtgaactagtgtggtggctgcctgcggacaccctcctgttctgagccctgggcctgtgttcttctcagacactcccagactgaggggtggtgtgtggcgggtggcagggtggctgtggagactggggatctggagcctggtgctggcacctggcctgagtttccgtgggcagctggcggggacctgtgctgctgctgctgactgtgggtgggcgggcggcgcctgggagtggctcttgctcaggaattgataggaaccctaaaaactaggataccccctcctcggcccatgaggcacgcacagtgacttatttaagacttcccccttaatttatctgcccccaggatgcgtcagtctgttcagtggtcagcaggccccccaccccccgccgactgccctcgccatcgtggtcagacccccctcccaacacaacacgctgctggtctgtgtcagcctttgtaacgtgggaggctctgccgtgtcttccgggtgaactgtatttggattgcgcgcattgtcacggtccgcccctgggctgcaggcgccccttcctctgggcacccctgcattctgcatccccacctctagacgctgtaataaacagactgttttcactcggaaaaaaaaaaaaaaaaaaaa

SEQ ID NO: 40 - protein, 1537 aa, Homo sapiens
MGEKLELRLKSPVGAEPAVYPWPLPVYDKHHDAAHEIIETIRWVCEEIPDLKLAMENYVLIDYDTKSFESMQRLCDKYNRAIDSIHQLWKGTTQPMKLNTRPSTGLLRHILQQVYNHSVTDPEKLNNYEPFSPEVYGETSFDLVAQMIDEIKMTDDDLFVDLGSGVGQVVLQVAAATNCKHHYGVEKADIPAKYAETMDREFRKWMKWYGKKHAEYTLERGDFLSEEWRERIANTSVIFVNNFAFGPEVDHQLKERFANMKEGGRIVSSKPFAPLNFRINSRNLSDIGTIMRVVELSPLKGSVSWTGKPVSYYLHTIDRTILENYFSSLKNPKLREEQEAARRRQQRESKSNAATPTKGPEGKVAGPADAPMDSGAEEEKAGAATVKKPSPSKARKKKLNKKGRKMAGRKRGRPKKMNTANPERKPKKNQTALDALHAQTVSQTAASSPQDAYRSPHSPFYQLPPSVQRHSPNPLLVAPTPPALQKLLESFKIQYLQFLAYTKTPQYKASLQELLGQEKEKNAQLLGAAQQLLSHCQAQKEEIRRLFQQKLDELGVKALTYNDLIQAQKEISAHNQQLREQSEQLEQDNRALRGQSLQLLKARCEELQLDWATLSLEKLLKEKQALKSQISEKQRHCLELQISIVELEKSQRQQELLQLKSCVPPDDALSLHLRGKGALGRELEPDASRLHLELDCTKFSLPHLSSMSPELSMNGQAAGYELCGVLSRPSSKQNTPQYLASPLDQEVVPCTPSHVGRPRLEKLSGLAAPDYTRLSPAKIVLRRHLSQDHTVPGRPAASELHSRAEHTKENGLPYQSPSVPGSMKLSPQDPRPLSPGALQLAGEKSSEKGLRERAYGSSGELITSLPISIPLSTVQPNKLPVSIPLASVVLPSRAERARSTPSPVLQPRDPSSTLEKQIGANAHGAGSRSLALAPAGFSYAGSVAISGALAGSPASLTPGAEPATLDESSSSGSLFATVGSRSSTPQHPLLLAQPRNSLPASPAHQLSSSPRLGGAAQGPLPEASKGDLPSDSGFSDPESEAKRRIVFTITTGAGSAKQSPSSKHSPLTASARGDCVPSHGQDSRRRGRRKRASAGTPSLSAGVSPKRRALPSVAGLFTQPSGSPLNLNSMVSNINQPLEITAISSPETSLKSSPVPYQDHDQPPVLKKERPLSQTNGAHYSPLTSDEEPGSEDEPSSARIERKIATISLESKSPPKTLENGGGLAGRKPAPAGEPVNSSKWKSTFSPISDIGLAKSADSPLQASSALSQNSLFTFRPALEEPSADAKLAAHPRKGFPGSLSGADGLSPGTNPANGCTFGGGLAADLSLHSFSDGASLPHKGPEAAGLSSPLSFPSQRGKEGSDANPFLSKRQLDGLAGLKGEGSRGKEAGEGGLPLCGPTDKTPLLSGKAAKARDREVDLKNGHNLFISAAAVPPGSLLSGPGLAPAASSAGGAASSAQTHRSFLGPFPPGPQFALGPMSLQANLGSVAGSSVLQSLFSSVPAAAGLVHVSSAATRLTNSHAMGSFSGVAGGTVGGN

SEQ ID NO: 41 - DNA, 9153 bp, Homo sapiens
actgtctccaagatggcggccgtgtcagtttggggcatctccgcggtccggcccggggccccgggatctcggctgtccttcctcccggcataagatgcacatttttctgctctggagccgggaatgaaatattcttgagttcttacaactttatgacgagacccatgtgtggtgctattgagaaattcattgggaagttggaagacatttcaatcaacaggttgttttggtttctatagtacaattggggtggcattctgttttgtgaaaggaggaaggacttaggccagaaaactcatatgctatggttaactggttcccagcctccgagaatcttgttttccatggtgtaaaacttactcagcatcaggataagggataacgactctatggatatacagaatccttcaccatggtaaaactcgcaaacccgctttatactgagtggattttggaggccatcaaaaaagtgaaaaagcagaaacagcgtccttcagaagaaaggatatgcaatgctgtgtcttcatcccatggcttggatcgtaaaactgttttagaacaattggagttgagtgttaaagatggaacaattttaaaagtctcaaataaaggactcaattcctataaagatcctgataatcctgggcgaatagcacttcctaagcctcggaaccatggaaaattggataataaacaaaatgtggattggaataaactgataaagcgggcagttgagggcttggcagagtctggtggctcaactttgaaaagcattgaacgttttttgaaaggtcagaaggatgtgtctgcattattcggaggcagtgctgcctctggctttcaccagcagttacgattggctatcaaacgtgccattggccacggcagactccttaaagatggacctctttatcggctcaacactaaagcaaccaacgtggatgggaaagagagttgtgagtctctttcctgtttacctccagtgtcccttcttccacatgaaaaggataagccggttgctgaaccaatccccatctgtagtttctgtcttggtacaaaagaacaaaaccgagaaaagaagccagaggaactcatctcctgtgccgactgtggcaacagtggccatccatcctgtttaaagttttcccctgaactaacggttcgagtgaaggccttacggtggcagtgcatcgagtgtaaaacatgcagctcctgtcgagatcaaggcaaaaatgcggataacatgctcttttgtgattcatgtgaccgaggttttcacatggagtgttgtgatccgccactcacccgtatgccaaaaggcatgtggatatgtcaaatatgtcgacctaggaaaaaaggacgaaaacttctacaaaagaaggcagcacagataaaacggcgctatactaatccaataggacgtccaaaaaacaggttaaagaaacaaaacacggtatcaaaaggtcccttcagcaaagttcgaactggccctggaaggggtaggaaacgaaaaatcactctttccagccaatcagcatcatcatcatcagaagaaggatatttagagcggatagatggcttggacttctgcagagatagcaatgtctccttgaagttcaacaagaaaaccaaagggctcattgatggccttaccaaattttttaccccttcccctgatgggcggaaagctcggggggaagtggtggactactctgagcaatatcgaatcagaaagaggggcaacaggaaatcaagcacttcagattggcccacagacaatcaggatggctgggatggcaaacaagaaaatgaggagcgactttttgggagccaggaaatcatgactgagaaagatatggaattatttcgtgatatccaagaacaagcactgcagaaagttggagtgactggtccccctgatccacaagtccgctgtccctctgtcattgagtttgggaagtatgaaattcacacctggtactcctccccatatcctcaagaatactcaaggctgcccaaattgtatctttgtgaattttgtctaaaatatatgaaaagtagaactattctgcagcagcacatgaagaaatgtggttggttccatcctcctgccaatgagatttacagaaagaataatatttctgtctttgaggttgatgggaatgtgagtaccatttattgtcaaaacctgtgtcttttggcaaagttgtttcttgaccacaaaaccctctattacgatgtggagccatttcttttttatgtactaacacagaatgatgtcaagggctgccaccttgttggctacttttctaaggaaaagcactgccaacagaagtacaatgtttcctgtataatgattcttcctcaataccagcgtaagggctatggcaggtttctcatcgatttcagttatttgttatcaaagcgtgaaggccaagcagggtctccagagaaaccgttatctgatctgggtcgtctttcctacatggcatattggaaaagtgtaatattggagtgcctttatcaccaaaatgacaagcagatcagcattaagaagttaagcaagttgactggaatctgccctcaagacatcacttccacactccaccacctacgaatgctggacttccgtagtgaccaatttgtgattatccgccgggaaaaacttatccaggatcacatggcaaagcttcagctgaatttgcgacctgtagatgtagatccagaatgtttgcgctggactccagtcatagtgtccaactctgtggtctcagaggaggaagaagaggaggctgaggaaggagaaaacgaagagccacagtgccaggaaagagaattagagatcagtgtgggaaagtctgtgtctcatgagaacaaagaacaagattcttattcagtagaaagtgaaaagaaaccagaagttatggctccagtcagttctacacgtttgagcaaacaagtccttcctcatgatagtcttcctgcaaatagccagccatctcggaggggccgctgggggaggaagaacagaaaaacccaggaacgttttggtgataaagattctaaactgctcttggaagagacgtcttcagctcctcaggaacaatatggagaatgtggggagaaatcagaagccacccaggaacaatacactgaaagtgaagaacagctggtggcttctgaggagcagccaagccaggacgggaaacctgaccttcccaagagaagactcagtgagggggttgagccctggcgaggacagctcaagaaaagccctgaggctctgaagtgcagattaacagaaggaagtgagaggctgccccgtcgctacagtgagggtgacagggctgtcctcaggggcttcagtgagagcagcgaggaggaggaggagccggaaagccctcggtcaagctcgccaccaattctcacaaagcccacgctgaagcgaaagaaaccatttctccaccgaaggaggagagtccgaaagcgcaaacaccacaatagcagtgtagtcacagaaactatttctgagaccactgaagtgttagatgaaccttttgaagattctgactccgagaggccaatgccaagattagaacccacgtttgagatcgatgaagaagaggaggaagaggatgaaaatgaacttttccctagagaatacttccgtcgtttgtcttcgcaggatgtactcaggtgtcagtcctcttctaagaggaagtctaaagatgaagaagaagatgaagagtcagatgatgctgatgacactcctatcttaaagccagtatctcttttgcgaaaacgtgatgtgaagaattctcctcttgagccagatacatccacacctttgaaaaagaaaaagggatggcccaaaggcaagagccgcaaaccaatccactggaagaaaagacctggtcgaaaaccaggatttaagttgagtcgggaaatcatgccagtttctactcaagcatgcgtcattgagcccatcgtttccattcctaaagctggacgtaaacccaagatccaggagagtgaagaaactgttgagccaaaagaagacatgcccctacccgaggagaggaaggaggaggaggagatgcaagcagaggcagaagaggctgaagagggtgaggaagaggatgcagccagcagtgaagtcccagcagcctctccagcagacagcagcaatagtcctgagaccgaaaccaaggagcctgaggtggaggaggaagaagagaagccccgtgtctcagaggagcagaggcagtcagaggaggagcagcaggaattagaggagccagagccagaggaggaggaagatgcagctgcagagactgcccagaatgacgaccacgacgctgatgatgaggatgatggccacctggagtccacaaagaaaaaggagctagaggaacagcccacgagggaagatgtcaaggaggagcctggtgttcaagagtcttttttagatgctaatatgcagaagagtagggaaaagataaaggataaagaggaaaccgagctggattccgaagaggagcagccttcccatgacacgtccgtggtgtcagagcagatggctgggtctgaggacgaccacgaagaagactcccacactaaggaagagttaatcgaattaaaagaggaggaagagattcctcatagtgagctggatctggaaactgtacaggcagtgcagtctttgactcaagaagaaagcagtgagcatgagggcgcctaccaggactgtgaggaaactcttgcggcgtgtcagaccctgcagagttacacccaggctgacgaggaccctcagatgtccatggttgaagactgtcatgcgtcagaacataatagccctatctcctccgttcagtctcaccccagccagtcagtccgttcggtcagcagtcccaacgtgcctgcccttgagagtggctacacccagatcagcccagaacaaggatccctgtccgcaccctctatgcagaacatggagaccagccccatgatggatgtgccttccgtatcagaccactctcagcaggtggtggacagcggcttcagtgacctgggcagcattgagagcaccactgaaaactatgagaacccaagcagttacgactccacgatgggcggcagcatctgtgggaacagctcttcccagagcagctgctcctacggtgggctgtcgtcctccagcagcctcacccagagcagctgtgtggtcactcagcagatggccagcatgggcagcagctgcagcatgatgcagcagagcagcgtccagcctgctgccaactgcagcatcaagtcacctcagagctgcgtggtggagaggcctcccagtaaccagcagcagcagccgccaccaccgcctccacagcagccacagccgccgccgccacaaccacaaccagcaccacagcctccaccaccccagcagcagccgcaacagcagccgcagcctcagccccagcagcctccacccccaccccctccccagcagcagcccccgctgtcacagtgtagtatgaataacagtttcaccccagctcctatgatcatggagataccagaatctggaagcactgggaacataagtatctatgagaggattccaggggattttggtgccggcagctactctcaaccatcagccaccttcagcctagccaagctgcagcagctgaccaacaccattatggaccctcatgccatgccttatagccattctcctgctgtgacttcctatgcaaccagtgtttctctgtccaatacaggactggctcagctggctccatctcatcccttagctgggactcctcaagcacaagccaccatgacgccacccccaaacttggcatccactaccatgaacctcacatctcctctgcttcagtgcaacatgtctgccaccaacattggcattcctcacacgcagagattgcaagggcaaatgccagtgaaggggcacatttccatccgctccaagtctgcgccactgccctctgcggctgctcaccagcagcagctgtatggccgtagcccatcggcagttgccatgcaggctggccctcgcgcactggctgttcagcgtggcatgaacatgggggttaatctgatgcctactcccgcctataatgtcaattccatgaatatgaacaccttgaatgccatgaacagctatcgaatgacacagcccatgatgaacagcagttaccatagtaaccctgcctacatgaaccagacagcacagtatcctatgcagatgcagatgggaatgatggggagccaggcctatacccagcagcctatgcagcctaaccctcatgggaacatgatgtacacaggcccctcccatcacagctacatgaacgctgctggcgtgcccaagcagtcactcaacggaccttacatgagaagatgagcaagatgaacttgcaatcaaaaacttaaatatatataaataaaggaaccttttatactgacaaaccagagaaaaatggacctttttccagttaaaatattgctgtagatttagaggaatttttctttggtttattttattttttagaaaacctgatcttctctttttttgggttcattttgttctgggttttggttttcttcacaatcttgaacattttacagtagaactcatctaaaaatggatttggggatggggaaacatgcacaaaatcttttcataattaaaaagagccttactttctttacataccacatggacagaatttgtgtaaaagtgaattatctttattttaaaatgtatgtttcccctcactgtttgcagctcccaatgttgtcatttttaaatgttatatacatctcaagggttaaccagaccctttcctccaaacccaacctttcatttcctacttcattccagcaggaggcacttaggggagactcggatggggacatggagaacaacccaagctccttaaacttattattattgttaatattattattattattattaataaagtgaggcaggaaaatgcttctccttttaaaatcccctccactcctcacacacacacacctcttgaaacccttccccaagaatgtttctttatagacggacttcattgaaatctttgttgttcttgaatcaagtgtaatataatttttttcttcttttttaaaatattcccactcagcactcagagacacaaaaatactgtaagtctcaattaacagcagaatctcagagaaaagctgtttgcaatccaaatccagcctttggaggaatagagatggtcaattaacaatcaaaaagaggagattaacctcttgtttttttaccacctggtgaatcagccataacgcacacacacgccacccagcctcttgtttctagtatgtactttgaaatgctaactgagggtcttgatgcttgagcctttgactgataaaactcaaatagcagtccccagtgatttgcctcttaggttctttcttaaattgttggtggatgactgtacattttagtgatttgaaaaataactgacaaaccattgaaacagtttattttatgttggaagagatggcgcagatgtgtgtcagaagggagatcacggtgtgagtttcgtagctatttaagtgatacatacctctagtttttgtatgtcttttgagatcctgagttcatcccctgtgaatcagagtgcacaagcacctctcctgtgagtggctaatgagaagagggacagaccgaccaccagcacagtagggcagatctggacagcagaatgttataacgcaagttcatgtgttgctcccaactccattctcttttctctcgtgcaaccagtttgcccattctcttcctattacttgctccagggataggtaaaaaaaaaaaaaaaaaaaaaaaaaatatatatatatatatatacacacacacacacacacacacacacacatatatatatatatatattccatcattagaagatggaaactattataccacttggtatgtgcagtcaaatatccaaaagggggaagtactgcttagagaaatatctgtaagcattaaattctctcctttatttgtacattttatatagataaatttttaaagtactaattaggcattaacttttttcaaatgcacaggtttgttggtttttttaatacactttaattgactttctcaagcgtgctaggtagaaacgcagaattccacatcttcccgctctcagctctgagcatgtgcaaggctgtgtaggacccagtttctctgtatatactattccagttcccagtcatctatgtagaaagtgcactgtgctgccatcgccctacatcttcagctgtgtcattgcttcctggttggggtggggacggggtgggtcgggagggaggtatattgggaggagggtgggtcaaggcagaaggagaagctgttgaaatgagggccgtgaaatcagtttctgttggtttgcggttgtgtttggttttgtttgtttctttataaaaaattcaatcgggcagctcccttttccacaagcctctttgtgactgtagaactattgtagaaaaaaaaagttcttttctatattataaaagaaattatccaacacagtaatattggtacctgtcattttttcacttctgtttaaaaaaaatgtatttttagcaagataacttgggtaatcttctaaaaaagaaatttaaaaactcactgttagtgactttgatgccttttaaaataagagctttttcatttcattccatctttaaaattttttatctttgttgtagaatattaaaaactattttaagaaagataaattctctttaaagagatctctagcgtgtgtgaatagagctccagatgcctctaaaagccgcatgtacaaaggaagccacgtctatcctgtctgtttatatttgcttttcctgttttgtaacctctttgtactttgttcatggtgacttgtaagctaaggggaaggggtgcctagatgcctttgtatctctccatgtcacgcgctcctgggccagccggcctcccttcctctccttgtatgtaatacctttttttcccctttctagcaagtactttcaaaagaactctgtacattttaacataaaaaataaattatgttgagccattttgga

SEQ ID NO: 42 - protein, 2004 aa, Homo sapiens
MVKLANPLYTEWILEAIKKVKKQKQRPSEERICNAVSSSHGLDRKTVLEQLELSVKDGTILKVSNKGLNSYKDPDNPGRIALPKPRNHGKLDNKQNVDWNKLIKRAVEGLAESGGSTLKSIERFLKGQKDVSALFGGSAASGFHQQLRLAIKRAIGHGRLLKDGPLYRLNTKATNVDGKESCESLSCLPPVSLLPHEKDKPVAEPIPICSFCLGTKEQNREKKPEELISCADCGNSGHPSCLKFSPELTVRVKALRWQCIECKTCSSCRDQGKNADNMLFCDSCDRGFHMECCDPPLTRMPKGMWICQICRPRKKGRKLLQKKAAQIKRRYTNPIGRPKNRLKKQNTVSKGPFSKVRTGPGRGRKRKITLSSQSASSSSEEGYLERIDGLDFCRDSNVSLKFNKKTKGLIDGLTKFFTPSPDGRKARGEVVDYSEQYRIRKRGNRKSSTSDWPTDNQDGWDGKQENEERLFGSQEIMTEKDMELFRDIQEQALQKVGVTGPPDPQVRCPSVIEFGKYEIHTWYSSPYPQEYSRLPKLYLCEFCLKYMKSRTILQQHMKKCGWFHPPANEIYRKNNISVFEVDGNVSTIYCQNLCLLAKLFLDHKTLYYDVEPFLFYVLTQNDVKGCHLVGYFSKEKHCQQKYNVSCIMILPQYQRKGYGRFLIDFSYLLSKREGQAGSPEKPLSDLGRLSYMAYWKSVILECLYHQNDKQISIKKLSKLTGICPQDITSTLHHLRMLDFRSDQFVIIRREKLIQDHMAKLQLNLRPVDVDPECLRWTPVIVSNSVVSEEEEEEAEEGENEEPQCQERELEISVGKSVSHENKEQDSYSVESEKKPEVMAPVSSTRLSKQVLPHDSLPANSQPSRRGRWGRKNRKTQERFGDKDSKLLLEETSSAPQEQYGECGEKSEATQEQYTESEEQLVASEEQPSQDGKPDLPKRRLSEGVEPWRGQLKKSPEALKCRLTEGSERLPRRYSEGDRAVLRGFSESSEEEEEPESPRSSSPPILTKPTLKRKKPFLHRRRRVRKRKHHNSSVVTETISETTEVLDEPFEDSDSERPMPRLEPTFEIDEEEEEEDENELFPREYFRRLSSQDVLRCQSSSKRKSKDEEEDEESDDADDTPILKPVSLLRKRDVKNSPLEPDTSTPLKKKKGWPKGKSRKPIHWKKRPGRKPGFKLSREIMPVSTQACVIEPIVSIPKAGRKPKIQESEETVEPKEDMPLPEERKEEEEMQAEAEEAEEGEEEDAASSEVPAASPADSSNSPETETKEPEVEEEEEKPRVSEEQRQSEEEQQELEEPEPEEEEDAAAETAQNDDHDADDEDDGHLESTKKKELEEQPTREDVKEEPGVQESFLDANMQKSREKIKDKEETELDSEEEQPSHDTSVVSEQMAGSEDDHEEDSHTKEELIELKEEEEIPHSELDLETVQAVQSLTQEESSEHEGAYQDCEETLAACQTLQSYTQADEDPQMSMVEDCHASEHNSPISSVQSHPSQSVRSVSSPNVPALESGYTQISPEQGSLSAPSMQNMETSPMMDVPSVSDHSQQVVDSGFSDLGSIESTTENYENPSSYDSTMGGSICGNSSSQSSCSYGGLSSSSSLTQSSCVVTQQMASMGSSCSMMQQSSVQPAANCSIKSPQSCVVERPPSNQQQQPPPPPPQQPQPPPPQPQPAPQPPPPQQQPQQQPQPQPQQPPPPPPPQQQPPLSQCSMNNSFTPAPMIMEIPESGSTGNISIYERIPGDFGAGSYSQPSATFSLAKLQQLTNTIMDPHAMPYSHSPAVTSYATSVSLSNTGLAQLAPSHPLAGTPQAQATMTPPPNLASTTMNLTSPLLQCNMSATNIGIPHTQRLQGQMPVKGHISIRSKSAPLPSAAAHQQQLYGRSPSAVAMQAGPRALAVQRGMNMGVNLMPTPAYNVNSMNMNTLNAMNSYRMTQPMMNSSYHSNPAYMNQTAQYPMQMQMGMMGSQAYTQQPMQPNPHGNMMYTGPSHHSYMNAAGVPKQSLNGPYMRR

SEQ ID NO: 43 - DNA, 8789 bp, Homo sapiens
atgctcagtggcttctcgacaagttggcagcaacaacacggccctggtcgtcgtcgccgctgcggtaacggagcggtttgggtggcggagcctgcgttcgcgccttcccgctctcctcgggaggcccttcctgctctcccctaggctccgcggccgcccagggggtgggagcgggtgaggggagccaggcgcccagcgagagaggccccccgccgcagggcggcccgggagctcgaggcggtccggcccgcgcgggcagcggcgcggcgctgaggaggggcggcctggccgggacgcctcggggcgggggccgaggagctctccgggccgccggggaaagctacgggcccggtgcgtccgcggaccagcagcgcgggagagcggactcccctcgccaccgcccgagcccaggttatcctgaatacatgtctaacaattttccttgcaacgttagctgttgtttttcactgtttccaaaggatcaaaattgcttcagaaattggagacatatttgatttaaaaggaaaaacttgaacaaatggacaatatgtctattacgaatacaccaacaagtaatgatgcctgtctgagcattgtgcatagtttgatgtgccatagacaaggtggagagagtgaaacatttgcaaaaagagcaattgaaagtttggtaaagaagctgaaggagaaaaaagatgaattggattctttaataacagctataactacaaatggagctcatcctagtaaatgtgttaccatacagagaacattggatgggaggcttcaggtggctggtcggaaaggatttcctcatgtgatctatgcccgtctctggaggtggcctgatcttcacaaaaatgaactaaaacatgttaaatattgtcagtatgcgtttgacttaaaatgtgatagtgtctgtgtgaatccatatcactacgaacgagttgtatcacctggaattgatctctcaggattaacactgcagagtaatgctccatcaagtatgatggtgaaggatgaatatgtgcatgactttgagggacagccatcgttgtccactgaaggacattcaattcaaaccatccagcatccaccaagtaatcgtgcatcgacagagacatacagcaccccagctctgttagccccatctgagtctaatgctaccagcactgccaactttcccaacattcctgtggcttccacaagtcagcctgccagtatactggggggcagccatagtgaaggactgttgcagatagcatcagggcctcagccaggacagcagcagaatggatttactggtcagccagctacttaccatcataacagcactaccacctggactggaagtaggactgcaccatacacacctaatttgcctcaccaccaaaacggccatcttcagcaccacccgcctatgccgccccatcccggacattactggcctgttcacaatgagcttgcattccagcctcccatttccaatcatcctgctcctgagtattggtgttccattgcttactttgaaatggatgttcaggtaggagagacatttaaggttccttcaagctgccctattgttactgttgatggatacgtggacccttctggaggagatcgcttttgtttgggtcaactctccaatgtccacaggacagaagccattgagagagcaaggttgcacataggcaaaggtgtgcagttggaatgtaaaggtgaaggtgatgtttgggtcaggtgccttagtgaccacgcggtctttgtacagagttactacttagacagagaagctgggcgtgcacctggagatgctgttcataagatctacccaagtgcatatataaaggtctttgatttgcgtcagtgtcatcgacagatgcagcagcaggcggctactgcacaagctgcagcagctgcccaggcagcagccgtggcaggaaacatccctggcccaggatcagtaggtggaatagctccagctatcagtctgtcagctgctgctggaattggtgttgatgaccttcgtcgcttatgcatactcaggatgagttttgtgaaaggctggggaccggattacccaagacagagcatcaaagaaacaccttgctggattgaaattcacttacaccgggccctccagctcctagacgaagtacttcataccatgccgattgcagacccacaacctttagactgaggtcttttaccgttggggcccttaaccttatcaggatggtggactacaaaatacaatcctgtttataatctgaagatatatttcacttttgttctgctttatcttttcataaagggttgaaaatgtgtttgctgccttgctcctagcagacagaaactggattaaaacaattttttttttcctcttcagaacttgtcaggcatggctcagagcttgaagattaggagaaacacattcttattaattcttcacctgttatgtatgaaggaatcattccagtgctagaaaatttagccctttaaaacgtcttagagccttttatctgcagaacatcgatatgtatatcattctacagaataatccagtattgctgattttaaaggcagagaagttctcaaagttaattcacctatgttattttgtgtacaagttgttattgttgaacatacttcaaaaataatgtgccatgtgggtgagttaattttaccaagagtaactttactctgtgtttaaaaagtaagttaataatgtattgtaatctttcatccaaaatattttttgcaagttatattagtgaagatggtttcaattcagattgtcttgcaacttcagttttatttttgccaaggcaaaaaactcttaatctgtgtgtatattgagaatcccttaaaattaccagacaaaaaaatttaaaattacgtttgttattcctagtggatgactgttgatgaagtatacttttcccctgttaaacagtagttgtattcttctgtatttctaggcacaaggttggttgctaagaagcctataagaggaatttcttttccttcattcatagggaaaggttttgtattttttaaaacactaaaagcagcgtcactctacctaatgtctcactgttctgcaaaggtggcaatgcttaaactaaataatgaataaactgaatattttggaaactgctaaattctatgttaaatactgtgcagaataatggaaacattacagttcataataggtagtttggatatttttgtacttgatttgatgtgactttttttggtataatgtttaaatcatgtatgttatgatattgtttaaaattcagtttttgtatcttggggcaagactgcaaacttttttatatcttttggttattctaagccctttgccatcaatgatcatatcaattggcagtgactttgtatagagaatttaagtagaaaagttgcagatgtattgactgtaccacagacacaatatgtatgctttttacctagctggtagcataaataaaactgaatctcaacatacaaagttgaattctaggtttgatttttaagattttttttttcttttgcacttttgagtccaatctcagtgatgaggtaccttctactaaatgacaggcaacagccagttctattgggcagctttgtttttttccctcacactctaccgggacttccccatggacattgtgtatcatgtgtagagttggttttttttttttttaatttttattttactatagcagaaatagacctgattatctacaagatgataaatagattgtctacaggataaatagtatgaaataaaatcaaggattatctttcagatgtgtttacttttgcctggagaacttttagctatagaaacacttgtgtgatgatagtcctccttatatcacctggaatgaacacagcttctactgccttgctcagaaggtcttttaaatagaccatcctagaaaccactgagtttgcttatttctgtgatttaaacatagatcttgatccaagctacatgacttttgtctttaaataacttatctaccacctcatttgtactcttgattacttacaaattctttcagtaaacacctaattttcttctgtaaaagtttggtgatttaagttttattggcagttttataaaaagacatcttctctagaaattgctaactttaggtccattttactgtgaatgaggaataggagtgagttttagaataacagatttttaaaaatccagatgatttgattaaaaccttaatcatacattgacataattcattgcttcttttttttgagatatggagtcttgctgtgttgcccaggcaggagtgcagtggtatgatctcagctcactgcaacctctgcctcccgggttcaactgattctcctgcctcagcctccctggtagctaggattacaggtgcccgccaccatgcctggctaacttttgtagttttagtagagacggggttttgcctgttggccaggctggtcttgaactcctgacctcaagtgatccatccaccttggcctcccaaagtgctgggattacgggcgtgagccactgtccctggcctcattgttcccttttctactttaaggaaagttttcatgtttaatcatctggggaaagtatgtgaaaaatatttgttaagaagtatctctttggagccaagccacctgtcttggtttctttctactaagagccataaagtatagaaatacttctagttgttaagtgcttatatttgtacctagatttagtcacacgcttttgagaaaacatctagtatgttatgatcagctattcctgagagcttggttgttaatctatatttctatttcttagtggtagtcatctttgatgaataagactaaagattctcacaggtttaaaattttatgtctactttaagggtaaaattatgaggttatggttctgggtgggttttctctagctaattcatatctcaaagagtctcaaaatgttgaatttcagtgcaagctgaatgagagatgagccatgtacacccaccgtaagacctcattccatgtttgtccagtgcctttcagtgcattatcaaagggaatccttcatggtgttgcctttattttccggggagtagatcgtgggatatagtctatctcatttttaatagtttaccgcccctggtatacaaagataatgacaataaatcactgccatataaccttgctttttccagaaacatggctgttttgtattgctgtaaccactaaataggttgcctataccattcctcctgtgaacagtgcagatttacaggttgcatggtctggcttaaggagagccatacttgagacatgtgagtaaactgaactcatattagctgtgctgcatttcagacttaaaatccatttttgtggggcagggtgtggtgtgtaaaggggggtgtttgtaatacaagttgaaggcaaaataaaatgtcctgtctcccagatgatatacatcttattatttttaaagtttattgctaattgtaggaaggtgagttgcaggtatctttgactatggtcatctggggaaggaaaattttacattttactattaatgctccttaagtgtctatggaggttaaagaataaaatggtaaatgtttctgtgcctggtttgatggtaactggttaatagttactcaccattttatgcagagtcacattagttcacaccctttctgagagccttttgggagaagcagttttattctctgagtggaacagagttctttttgttgataatttctagtttgctcccttcgttattgccaactttactggcattttatttaatgatagcagattgggaaaatggcaaatttaggttacggaggtaaatgagtatatgaaagcaattacctctaaagccagttaacaattattttgtaggtggggtacactcagcttaaagtaatgcatttttttttcccgtaaaggcagaatccatcttgttgcagatagctatctaaataatctcatatcctcttttgcaaagactacagagaataggctatgacaatcttgttcaagcctttccatttttttccctgataactaagtaatttctttgaacataccaagaagtatgtaaaaagtccatggccttattcatccacaaagtggcatcctaggcccagccttatccctagcagttgtcccagtgctgctaggttgcttatcttgtttatctggaatcactgtggagtgaaattttccacatcatccagaattgccttatttaagaagtaaaacgttttaatttttagcctttttttggtggagttatttaatatgtatatcagaggatatactagatggtaacatttctttctgtgcttggctatctttgtggacttcaggggcttctaaaacagacaggactgtgttgcctttactaaatggtctgagacagctatggttttgaatttttagttttttttttttaacccacttcccctcctggtctcttccctctctgataattaccattcatatgtgagtgttagtgtgcctccttttagcattttcttcttctctttctgattcttcatttctgactgcctaggcaaggaaaccagataaccaaacttactagaacgttctttaaaacacaagtacaaactctgggacaggacccaagacactttcctgtgaagtgctgaaaaagacctcattgtattggcatttgatatcagtttgatgtagcttagagtgcttcctgattcttgctgagtttcaggtagttgagatagagagaagtgagtcatattcatattttcccccttagaataatattttgaaaggtttcattgcttccacttgaatgctgctcttacaaaaactggggttacaagggttactaaattagcatcagtagccagaggcaataccgttgtctggaggacaccagcaaacaacacacaacaaagcaaaacaaaccttgggaaactaaggccatttgttttgttttggtgtcccctttgaagccctgccttctggccttactcctgtacagatatttttgacctataggtgcctttatgagaattgagggtctgacatcctgccccaaggagtagctaaagtaattgctagtgttttcagggattttaacatcagactggaatgaatgaatgaaactttttgtcctttttttttctgtttttttttttctaatgtagtaaggactaaggaaaacctttggtgaagacaatcatttctctctgttgatgtggatacttttcacaccgtttatttaaatgctttctcaataggtccagagccagtgttcttgttcaacctgaaagtaatggctctgggttgggccagacagttgcactctctagtttgccctctgccacaaatttgatgtgtgacctttgggcaagtcatttatcttctctgggccttagttgcctcatctgtaaaatgagggagttggagtagattaattattccagctctgaaattctaagtgaccttggctaccttgcagcagttttggatttcttccttatctttgttctgctgtttgagggggctttttacttatttccatgttattcaaaggagactaggcttgatattttattactgttcttttatggacaaaaggttacatagtatgcccttaagacttaattttaaccaaaggcctagcaccaccttaggggctgcaataaacacttaacgcgcgtgcgcacgcgcgcgcgcacacacacacacacacacacacacacacacaggtcagagtttaaggctttcgagtcatgacattctagcttttgaattgcgtgcacacacacacgcacgcacacactctggtcagagtttattaaggctttcgagtcatgacattatagcttttgagttggtgtgtgtgacaccaccctcctaagtggtgtgtgcttgtaattttttttttcagtgaaaatggattgaaaacctgttgttaatgcttagtgatattatgctcaaaacaaggaaattcccttgaaccgtgtcaattaaactggtttatatgactcaagaaaacaataccagtagatgattattaactttattcttggctctttttaggtccattttgattaagtgacttttggctggatcattcagagctctcttctagcctacccttggatgagtacaattaatgaaattcatattttcaaggacctgggagccttccttggggctgggttgagggtggggggttggggagtcctggtagaggccagctttgtggtagctggagaggaagggatgaaaccagctgctgttgcaaaggctgcttgtcattgatagaaggactcacgggcttggattgattaagactaaacatggagttggcaaactttcttcaagtattgagttctgttcaatgcattggacatgtgatttaagggaaaagtgtgaatgcttatagatgatgaaaacctggtgggctgcagagcccagtttagaagaagtgagttgggggttggggacagatttggtggtggtatttcccaactgtttcctcccctaaattcagaggaatgcagctatgccagaagccagagaagagccactcgtagcttctgctttggggacaactggtcagttgaaagtcccaggagttcctttgtggctttctgtatacttttgcctggttaaagtctgtggctaaaaaatagtcgaacctttcttgagaactctgtaacaaagtatgtttttgattaaaagagaaagccaactaaaaaaaaaaaaaaaaaaaa

SEQ ID NO: 44 - protein, 552 aa, Homo sapiens
MDNMSITNTPTSNDACLSIVHSLMCHRQGGESETFAKRAIESLVKKLKEKKDELDSLITAITTNGAHPSKCVTIQRTLDGRLQVAGRKGFPHVIYARLWRWPDLHKNELKHVKYCQYAFDLKCDSVCVNPYHYERVVSPGIDLSGLTLQSNAPSSMMVKDEYVHDFEGQPSLSTEGHSIQTIQHPPSNRASTETYSTPALLAPSESNATSTANFPNIPVASTSQPASILGGSHSEGLLQIASGPQPGQQQNGFTGQPATYHHNSTTTWTGSRTAPYTPNLPHHQNGHLQHHPPMPPHPGHYWPVHNELAFQPPISNHPAPEYWCSIAYFEMDVQVGETFKVPSSCPIVTVDGYVDPSGGDRFCLGQLSNVHRTEAIERARLHIGKGVQLECKGEGDVWVRCLSDHAVFVQSYYLDREAGRAPGDAVHKIYPSAYIKVFDLRQCHRQMQQQAATAQAAAAAQAAAVAGNIPGPGSVGGIAPAISLSAAAGIGVDDLRRLCILRMSFVKGWGPDYPRQSIKETPCWIEIHLHRALQLLDEVLHTMPIADPQPLD

SEQ ID NO: 45 - DNA, 9520 bp, Homo sapiens
gcctcctccccacacctgggaggggagtggtgcggcgcggcctcctcccccggcgctcgcaactcctgtccggccgtagctgcgccgccgcggcgggagtaaaggtcgcgccgccgggagcgagccggccgcggcgcctgcgggaagccggcggggcaggtcggagaagagcgagaagatcgagaaactccaggccagcccgggaacatggcgccaggcgggccagccgcggactgagagccgcggggcagccaggagccggggcccgagccccgcccggcccgggccatgtcggtgggcgagctctacagccagtgcacaagggtctggatccctgaccctgatgaggtatggcgctcagctgagttaaccaaggactacaaagaaggagacaagagcctacagctcagactggaggatgaaacgattctggaatacccaattgatgtacaacgcaaccagctgcccttcttacggaatccagatatcttggtgggagaaaatgacctgactgcccttagctatcttcatgagcctgcagttttgcataatttgaaggtccgtttcctggagtccaaccatatctacacttactgtggtatcgtacttgttgccattaatccttatgaacagttgccaatctatggacaagatgtcatctatacctacagtggccaaaacatgggagacatggacccccacatctttgctgtggcagaagaagcctacaagcagatggccagagatgagaagaatcagtccatcatagtcagtggggagtctggagccgggaagacggtatcagccaagtatgccatgcgctatttcgccaccgttggtggctcggccagtgaaaccaacatcgaagagaaggtgctggcatccagtcccatcatggaggccattggaaatgccaagaccacccgcaatgacaacagcagccgttttggcaagtacatccagattggctttgacaaaaggtaccacatcatcggggccaacatgaggacttacctcttggagaagtccagagtggtcttccaggcagatgatgagaggaattaccacatcttttaccagctctgtgctgctgccggtcttccagaatttaaagagcttgcactaacaagtgcagaggactttttctatacatcacagggaggagacacttccatcgagggtgtggacgatgctgaggactttgagaagactcgacaagccttcacactcctcggagtgaaagagtcccatcagatgagcatttttaagataattgcttctatcttgcaccttggaagtgtggcgattcaggctgagcgtgatggtgattcctgtagtatatcaccccaggatgtatacctaagcaacttctgccgactgctaggggtggagcacagtcagatggagcactggctgtgtcatcgcaagctggtcaccacctcggagacctacgtcaagaccatgtccctgcagcaggtgatcaatgcgcgcaacgccctggcgaagcacatctatgcccagttgttcggctggattgtggagcacatcaacaaggccctgcacacctccctcaagcagcactccttcatcggggtcctggacatctatgggtttgagacatttgaggtaaacagctttgagcagttctgtatcaactatgcaaatgaaaagctccagcagcagttcaactcgcatgttttcaaactggagcaagaagaatacatgaaggaacagatcccttggaccctgattgatttttatgataaccaaccttgtatcgacctcattgaagccaagctgggtatcttggacctgttggatgaagaatgtaaggtccccaaaggaactgaccagaactgggctcagaagctctatgaccggcactccagcagccagcacttccagaagccccgcatgtccaacacggccttcatcatcgtccactttgcagacaaggtggagtacctctctgatggttttctggagaaaaacagagacacggtgtatgaagagcagatcaatatcctgaaggccagcaagttcccactagtggctgacttgtttcatgatgacaaggaccctgttcctgccaccacccctgggaaggggtcatcttcgaagatcagcgtccgttctgccagaccccccatgaaagtctccaacaaggagcacaagaaaaccgttggccaccagttccgtacctccctgcatctgctcatggagaccctgaatgccacgacacctcactatgtccgctgcatcaagcccaacgatgagaagctcccctttcactttgacccaaagagagcagtgcagcaactcagagcctgcggggtgttggagacgattcgaatcagtgcagctggctacccatccaggtgggcctaccatgactttttcaaccggtatcgggtgctggtcaagaagagagagctcgccaacacagacaaaaaggccatctgcaggtctgtcctggagaacctcatcaaggaccccgacaagttccagtttggccgcaccaagatcttctttcgagcaggccaggtggcctacctggagaagctgcgggctgacaagttccggacagccaccatcatgatccagaaaactgtccggggatggctgcagaaggtgaaatatcacaggctgaagggggctaccttaaccctgcagaggtactgccggggacacctggcccgcaggctggctgagcacctgcggaggatcagagcggctgtggtgctccagaaacattaccgcatgcagagggcccgccaggcctaccagagggtccgcagagctgccgttgttatccaggccttcacccgggccatgtttgtgcggagaacctaccgccaggtcctcatggagcacaaggccaccaccatccagaagcacgtgcggggctggatggcacgcaggcacttccagcggctgcgggatgcagccattgtcatccagtgtgccttccggatgctcaaggccaggcgggagctgaaggccctcaggattgaggcccgctcagcagagcatctgaaacgtctcaacgtgggcatggagaacaaggtggtccagctgcagcggaagatcgatgagcagaacaaagagttcaagacactttcagagcagttgtccgtgaccacctcaacatacaccatggaggtagagcggctgaagaaggagctggtgcactaccagcagagcccaggtgaggacaccagcctcaggctgcaggaggaggtggagagcctgcgcacagagctgcagagggcccactcggagcgcaagatcttggaggacgcccacagcagggagaaagatgagctgaggaagcgagttgcagacctggagcaagaaaatgctctcttgaaagatgagaaagaacagctcaacaaccaaatcctgtgccagtctaaagatgaatttgcccagaactctgtgaaggaaaatctcatgaagaaagaactggaggaggagcgatcccggtaccagaaccttgtgaaggaatattcacagttggagcagagatacgacaaccttcgggatgaaatgaccatcataaagcaaactccaggtcataggcggaacccatcaaaccaaagtagcttagaatctgactccaattacccctccatctccacatctgagatcggagacactgaggatgccctccagcaggtggaggaaattggcctggagaaggcagccatggacatgacggtcttcctgaagctgcagaagagagtacgggagctggagcaggagaggaaaaagctgcaagtgcagctggagaagagagaacagcaggacagcaagaaagtccaggcggaaccaccacagactgacatagatttggacccgaatgcagatctggcctacaatagtctgaagaggcaagagctggagtcagagaacaaaaagctgaagaatgacctgaatgagctgaggaaagccgtggccgaccaagccacgcagaataactccagccacggctccccagatagctacagcctcctgctgaaccagctcaagctggcccacgaggagctcgaggtgcgcaaggaggaggtgctcatcctcaggacccagatcgtgagcgccgaccagcggcgactcgccggcaggaacgcggagccgaacattaatgccagatcaagttggcctaacagtgaaaagcatgttgaccaggaggatgccattgaggcctatcacggggtctgccagacaaacagcaagactgaggattggggatatttaaatgaagatggagaactcggcttggcctaccaaggcctaaagcaagttgccaggctgctggaggctcagctgcaggcccagagcctggagcatgaggaggaggtggagcatctcaaggctcagctcgaggccctgaaggaggagatggacaaacagcagcagaccttctgccagacgctactgctctccccagaggcccaggtggaattcggcgttcagcaggaaatatcccggctgaccaacgagaatctggaccttaaagaactggtagaaaagctggaaaagaatgagaggaagctcaaaaagcaactgaagatttacatgaagaaagcccaggacctagaagctgcccaggcattggcccagagtgagaggaagcgccatgagctcaacaggcaggtcacggtccagcggaaagagaaggatttccagggcatgctggagtaccacaaagaggacgaggccctcctcatccggaacctggtgacagacttgaagccccagatgctgtcgggcacagtgccctgtctccccgcctacatcctctacatgtgcatccggcacgcggactacaccaacgacgatctcaaggtgcactccctgctgacctccaccatcaacggcattaagaaagtcctgaaaaagcacaatgatgactttgagatgacgtcattctggttatccaacacctgccgccttcttcactgtctgaagcagtacagcggggatgagggcttcatgactcagaacactgcaaagcagaatgaacactgtcttaagaattttgacctcaccgaataccgtcaggtgctgagtgacctttccattcagatctaccagcagctcattaaaattgccgagggcgtgttacagccgatgatagtttctgccatgttggaaaatgagagcattcagggtctatctggtgtgaagcccaccggctaccggaagcgctcctccagcatggcagatggggataactcatactgcctggaagctatcatccgccagatgaatgcctttcatacagtcatgtgtgaccagggcttggaccctgagatcatcctgcaggtattcaaacagctcttctacatgatcaacgcagtgactcttaacaacctgctcttgcggaaggacgtctgctcttggagcacaggcatgcaactcaggtacaatataagtcagcttgaggagtggcttcggggaagaaaccttcaccagagtggagcagttcagaccatggaacctctgatccaagcagcccagctcctgcaattaaagaagaaaacccaggaggacgcagaggctatctgctccctgtgtacctccctcagcacccagcagattgtcaaaattttaaacctttatactcccctgaatgaatttgaagaacgggtaacagtggcctttatacgaacaatccaggcacaactacaagagcggaatgaccctcagcaactgctattagatgccaagcacatgtttcctgttttgtttccatttaatccatcttctctaaccatggactcaatccacatcccagcgtgtctcaatctggaattcctcaatgaagtctgaagatgcatgtttccagcattagtttgattcccaatgtgagcaagaaggaagtatatacagtaaagtaaattcaaggatctgttaaatctggtaaaagtagatcaaatcagagattgacagcctgtggagggtgctgaactatacagaattagacacaactatgtcattattttttgtacctactgctcagaataaaaacacttgaaatatggaagattttaagtttgatttcagtccaacacatatacataatttatagacaccaagcagtccccatagacatataaaaggtgtcaattctataaaacgaagctgcctagttttgatctttgcatagaactagagaatgtccaaattaaaataccaaatatatataagtcacataaattgccttcaaagggctttaacaaataatggtactaataaccatgataatggcatatactgacatttcccaaagtttgcaaaccataggtgtggttgagtttgtggtgagatgttttaagaacaaaaatatggggatgagacttctgagaaatattcccaaaatattttttaatggctgattatacacagacagtggtgtaactgacctccagaccagacattttgagtactggtttctgaagcaaaattagaagtgccagtcctcagtgtgctcaaacgcttttgtgttatcttgatttaatggaagagattattaaaatgctgctatcccaaactccaagtgagaaagatggaaaaatattttgtttctgatgctagtccatacactttccaagtcccacaaaactttcacaaaaatgtatataagctaaatattagaaacggataacaaacttgttttatttatagatgtaaaaaccaaacaagtcaatatgaaagcttttaatctcttaataccattaagcttccagtaagagcatcacataatgctctactgttccagaaaccaaatagtaaaacaaactaaagttcgcacatcagatcatctgaaaaaccttcaaaaataatcagttcagggatattatacaaaagtttgggttttttttttttaagagaataaaatggcttaggtcaactttcccttttcaggttattttcaacgtttttcaaatttagcacacaaaaaattgtaaatatctctcccacaaaataaggattttaaaaaagtaattcagtaatataacaggcttagatgtttgctgctcttagaattttttttaacttgtttttggtttcttcaaaagcaagcattcaattggaaacccatattctttccacacttttttttactgtcttttctgtatttcttgatagcagtatgctgttcccataagaaaaaaatggtatttgcaaatcatggaagaacagcctctgtattacattgagaaaataagatttatccatgaattggaagtagaacagcctgccttcaccctcttttactcaaccacccaacttaaaaggctcttggaaacacagcacactccacgctaccttctgcactgtgcccttagagcacagcttcctcagttgttctctgcatctcctggggcttaggccagtcttagcctgggttaaggctgctgacattgtgttccaatcagttgtcatgggcattatcccctctacatccacattaaacatgccggcttctcttgggcatcggcagagctgtgcctttttctttcagttacagttacataatcactgacgtccatgacacttacccatggatccatgtgctgacttcatttagaaggccaatctaaaacaactgggtttgtggctacctctttaaagttgtttgtgaaggataatttgttttttaatgcactttagtttgaaagtgagtctcttatgtaaggaccatccttaaaagaccaaaaatgccttgttagagtgttaaggagttttgacatgcagtggttccacaaacacagtggcttactatccttatacactgtcttataccatcattctctccatctctcttggtcactactctctgctgtcactggttaatcactaggtgccaagagcttactgaataaaagcttggcaattagaataaatggggagggaaggaccttatgaatagtccatttagcctaagaaatggcagatttagttcttctcttccaaaagataaaggtatatcctggaattgtacttaaaacttacagatgactaacaaatatatactttatatgtagttaatatttagatctgtcttatttaatacttggaggctagaagaagcatctttaggggaactatataatcttttgttagcattttctctgcattttaaaaaatcatttcaattcaaacatttatcagtgtcatgaaatcagtaatgactctttaacaattcaggtttgaactctgcattagatgtctctttaattttttaatatttaaaatttagttgacatttttttcaccaggtgcctttagcggttactaagataactgacatcagttgtttctctgaaataagtgttgctgtgggaataattttaatgttcaaggtgatatcatgggggagttttgtcttttaaaacattagaagcattttaaatattaagaatcaaatatttatagatcaaaacttgtgttttaagtattatacgggacctgtttacttatagtaaatgtgaatgtacacatgagttgttgctgaagctgacaagcatattacatacatgcattttccctgtgccctcatagttgcagttagagttccagtacctgtaggctcacctgggaggcagattagacccaaaggtagatgtttttcccctttccatgaagcatgtcagtgggagttgcttcctttgatttccctagtactaaattttaaggcttttgtaaaaacaaaacaaaactaggagcttggaacagttaaaaatcaacactgctaccatcaattcatcaaatatttacttagagctttcatacattaagattccagtaaccaataaattagaattcatttcttctgcataaagtaaattttcatacacttgacctactaagacagcaagggtgtcctaaattgaggcatttgtataatgcctgcataactaaatggtcactaaaatgggacagcatggggcaagaccttgtagttcttcacagaatatttgtggtcagtttctccaattaatttgctgcatgagccaaataaccataattcactttttatacccactggtgccataattagagaattagagggtgtagacagaggttaatgccaatgagaaacacaggacagggttttttttattataaaggtcattagatacaaaagattgtttttcaaaaaatttctaattctaacaaaggggatcaatcagaaatgaaactaagctactttctaaagtgacactgtatcagaataatccagatttgaatataacattttgccaccaactgacatttagatgaaggactgcctctctgaaagagttcagatcatattcaggggtgaatccaacaccatggaagaaagactactgatgaaaatattttcccactttgcacaaatctgtaaactacacctttgtttatagaaaaatgcttgtaatagtcactgtaatatttagctgtggataaaaatttgtggaaataaatacttttgaataaagaggtgtgccaaatctaaatgaaattt

SEQ ID NO: 46 - protein, 1848 aa, Homo sapiens
MSVGELYSQCTRVWIPDPDEVWRSAELTKDYKEGDKSLQLRLEDETILEYPIDVQRNQLPFLRNPDILVGENDLTALSYLHEPAVLHNLKVRFLESNHIYTYCGIVLVAINPYEQLPIYGQDVIYTYSGQNMGDMDPHIFAVAEEAYKQMARDEKNQSIIVSGESGAGKTVSAKYAMRYFATVGGSASETNIEEKVLASSPIMEAIGNAKTTRNDNSSRFGKYIQIGFDKRYHIIGANMRTYLLEKSRVVFQADDERNYHIFYQLCAAAGLPEFKELALTSAEDFFYTSQGGDTSIEGVDDAEDFEKTRQAFTLLGVKESHQMSIFKIIASILHLGSVAIQAERDGDSCSISPQDVYLSNFCRLLGVEHSQMEHWLCHRKLVTTSETYVKTMSLQQVINARNALAKHIYAQLFGWIVEHINKALHTSLKQHSFIGVLDIYGFETFEVNSFEQFCINYANEKLQQQFNSHVFKLEQEEYMKEQIPWTLIDFYDNQPCIDLIEAKLGILDLLDEECKVPKGTDQNWAQKLYDRHSSSQHFQKPRMSNTAFIIVHFADKVEYLSDGFLEKNRDTVYEEQINILKASKFPLVADLFHDDKDPVPATTPGKGSSSKISVRSARPPMKVSNKEHKKTVGHQFRTSLHLLMETLNATTPHYVRCIKPNDEKLPFHFDPKRAVQQLRACGVLETIRISAAGYPSRWAYHDFFNRYRVLVKKRELANTDKKAICRSVLENLIKDPDKFQFGRTKIFFRAGQVAYLEKLRADKFRTATIMIQKTVRGWLQKVKYHRLKGATLTLQRYCRGHLARRLAEHLRRIRAAVVLQKHYRMQRARQAYQRVRRAAVVIQAFTRAMFVRRTYRQVLMEHKATTIQKHVRGWMARRHFQRLRDAAIVIQCAFRMLKARRELKALRIEARSAEHLKRLNVGMENKVVQLQRKIDEQNKEFKTLSEQLSVTTSTYTMEVERLKKELVHYQQSPGEDTSLRLQEEVESLRTELQRAHSERKILEDAHSREKDELRKRVADLEQENALLKDEKEQLNNQILCQSKDEFAQNSVKENLMKKELEEERSRYQNLVKEYSQLEQRYDNLRDEMTIIKQTPGHRRNPSNQSSLESDSNYPSISTSEIGDTEDALQQVEEIGLEKAAMDMTVFLKLQKRVRELEQERKKLQVQLEKREQQDSKKVQAEPPQTDIDLDPNADLAYNSLKRQELESENKKLKNDLNELRKAVADQATQNNSSHGSPDSYSLLLNQLKLAHEELEVRKEEVLILRTQIVSADQRRLAGRNAEPNINARSSWPNSEKHVDQEDAIEAYHGVCQTNSKTEDWGYLNEDGELGLAYQGLKQVARLLEAQLQAQSLEHEEEVEHLKAQLEALKEEMDKQQQTFCQTLLLSPEAQVEFGVQQEISRLTNENLDLKELVEKLEKNERKLKKQLKIYMKKAQDLEAAQALAQSERKRHELNRQVTVQRKEKDFQGMLEYHKEDEALLIRNLVTDLKPQMLSGTVPCLPAYILYMCIRHADYTNDDLKVHSLLTSTINGIKKVLKKHNDDFEMTSFWLSNTCRLLHCLKQYSGDEGFMTQNTAKQNEHCLKNFDLTEYRQVLSDLSIQIYQQLIKIAEGVLQPMIVSAMLENESIQGLSGVKPTGYRKRSSSMADGDNSYCLEAIIRQMNAFHTVMCDQGLDPEIILQVFKQLFYMINAVTLNNLLLRKDVCSWSTGMQLRYNISQLEEWLRGRNLHQSGAVQTMEPLIQAAQLLQLKKKTQEDAEAICSLCTSLSTQQIVKILNLYTPLNEFEERVTVAFIRTIQAQLQERNDPQQLLLDAKHMFPVLFPFNPSSLTMDSIHIPACLNLEFLNEV

SEQ ID NO: 47 - DNA, 5422 bp, Homo sapiens
tttgagcagttcgtgtgggtccgctcccaagctagggctgggctgttgcgcttgcgccaggggtcgcatgcagtcacgcgctgccgaccgcttccggtgcgccgcgagggccgccgggacgggtctccctggcgatccgtggtgtgccgctactgccggtgcagccgccaaaccggtgcctcggtgacgaccgtgtccctgccgtcttcctcgagctccccggggcttgacccccggggccctcggcaggcatcggtgaggagcctgcggagcgaacctgtgctcctattcttgcccttcaggaccccatatcgcgactccgaggaggggaagcgagaggggctgtcgcgactccgcgccgtgtgtcgccgggcggggccgcggggccggggctccttcagcccccgggatgcgcgcgcgagccctcgcctccacttccttgttgctgctgtcacgactggagccgcctctcgccgacagcggggagcgcgagtgcgccagccatccccctcgtccagccgccgggccaagcgcctccgggaatgtgagcggcgcagcttgcacgctcctccggccatggacgcatcatatgatggtactgaggtaactgtcgtgatggaggaaattgaggaagcctattgttacacctctcctgggccacccaagaagaagaaaaagtataaaatacatggagaaaagacaaagaaacccaggtctgcttaccttctgtactattacgacatctacctgaaagtgcagcaggagctcccccacctccctcagtctgagatcaataagaagattagtgagagttggaggcttctcagcgtggccgagaggagttactacttggagaaagccaaactagagaaggaaggtttggatcctaactctaagctctctgcactgactgctgtggttccggacatcccaggtttccgcaagatcctcccacgctcagattatatcatcatccccaagagcagcctgcaggaggaccggagctgccctcagctagagctatgtgtggctcagaaccagatgtccccgaaaggacctcctcttgtgtccaacactgccccggagacagtgcccagccatgcaggcatggcagagcagtgcctggctgtggaggccctggctgaggaggtgggagcccttacccagtcaggtgctgtacaggagattgccacctcagagatcctcagccaggatgtgctcctagaggacgcttccctagaagtaggggagagccaccaaccttaccagacaagcctggtaattgaagagaccttggtgaatggctcaccagacctccccactggaagcctggctgtgccccacccccaggttggggagagtgtatcagtggtaacagtcatgagggattccagtgagagtagctcctctgcaccagccacacagttcatcatgttgcctctgcctgcctactcggttgtggagaaccccacctccatcaaactgaccactacatatacccgccggggccatgggacatgcaccagcccagggtgctcctttacatatgtcaccaggcacaagccacctaagtgccctacctgtggtaacttcctaggagggaagtggatcccaaaggaaaagccagccaaagtaaaagtggaattggcttctggcgtctcttccaaaggctctgtggtgaaaagaaatcagcaacctgtcaccactgagcaaaattcctctaaggaaaatgcctccaaactgactctggagaattcggaagctgtaagccagctcctgaacgtagctcctcccagagaagtaggtgaggagagtgagtgggaggaagtgatcatctccgatgcccatgttttggttaaggaagctcccgggaattgtggtacagcagtcactaagacgccagtcgtcaaaagtggtgtgcagcctgaggtcactctggggacaactgacaatgacagtcctggagcagacgtaccaacaccatccgaggggacaagtacctccagtccactccctgctcctaaaaaacctacaggagttgacctgcttacccctgggtccagagctccagagcttaaaggcagagcacggggcaagccctcattactggctgcagcaagacccatgagagcaattttgccagccccagttaacgtggggcgaggcagcagcatgggactgcccagggccaggcaggccttttccctgagtgataagactccctctgtgaggacttgtggtctgaagccaagcacactgaagcagctgggccagcccattcaacagccatctggccctggtgaggtgaagctaccaagtggcccatccaacaggacttctcaggtgaaagttgtggaggtcaagcccgatatgtttcctccatataagtacagctgcactgtcacattggatttgggcctggctacatcaagaggccggggaaagtgcaagaatccctcttgtagctatgtctacaccaacaggcacaaacctcgaatttgtcccagctgtggtgttaaccttgccaaagaccggactgagaaaaccaccaaggctatcgaggtgagctcaccactcccagatgtactgaatgccacagagcccctgagcacagcccagagggagatccagcgccagtccacactgcagctgctgcgcaaagtcctgcagattcctgagaatgagtcagagctggctgaggtcttcgccttgattcatgaactcaacagctctcgacttatcttgtccaacgtgagtgaggagacagtcaccatcgagcaaacctcttggtcgaattattatgagtctccgtccacgcagtgccttctctgtagcagcccattattcaaagggggacaaaactccctggctgggccccaggagtgctggctgctgacagccagccgtctgcagacagtgactgcccaggtgaagatgtgtctgaacccccattgtctggccctgcacagcttcatagacatctacacaggtctctttaatgtggggaacaagctgctggtaagcctggacttgctttttgcaatcagaaatcagatcaagctcggagaggaccccagagtgtccatcaatgttgttctgaagtcggtgcaggagcagacagagaagactctgacctcggaggagctgagccagctgcaggagctgctgtgcaatggctattgggcctttgagtgcctcactgtccgagactacaatgacatgatctgtggcatctgtggtgtggcccccaaagtggaaatggctcagaggagtgaagagaatgtgctagcactgaagagcgtggagttcacctggcctgaattcctgggctctaatgaggtaaatgtggaggacttttgggccacgatggagacagaggtgattgagcaggtggcatttcctgccagcatccctatcaccaaatttgatgcgtctgttattgcccccttcttcccaccactcatgagaggagctgtggtcgtcaacactgagaaagacaaaaacctggatgtgcagccagtacctggcagtggcagtgccttggtgaggctgctccaggagggcacctgcaagcttgatgagattggctcctacagtgaagagaagctgcagcacctgctaaggcagtgtggaatcccctttggggcagaagactccaaggaccagctctgcttctccttgttggccctctacgaatctgtacagaatggagctagagctatacggcccccacgtcacttcacaggtggtaaaatctacaaggtgtgcccccatcaggtggtctgcggctccaagtatcttgtgcgaggtgagagtgcccgtgaccatgtggacctgcttgcctcttcccgccactggccgcctgtctatgtggtagatatggccacgtcagtggccctgtgtgctgacctctgctacccagagctgactaaccagatgtgggggaggaaccagggctgtttctctagccccacagagccacctgtgagtgtgtcctgcccagagctcttggaccagcattatactgtggacatgacagaaactgagcactctatccagcacccagtcaccaagactgccacgcggcgcatcgtccatgcaggcctacagcccaatcctggtgaccccagtgctgggcaccactccttggccctgtgccctgaattggcaccttacgcaaccatcctggcctccatcgtggacagcaaaccaaacggtgtccgccagcggcccattgccttcgacaatgccactcactattacctctacaaccgcctcatggacttcctcaccagccgcgaaattgtcaatcgtcagatccatgacattgtacagagctgccagcctggtgaggtggtcattcgtgacaccctctaccgccttggggttgctcagatcaagacagagacagaggaggagggtgaggaagaggaggtggccgcagtggcagaataagccaggctgttgtacagggactacaccatctctcaagccatagtaaggcccttgcctgaggcagagctatccaggggacctgcagaagtggtctcctgtggggagggcctctgactgctgggactgaccaaagagcttccattccctgagcatggtgggacccagggtcctcagttctcaaccctccaggggtcaggagtggtaccaggaaacctcttctggccccgagagagcacttgggggacacggtatgtttaatggaggggaggctgagggaaaggctcgtagctggtgggttccgtggggcctgcggtgtgggtcagggtggaggtcctgggtgggctaaggcgtgagccccagcactaggtgggaaggctgctgaggtctctcccacccctgaggagccctggtttcagccccctcagtctgatgaattgcttagcctgttgcctttgactaggggcctgggtggcctcattaactctaggggtccctttgggctcttgattctccctgaaggagggatgcatttctctcttgctcttcctgtacccacatttgggggaagctgaggagggaggaacagtcagccacagctctcttccagcactgtcctctccaccccaagctttgaggaagagcatccccttcctcctttccctggccactgctgctgcagccaatatcctctctgggcctgggaccctctccacagaggggatgtggtccctggtcatgacataacctagcagcagtaggaaaaactcccttctatgaaggggaagcagactgggccataaggaaacagcaggactggctcaagtgcccaaggtttgtttagggcctgggaattggccatgtgttaatttattgagtggagtaggtggctttttttccctccctcttcccccaacaagaataaagtttattaaattatctggttttggtgtaaaaaaaaaaaaaaaaa

SEQ ID NO: 48 - protein, 1292 aa, Homo sapiens
MDASYDGTEVTVVMEEIEEAYCYTSPGPPKKKKKYKIHGEKTKKPRSAYLLYYYDIYLKVQQELPHLPQSEINKKISESWRLLSVAERSYYLEKAKLEKEGLDPNSKLSALTAVVPDIPGFRKILPRSDYIIIPKSSLQEDRSCPQLELCVAQNQMSPKGPPLVSNTAPETVPSHAGMAEQCLAVEALAEEVGALTQSGAVQEIATSEILSQDVLLEDASLEVGESHQPYQTSLVIEETLVNGSPDLPTGSLAVPHPQVGESVSVVTVMRDSSESSSSAPATQFIMLPLPAYSVVENPTSIKLTTTYTRRGHGTCTSPGCSFTYVTRHKPPKCPTCGNFLGGKWIPKEKPAKVKVELASGVSSKGSVVKRNQQPVTTEQNSSKENASKLTLENSEAVSQLLNVAPPREVGEESEWEEVIISDAHVLVKEAPGNCGTAVTKTPVVKSGVQPEVTLGTTDNDSPGADVPTPSEGTSTSSPLPAPKKPTGVDLLTPGSRAPELKGRARGKPSLLAAARPMRAILPAPVNVGRGSSMGLPRARQAFSLSDKTPSVRTCGLKPSTLKQLGQPIQQPSGPGEVKLPSGPSNRTSQVKVVEVKPDMFPPYKYSCTVTLDLGLATSRGRGKCKNPSCSYVYTNRHKPRICPSCGVNLAKDRTEKTTKAIEVSSPLPDVLNATEPLSTAQREIQRQSTLQLLRKVLQIPENESELAEVFALIHELNSSRLILSNVSEETVTIEQTSWSNYYESPSTQCLLCSSPLFKGGQNSLAGPQECWLLTASRLQTVTAQVKMCLNPHCLALHSFIDIYTGLFNVGNKLLVSLDLLFAIRNQIKLGEDPRVSINVVLKSVQEQTEKTLTSEELSQLQELLCNGYWAFECLTVRDYNDMICGICGVAPKVEMAQRSEENVLALKSVEFTWPEFLGSNEVNVEDFWATMETEVIEQVAFPASIPITKFDASVIAPFFPPLMRGAVVVNTEKDKNLDVQPVPGSGSALVRLLQEGTCKLDEIGSYSEEKLQHLLRQCGIPFGAEDSKDQLCFSLLALYESVQNGARAIRPPRHFTGGKIYKVCPHQVVCGSKYLVRGESARDHVDLLASSRHWPPVYVVDMATSVALCADLCYPELTNQMWGRNQGCFSSPTEPPVSVSCPELLDQHYTVDMTETEHSIQHPVTKTATRRIVHAGLQPNPGDPSAGHHSLALCPELAPYATILASIVDSKPNGVRQRPIAFDNATHYYLYNRLMDFLTSREIVNRQIHDIVQSCQPGEVVIRDTLYRLGVAQIKTETEEEGEEEEVAAVAE

SEQ ID NO: 49 - DNA, 4534 bp, Homo sapiens
aggccagccggcgcccgcgcggacactttcagccccgagccgcggccgctcgggtcggacccacgcgcagcggccggagatgcagcggggcgccgcgctgtgcctgcgactgtggctctgcctgggactcctggacggcctggtgagtggctactccatgacccccccgaccttgaacatcacggaggagtcacacgtcatcgacaccggtgacagcctgtccatctcctgcaggggacagcaccccctcgagtgggcttggccaggagctcaggaggcgccagccaccggagacaaggacagcgaggacacgggggtggtgcgagactgcgagggcacagacgccaggccctactgcaaggtgttgctgctgcacgaggtacatgccaacgacacaggcagctacgtctgctactacaagtacatcaaggcacgcatcgagggcaccacggccgccagctcctacgtgttcgtgagagactttgagcagccattcatcaacaagcctgacacgctcttggtcaacaggaaggacgccatgtgggtgccctgtctggtgtccatccccggcctcaatgtcacgctgcgctcgcaaagctcggtgctgtggccagacgggcaggaggtggtgtgggatgaccggcggggcatgctcgtgtccacgccactgctgcacgatgccctgtacctgcagtgcgagaccacctggggagaccaggacttcctttccaaccccttcctggtgcacatcacaggcaacgagctctatgacatccagctgttgcccaggaagtcgctggagctgctggtaggggagaagctggtcctgaactgcaccgtgtgggctgagtttaactcaggtgtcacctttgactgggactacccagggaagcaggcagagcggggtaagtgggtgcccgagcgacgctcccagcagacccacacagaactctccagcatcctgaccatccacaacgtcagccagcacgacctgggctcgtatgtgtgcaaggccaacaacggcatccagcgatttcgggagagcaccgaggtcattgtgcatgaaaatcccttcatcagcgtcgagtggctcaaaggacccatcctggaggccacggcaggagacgagctggtgaagctgcccgtgaagctggcagcgtaccccccgcccgagttccagtggtacaaggatggaaaggcactgtccgggcgccacagtccacatgccctggtgctcaaggaggtgacagaggccagcacaggcacctacaccctcgccctgtggaactccgctgctggcctgaggcgcaacatcagcctggagctggtggtgaatgtgcccccccagatacatgagaaggaggcctcctcccccagcatctactcgcgtcacagccgccaggccctcacctgcacggcctacggggtgcccctgcctctcagcatccagtggcactggcggccctggacaccctgcaagatgtttgcccagcgtagtctccggcggcggcagcagcaagacctcatgccacagtgccgtgactggagggcggtgaccacgcaggatgccgtgaaccccatcgagagcctggacacctggaccgagtttgtggagggaaagaataagactgtgagcaagctggtgatccagaatgccaacgtgtctgccatgtacaagtgtgtggtctccaacaaggtgggccaggatgagcggctcatctacttctatgtgaccaccatccccgacggcttcaccatcgaatccaagccatccgaggagctactagagggccagccggtgctcctgagctgccaagccgacagctacaagtacgagcatctgcgctggtaccgcctcaacctgtccacgctgcacgatgcgcacgggaacccgcttctgctcgactgcaagaacgtgcatctgttcgccacccctctggccgccagcctggaggaggtggcacctggggcgcgccacgccacgctcagcctgagtatcccccgcgtcgcgcccgagcacgagggccactatgtgtgcgaagtgcaagaccggcgcagccatgacaagcactgccacaagaagtacctgtcggtgcaggccctggaagcccctcggctcacgcagaacttgaccgacctcctggtgaacgtgagcgactcgctggagatgcagtgcttggtggccggagcgcacgcgcccagcatcgtgtggtacaaagacgagaggctgctggaggaaaagtctggagtcgacttggcggactccaaccagaagctgagcatccagcgcgtgcgcgaggaggatgcgggacgctatctgtgcagcgtgtgcaacgccaagggctgcgtcaactcctccgccagcgtggccgtggaaggctccgaggataagggcagcatggagatcgtgatccttgtcggtaccggcgtcatcgctgtcttcttctgggtcctcctcctcctcatcttctgtaacatgaggaggccggcccacgcagacatcaagacgggctacctgtccatcatcatggaccccggggaggtgcctctggaggagcaatgcgaatacctgtcctacgatgccagccagtgggaattcccccgagagcggctgcacctggggagagtgctcggctacggcgccttcgggaaggtggtggaagcctccgctttcggcatccacaagggcagcagctgtgacaccgtggccgtgaaaatgctgaaagagggcgccacggccagcgagcaccgcgcgctgatgtcggagctcaagatcctcattcacatcggcaaccacctcaacgtggtcaacctcctcggggcgtgcaccaagccgcagggccccctcatggtgatcgtggagttctgcaagtacggcaacctctccaacttcctgcgcgccaagcgggacgccttcagcccctgcgcggagaagtctcccgagcagcgcggacgcttccgcgccatggtggagctcgccaggctggatcggaggcggccggggagcagcgacagggtcctcttcgcgcggttctcgaagaccgagggcggagcgaggcgggcttctccagaccaagaagctgaggacctgtggctgagcccgctgaccatggaagatcttgtctgctacagcttccaggtggccagagggatggagttcctggcttcccgaaagtgcatccacagagacctggctgctcggaacattctgctgtcggaaagcgacgtggtgaagatctgtgactttggccttgcccgggacatctacaaagaccccgactacgtccgcaagggcagtgcccggctgcccctgaagtggatggcccctgaaagcatcttcgacaaggtgtacaccacgcagagtgacgtgtggtcctttggggtgcttctctgggagatcttctctctgggggcctccccgtaccctggggtgcagatcaatgaggagttctgccagcggctgagagacggcacaaggatgagggccccggagctggccactcccgccatacgccgcatcatgctgaactgctggtccggagaccccaaggcgagacctgcattctcggagctggtggagatcctgggggacctgctccagggcaggggcctgcaagaggaagaggaggtctgcatggccccgcgcagctctcagagctcagaagagggcagcttctcgcaggtgtccaccatggccctacacatcgcccaggctgacgctgaggacagcccgccaagcctgcagcgccacagcctggccgccaggtattacaactgggtgtcctttcccgggtgcctggccagaggggctgagacccgtggttcctccaggatgaagacatttgaggaattccccatgaccccaacgacctacaaaggctctgtggacaaccagacagacagtgggatggtgctggcctcggaggagtttgagcagatagagagcaggcatagacaagaaagcggcttcaggtagctgaagcagagagagagaaggcagcatacgtcagcattttcttctctgcacttataagaaagatcaaagactttaagactttcgctatttcttctactgctatctactacaaacttcaaagaggaaccaggaggacaagaggagcatgaaagtggacaaggagtgtgaccactgaagcaccacagggaggggttaggcctccggatgactgcgggcaggcctggataatatccagcctcccacaagaagctggtggagcagagtgttccctgactcctccaaggaaagggagacgccctttcatggtctgctgagtaacaggtgccttcccagacactggcgttactgcttgaccaaagagccctcaagcggcccttatgccagcgtgacagagggctcacctcttgccttctaggtcacttctcacaatgtcccttcagcacctgaccctgtgcccaccagttattccttggtaatatgagtaatacatcaaagagtagtattaaaagctaattaatcatgtttataaaaaaaaaaaaaaaaaaaaaaaaaaaaaaa

SEQ ID NO: 50 - protein, 1298 aa, Homo sapiens
MQRGAALCLRLWLCLGLLDGLVSGYSMTPPTLNITEESHVIDTGDSLSISCRGQHPLEWAWPGAQEAPATGDKDSEDTGVVRDCEGTDARPYCKVLLLHEVHANDTGSYVCYYKYIKARIEGTTAASSYVFVRDFEQPFINKPDTLLVNRKDAMWVPCLVSIPGLNVTLRSQSSVLWPDGQEVVWDDRRGMLVSTPLLHDALYLQCETTWGDQDFLSNPFLVHITGNELYDIQLLPRKSLELLVGEKLVLNCTVWAEFNSGVTFDWDYPGKQAERGKWVPERRSQQTHTELSSILTIHNVSQHDLGSYVCKANNGIQRFRESTEVIVHENPFISVEWLKGPILEATAGDELVKLPVKLAAYPPPEFQWYKDGKALSGRHSPHALVLKEVTEASTGTYTLALWNSAAGLRRNISLELVVNVPPQIHEKEASSPSIYSRHSRQALTCTAYGVPLPLSIQWHWRPWTPCKMFAQRSLRRRQQQDLMPQCRDWRAVTTQDAVNPIESLDTWTEFVEGKNKTVSKLVIQNANVSAMYKCVVSNKVGQDERLIYFYVTTIPDGFTIESKPSEELLEGQPVLLSCQADSYKYEHLRWYRLNLSTLHDAHGNPLLLDCKNVHLFATPLAASLEEVAPGARHATLSLSIPRVAPEHEGHYVCEVQDRRSHDKHCHKKYLSVQALEAPRLTQNLTDLLVNVSDSLEMQCLVAGAHAPSIVWYKDERLLEEKSGVDLADSNQKLSIQRVREEDAGRYLCSVCNAKGCVNSSASVAVEGSEDKGSMEIVILVGTGVIAVFFWVLLLLIFCNMRRPAHADIKTGYLSIIMDPGEVPLEEQCEYLSYDASQWEFPRERLHLGRVLGYGAFGKVVEASAFGIHKGSSCDTVAVKMLKEGATASEHRALMSELKILIHIGNHLNVVNLLGACTKPQGPLMVIVEFCKYGNLSNFLRAKRDAFSPCAEKSPEQRGRFRAMVELARLDRRRPGSSDRVLFARFSKTEGGARRASPDQEAEDLWLSPLTMEDLVCYSFQVARGMEFLASRKCIHRDLAARNILLSESDVVKICDFGLARDIYKDPDYVRKGSARLPLKWMAPESIFDKVYTTQSDVWSFGVLLWEIFSLGASPYPGVQINEEFCQRLRDGTRMRAPELATPAIRRIMLNCWSGDPKARPAFSELVEILGDLLQGRGLQEEEEVCMAPRSSQSSEEGSFSQVSTMALHIAQADAEDSPPSLQRHSLAARYYNWVSFPGCLARGAETRGSSRMKTFEEFPMTPTTYKGSVDNQTDSGMVLASEEFEQIESRHRQESGFR

SEQ ID NO: 51 - DNA, 16599 bp, Homo sapiens
ctgcttcacttcacggggcgaacatggcgcacagctgtcggtggcgcttccccgcccgacccgggaccaccgggggcggcggcggcggggggcgccggggcctagggggcgccccgcggcaacgcgtcccggccctgctgcttccccccgggcccccggtcggcggtggcggccccggggcgcccccctcccccccggctgtggcggccgcggcggcggcggcgggaagcagcggggctggggttccagggggagcggccgccgcctcagcagcctcctcgtcgtccgcctcgtcttcgtcttcgtcatcgtcctcagcctcttcagggccggccctgctccgggtgggcccgggcttcgacgcggcgctgcaggtctcggccgccatcggcaccaacctgcgccggttccgggccgtgtttggggagagcggcgggggaggcggcagcggagaggatgagcaattcttaggttttggctcagatgaagaagtcagagtgcgaagtcccacaaggtctccttcagttaaaactagtcctcgaaaacctcgtgggagacctagaagtggctctgaccgaaattcagctatcctctcagatccatctgtgttttcccctctaaataaatcagagaccaaatctggagataagatcaagaagaaagattctaaaagtatagaaaagaagagaggaagacctcccaccttccctggagtaaaaatcaaaataacacatggaaaggacatttcagagttaccaaagggaaacaaagaagatagcctgaaaaaaattaaaaggacaccttctgctacgtttcagcaagccacaaagattaaaaaattaagagcaggtaaactctctcctctcaagtctaagtttaagacagggaagcttcaaataggaaggaagggggtacaaattgtacgacggagaggaaggcctccatcaacagaaaggataaagaccccttcgggtctcctcattaattctgaactggaaaagccccagaaagtccggaaagacaaggaaggaacacctccacttacaaaagaagataagacagttgtcagacaaagccctcgaaggattaagccagttaggattattccttcttcaaaaaggacagatgcaaccattgctaagcaactcttacagagggcaaaaaagggggctcaaaagaaaattgaaaaagaagcagctcagctgcagggaagaaaggtgaagacacaggtcaaaaatattcgacagttcatcatgcctgttgtcagtgctatctcctcgcggatcattaagacccctcggcggtttatagaggatgaggattatgaccctccaattaaaattgcccgattagagtctacaccgaatagtagattcagtgccccgtcctgtggatcttctgaaaaatcaagtgcagcttctcagcactcctctcaaatgtcttcagactcctctcgatctagtagccccagtgttgatacctccacagactctcaggcttctgaggagattcaggtacttcctgaggagcggagcgatacccctgaagttcatcctccactgcccatttcccagtccccagaaaatgagagtaatgataggagaagcagaaggtattcagtgtcggagagaagttttggatctagaacgacgaaaaaattatcaactctacaaagtgccccccagcagcagacctcctcgtctccacctccacctctgctgactccaccgccaccactgcagccagcctccagtatctctgaccacacaccttggcttatgcctccaacaatccccttagcatcaccatttttgcctgcttccactgctcctatgcaagggaagcgaaaatctattttgcgagaaccgacatttaggtggacttctttaaagcattctaggtcagagccacaatacttttcctcagcaaagtatgccaaagaaggtcttattcgcaaaccaatatttgataatttccgaccccctccactaactcccgaggacgttggctttgcatctggtttttctgcatctggtaccgctgcttcagcccgattgttttcgccactccattctggaacaaggtttgatatgcacaaaaggagccctcttctgagagctccaagatttactccaagtgaggctcactctagaatatttgagtctgtaaccttgcctagtaatcgaacttctgctggaacatcttcttcaggagtatccaatagaaaaaggaaaagaaaagtgtttagtcctattcgatctgaaccaagatctccttctcactccatgaggacaagaagtggaaggcttagtagttctgagctctcacctctcacccccccgtcttctgtctcttcctcgttaagcatttctgttagtcctcttgccactagtgccttaaacccaacttttacttttccttctcattccctgactcagtctggggaatctgcagagaaaaatcagagaccaaggaagcagactagtgctccggcagagccattttcatcaagtagtcctactcctctcttcccttggtttaccccaggctctcagactgaaagagggagaaataaagacaaggcccccgaggagctgtccaaagatcgagatgctgacaagagcgtggagaaggacaagagtagagagagagaccgggagagagaaaaggagaataagcgggagtcaaggaaagagaaaaggaaaaagggatcagaaattcagagtagttctgctttgtatcctgtgggtagggtttccaaagagaaggttgttggtgaagatgttgccacttcatcttctgccaaaaaagcaacagggcggaagaagtcttcatcacatgattctgggactgatattacttctgtgactcttggggatacaacagctgtcaaaaccaaaatacttataaagaaagggagaggaaatctggaaaaaaccaacttggacctcggcccaactgccccatccctggagaaggagaaaaccctctgcctttccactccttcatctagcactgttaaacattccacttcctccataggctccatgttggctcaggcagacaagcttccaatgactgacaagagggttgccagcctcctaaaaaaggccaaagctcagctctgcaagattgagaagagtaagagtcttaaacaaaccgaccagcccaaagcacagggtcaagaaagtgactcatcagagacctctgtgcgaggaccccggattaaacatgtctgcagaagagcagctgttgcccttggccgaaaacgagctgtgtttcctgatgacatgcccaccctgagtgccttaccatgggaagaacgagaaaagattttgtcttccatggggaatgatgacaagtcatcaattgctggctcagaagatgctgaacctcttgctccacccatcaaaccaattaaacctgtcactagaaacaaggcaccccaggaacctccagtaaagaaaggacgtcgatcgaggcggtgtgggcagtgtcccggctgccaggtgcctgaggactgtggtgtttgtactaattgcttagataagcccaagtttggtggtcgcaatataaagaagcagtgctgcaagatgagaaaatgtcagaatctacaatggatgccttccaaagcctacctgcagaagcaagctaaagctgtgaaaaagaaagagaaaaagtctaagaccagtgaaaagaaagacagcaaagagagcagtgttgtgaagaacgtggtggactctagtcagaaacctaccccatcagcaagagaggatcctgccccaaagaaaagcagtagtgagcctcctccacgaaagcccgtcgaggaaaagagtgaagaagggaatgtctcggcccctgggcctgaatccaaacaggccaccactccagcttccaggaagtcaagcaagcaggtctcccagccagcactggtcatcccgcctcagccacctactacaggaccgccaagaaaagaagttcccaaaaccactcctagtgagcccaagaaaaagcagcctccaccaccagaatcaggtccagagcagagcaaacagaaaaaagtggctccccgcccaagtatccctgtaaaacaaaaaccaaaagaaaaggaaaaaccacctccggtcaataagcaggagaatgcaggcactttgaacatcctcagcactctctccaatggcaatagttctaagcaaaaaattccagcagatggagtccacaggatcagagtggactttaaggaggattgtgaagcagaaaatgtgtgggagatgggaggcttaggaatcttgacttctgttcctataacacccagggtggtttgctttctctgtgccagtagtgggcatgtagagtttgtgtattgccaagtctgttgtgagcccttccacaagttttgtttagaggagaacgagcgccctctggaggaccagctggaaaattggtgttgtcgtcgttgcaaattctgtcacgtttgtggaaggcaacatcaggctacaaagcagctgctggagtgtaataagtgccgaaacagctatcaccctgagtgcctgggaccaaactaccccaccaaacccacaaagaagaagaaagtctggatctgtaccaagtgtgttcgctgtaagagctgtggatccacaactccaggcaaagggtgggatgcacagtggtctcatgatttctcactgtgtcatgattgcgccaagctctttgctaaaggaaacttctgccctctctgtgacaaatgttatgatgatgatgactatgagagtaagatgatgcaatgtggaaagtgtgatcgctgggtccattccaaatgtgagaatctttcagatgagatgtatgagattctatctaatctgccagaaagtgtggcctacacttgtgtgaactgtactgagcggcaccctgcagagtggcgactggcccttgaaaaagagctgcagatttctctgaagcaagttctgacagctttgttgaattctcggactaccagccatttgctacgctaccggcaggctgccaagcctccagacttaaatcccgagacagaggagagtataccttcccgcagctcccccgaaggacctgatccaccagttcttactgaggtcagcaaacaggatgatcagcagcctttagatctagaaggagtcaagaggaagatggaccaagggaattacacatctgtgttggagttcagtgatgatattgtgaagatcattcaagcagccattaattcagatggaggacagccagaaattaaaaaagccaacagcatggtcaagtccttcttcattcggcaaatggaacgtgtttttccatggttcagtgtcaaaaagtccaggttttgggagccaaataaagtatcaagcaacagtgggatgttaccaaacgcagtgcttccaccttcacttgaccataattatgctcagtggcaggagcgagaggaaaacagccacactgagcagcctcctttaatgaagaaaatcattccagctcccaaacccaaaggtcctggagaaccagactcaccaactcctctgcatcctcctacaccaccaattttgagtactgataggagtcgagaagacagtccagagctgaacccacccccaggcatagaagacaatagacagtgtgcgttatgtttgacttatggtgatgacagtgctaatgatgctggtcgtttactatatattggccaaaatgagtggacacatgtaaattgtgctttgtggtcagcggaagtgtttgaagatgatgacggatcactaaagaatgtgcatatggctgtgatcaggggcaagcagctgagatgtgaattctgccaaaagccaggagccaccgtgggttgctgtctcacatcctgcaccagcaactatcacttcatgtgttcccgagccaagaactgtgtctttctggatgataaaaaagtatattgccaacgacatcgggatttgatcaaaggcgaagtggttcctgagaatggatttgaagttttcagaagagtgtttgtggactttgaaggaatcagcttgagaaggaagtttctcaatggcttggaaccagaaaatatccacatgatgattgggtctatgacaatcgactgcttaggaattctaaatgatctctccgactgtgaagataagctctttcctattggatatcagtgttccagggtatactggagcaccacagatgctcgcaagcgctgtgtatatacatgcaagatagtggagtgccgtcctccagtcgtagagccggatatcaacagcactgttgaacatgatgaaaacaggaccattgcccatagtccaacatcttttacagaaagttcatcaaaagagagtcaaaacacagctgaaattataagtcctccatcaccagaccgacctcctcattcacaaacctctggctcctgttattatcatgtcatctcaaaggtccccaggattcgaacacccagttattctccaacacagagatcccctggctgtcgaccgttgccttctgcaggaagtcctaccccaaccactcatgaaatagtcacagtaggtgatcctttactctcctctggacttcgaagcattggctccaggcgtcacagtacctcttccttatcaccccagcggtccaaactccggataatgtctccaatgagaactgggaatacttactctaggaataatgtttcctcagtctccaccaccgggaccgctactgatcttgaatcaagtgccaaagtagttgatcatgtcttagggccactgaattcaagtactagtttagggcaaaacacttccacctcttcaaatttgcaaaggacagtggttactgtaggcaataaaaacagtcacttggatggatcttcatcttcagaaatgaagcagtccagtgcttcagacttggtgtccaagagctcctctttaaagggagagaagaccaaagtgctgagttccaagagctcagagggatctgcacataatgtggcttaccctggaattcctaaactggccccacaggttcataacacaacatctagagaactgaatgttagtaaaatcggctcctttgctgaaccctcttcagtgtcgttttcttctaaagaggccctctccttcccacacctccatttgagagggcaaaggaatgatcgagaccaacacacagattctacccaatcagcaaactcctctccagatgaagatactgaagtcaaaaccttgaagctatctggaatgagcaacagatcatccattatcaacgaacatatgggatctagttccagagataggagacagaaagggaaaaaatcctgtaaagaaactttcaaagaaaagcattccagtaaatcttttttggaacctggtcaggtgacaactggtgaggaaggaaacttgaagccagagtttatggatgaggttttgactcctgagtatatgggccaacgaccatgtaacaatgtttcttctgataagattggtgataaaggcctttctatgccaggagtccccaaagctccacccatgcaagtagaaggatctgccaaggaattacaggcaccacggaaacgcacagtcaaagtgacactgacacctctaaaaatggaaaatgagagtcaatccaaaaatgccctgaaagaaagtagtcctgcttcccctttgcaaatagagtcaacatctcccacagaaccaatttcagcctctgaaaatccaggagatggtccagtggcccaaccaagccccaataatacctcatgccaggattctcaaagtaacaactatcagaatcttccagtacaggacagaaacctaatgcttccagatggccccaaacctcaggaggatggctcttttaaaaggaggtatccccgtcgcagtgcccgtgcacgttctaacatgttttttgggcttaccccactctatggagtaagatcctatggtgaagaagacattccattctacagcagctcaactgggaagaagcgaggcaagagatcagctgaaggacaggtggatggggccgatgacttaagcacttcagatgaagacgacttatactattacaacttcactagaacagtgatttcttcaggtggagaggaacgactggcatcccataatttatttcgggaggaggaacagtgtgatcttccaaaaatctcacagttggatggtgttgatgatgggacagagagtgatactagtgtcacagccacaacaaggaaaagcagccagattccaaaaagaaatggtaaagaaaatggaacagagaacttaaagattgatagacctgaagatgctggggagaaagaacatgtcactaagagttctgttggccacaaaaatgagccaaagatggataactgccattctgtaagcagagttaaaacacagggacaagattccttggaagctcagctcagctcattggagtcaagccgcagagtccacacaagtaccccctccgacaaaaatttactggacacctataatactgagctcctgaaatcagattcagacaataacaacagtgatgactgtgggaatatcctgccttcagacattatggactttgtactaaagaatactccatccatgcaggctttgggtgagagcccagagtcatcttcatcagaactcctgaatcttggtgaaggattgggtcttgacagtaatcgtgaaaaagacatgggtctttttgaagtattttctcagcagctgcctacaacagaacctgtggatagtagtgtctcttcctctatctcagcagaggaacagtttgagttgcctctagagctaccatctgatctgtctgtcttgaccacccggagtcccactgtccccagccagaatcccagtagactagctgttatctcagactcaggggagaagagagtaaccatcacagaaaaatctgtagcctcctctgaaagtgacccagcactgctgagcccaggagtagatccaactcctgaaggccacatgactcctgatcattttatccaaggacacatggatgcagaccacatctctagccctccttgtggttcagtagagcaaggtcatggcaacaatcaggatttaactaggaacagtagcacccctggccttcaggtacctgtttccccaactgttcccatccagaaccagaagtatgtgcccaattctactgatagtcctggcccgtctcagatttccaatgcagctgtccagaccactccaccccacctgaagccagccactgagaaactcatagttgttaaccagaacatgcagccactttatgttctccaaactcttccaaatggagtgacccaaaaaatccaattgacctcttctgttagttctacacccagtgtgatggagacaaatacttcagtattgggacccatgggaggtggtctcacccttaccacaggactaaatccaagcttgccaacttctcaatctttgttcccttctgctagcaaaggattgctacccatgtctcatcaccagcacttacattccttccctgcagctactcaaagtagtttcccaccaaacatcagcaatcctccttcaggcctgcttattggggttcagcctcctccggatccccaacttttggtttcagaatccagccagaggacagacctcagtaccacagtagccactccatcctctggactcaagaaaagacccatatctcgtctacagacccgaaagaataaaaaacttgctccctctagtaccccttcaaacattgccccttctgatgtggtttctaatatgacattgattaacttcacaccctcccagcttcctaatcatccaagtctgttagatttggggtcacttaatacttcatctcaccgaactgtccccaacatcataaaaagatctaaatctagcatcatgtattttgaaccggcacccctgttaccacagagtgtgggaggaactgctgccacagcggcaggcacatcaacaataagccaggatactagccacctcacatcagggtctgtgtctggcttggcatccagttcctctgtcttgaatgttgtatccatgcaaactaccacaacccctacaagtagtgcgtcagttccaggacacgtcaccttaaccaacccaaggttgcttggtaccccagatattggctcaataagcaatcttttaatcaaagctagccagcagagcctggggattcaggaccagcctgtggctttaccgccaagttcaggaatgtttccacaactggggacatcacagaccccctctactgctgcaataacagcggcatctagcatctgtgtgctcccctccactcagactacgggcataacagccgcttcaccttctggggaagcagacgaacactatcagcttcagcatgtgaaccagctccttgccagcaaaactgggattcattcttcccagcgtgatcttgattctgcttcagggccccaggtatccaactttacccagacggtagacgctcctaatagcatgggactggagcagaacaaggctttatcctcagctgtgcaagccagccccacctctcctgggggttctccatcctctccatcttctggacagcggtcagcaagcccttcagtgccgggtcccactaaacccaaaccaaaaaccaaacggtttcagctgcctctagacaaagggaatggcaagaagcacaaagtttcccatttgcggaccagttcttctgaagcacacattccagaccaagaaacgacatccctgacctcaggcacagggactccaggagcagaggctgagcagcaggatacagctagcgtggagcagtcctcccagaaggagtgtgggcaacctgcagggcaagtcgctgttcttccggaagttcaggtgacccaaaatccagcaaatgaacaagaaagtgcagaacctaaaacagtggaagaagaggaaagtaatttcagctccccactgatgctttggcttcagcaagaacaaaagcggaaggaaagcattactgagaaaaaacccaagaaaggacttgtttttgaaatttccagtgatgatggctttcagatctgtgcagaaagtattgaagatgcctggaagtcattgacagataaagtccaggaagctcgatcaaatgcccgcctaaagcagctctcatttgcaggtgttaacggtttgaggatgctggggattctccatgatgcagttgtgttcctcattgagcagctgtctggtgccaagcactgtcgaaattacaaattccgtttccacaagccagaggaggccaatgaaccccccttgaaccctcacggctcagccagggctgaagtccacctcaggaagtcagcatttgacatgtttaacttcctggcttctaaacatcgtcagcctcctgaatacaaccccaatgatgaagaagaggaggaggtacagctgaagtcagctcggagggcaactagcatggatctgccaatgcccatgcgcttccggcacttaaaaaagacttctaaggaggcagttggtgtctacaggtctcccatccatggccggggtcttttctgtaagagaaacattgatgcaggtgagatggtgattgagtatgccggcaacgtcatccgctccatccagactgacaagcgggaaaagtattacgacagcaagggcattggttgctatatgttccgaattgatgactcagaggtagtggatgccaccatgcatggaaatgctgcacgcttcatcaatcactcgtgtgagcctaactgctattctcgggtcatcaatattgatgggcagaagcacattgtcatctttgccatgcgtaagatctaccgaggagaggaactcacttacgactataagttccccattgaggatgccagcaacaagctgccctgcaactgtggcgccaagaaatgccggaagttcctaaactaaagctgctcttctcccccagtgttggagtgcaaggaggcggggccatccaaagcaacgctgaaggccttttccagcagctgggagctcccggattgcgtggcacagctgaggggcctctgtgatggctgagctctcttatgtcctatactcacatcagacatgtgatcatagtcccagagacagagttgaggtctcgaagaaaagatccatgatcggctttctcctggggcccctccaattgtttactgttagaaagtgggaatggggtccctagcagacttgcctggaaggagcctattatagagggttggttatgttgggagattgggcctgaatttctccacagaaataagttgccatcctcaggttggccctttcccaagcactgtaagtgagtgggtcaggcaaagccccaaatggagggttggttagattcctgacagtttgccagccaggccccacctacagcgtctgtcgaacaaacagaggtctggtggttttccctactatcctcccactcgagagttcacttctggttgggagacaggattcctagcacctccggtgtcaaaaggctgtcatggggttgtgccaattaattaccaaacattgagcctgcaggctttgagtgggagtgttgcccccaggagccttatctcagccaattacctttcttgacagtaggagcggcttccctctcccattccctcttcactcccttttcttcctttcccctgtcttcatgccactgctttcccatgcttctttcgggttgtaggggagactgactgcctgctcaaggacactccctgctgggcataggatgtgcctgcaaaaagttccctgagcctgtaagcactccaggtggggaagtggacaggagccattggtcataaccagacagaatttggaaacattttcataaagctccatggagagttttaaagaaacatatgtagcatgattttgtaggagaggaaaaagattatttaaataggatttaaatcatgcaacaacgagagtatcacagccaggatgacccttgggtcccattcctaagacatggttactttattttccccttgttaagacataggaagacttaatttttaaacggtcagtgtccagttgaaggcagaacactaatcagatttcaaggcccacaacttggggactagaccaccttatgttgagggaactctgccacctgcgtgcaacccacagctaaagtaaattcaatgacactactgccctgattactccttaggatgtggtcaaaacagcatcaaatgtttcttctcttcctttccccaagacagagtcctgaacctgttaaattaagtcattggattttactctgttctgtttacagtttactatttaaggttttataaatgtaaatatattttgtatatttttctatgagaagcacttcatagggagaagcacttatgacaaggctattttttaaaccgcggtattatcctaatttaaaagaagatcggtttttaataattttttattttcataggatgaagttagagaaaatattcagctgtacacacaaagtctggtttttcctgcccaacttccccctggaaggtgtactttttgttgtttaatgtgtagcttgtttgtgccctgttgacataaatgtttcctgggtttgctctttgacaataaatggagaaggaaggtcacccaactccattgggccactcccctccttcccctattgaagctcctcaaaaggctacagtaatatcttgatacaacagattctcttctttcccgcctctctcctttccggcgcaacttccagagtggtgggagacggcaatctttacatttccctcatctttcttacttcagagttagcaaacaacaagttgaatggcaacttgacatttttgcatcaccatctgcctcataggccactctttcctttccctctgcccaccaagtcctcatatctgcagagaacccattgatcaccttgtgccctcttttggggcagcctgttgaaactgaagcacagtctgaccactcacgataaagcagatttttctctgcctctgccacaaggtttcagagtagtgtagtccaagtagagggtggggcacccttttctcgccgcaagaagcccattcctatggaagtctagcaaagcaatacgactcagcccagcactctctgccccaggactcatggctctgctgtgccttccatcctgggctcccttctctcctgtgaccttaagaactttgtctggtggctttgctggaacattgtcactgttttcactgtcatgcagggagcccagcactgtggccaggatggcagagacttccttgtcatcatggagaagtgccagcaggggactgggaaaagcactctacccagacctcacctcccttcctccttttgcccatgaacaagatgcagtggccctaggggttccactagtgtctgctttcctttattattgcactgtgtgaggtttttttgtaaatccttgtattcctattttttttaaagaaaaaaaaaaaaccttaagctgcatttgttactgaaatgattaatgcactgatgggtcctgaattcaccttgagaaagacccaaaggccagtcagggggtggggggaactcagctaaatagacctagttactgccctgctaggccatgctgtactgtgagcccctcctcactctctaccaaccctaaaccctgaggacaggggaggaacccacagcttccttctcctgccagctgcagatggtttgccttgcctttccaccccctaattgtcaaccacaaaaatgagaaattcctcttctagctcagccttgagtccattgccaaattttcagcacacctgccagcaacttgggggaataagcgaaggtttccctacaagagggaaagaaggcaaaaacggcacagctatctccaaacacatctgagttcatttcaaaagtgaccaagggaatctccgcacaaaagtgcagattgaggaattgtgatgggtcattcccaagaatcccccaaggggcatcccaaatccctgaggagtaacagctgcaaacctggtcagttctcagtgagagccagctcacttatagctttgctgctagaacctgttgtggctgcatttcctggtggccagtgacaactgtgtaaccagaatagctgcatggcgctgaccctttggccggaacttggtctcttggctccctccttggccacccaccacctctcgcacagcccctctgtttttacaccaataacaagaattaagggggaagccctggcagctatacgttttcaaccagactcctttgccgggacccagcccgccaccctgctcgcctccgtcaaacccccggccaatgcagtgagcaccatgtagctcccttgatttaaaaaaaataaaaaataaaaaaaaaaggaaaaaaaaatacaacacacacacaaaaataaaaaaaatattctaatgaatgtatctttctaaaggactgacgttcaatcaaatatctgaaaatactaaaggtcaaaaccttgtcagatgttaacttctaagttcggtttgggattttttttttttaatagaaatcaagttgtttttgtttttaaggaaaagcgggtcattgcaaagggctgggtgtaattttatgtttcatttccttcattttaaagcaatacaaggttatggagcagatggttttgtgccgaatcatgaatactagtcaagtcacacactctggaaacttgcaactttttgtttgttttggttttcaaataaatataaatatgatatatataggaactaatatagtaatgcaccatgtaacaaagcctagttcagtccatggcttttaattctcttaacactatagataaggattgtgttacagttgctagtagcggcaggaagatgtcaggctcactttcctctgattcccgaaatggggggaacctctaaccataaaggaatggtagaacagtccattcctcggatcagagaaaaatgcagacatggtgtcacctggatttttttctgcccatgaatgttgccagtcagtacctgtcctccttgtttctctatttttggttatgaatgttggggttaccacctgcatttaggggaaaattgtgttctgtgctttcctggtatcttgttccgaggtactctagttctgtctttcaaccaagaaaatagaattgtggtgtttcttttattgaacttttaacagtctctttagtaaatacaggtagttgaataattgtttcaagagctcaacagatgacaagcttcttttctagaaataagacattttttgacaactttatcatgtataacagatctgttttttttccttgtgttcttccaagcttctggttagagaaaaagagaaaaaaaaaaaaggaaaatgtgtctaaagtccatcagtgttaactccctgtgacagggatgaaggaaaatactttaatagttcaaaaaataataatgctgaaagctctctacgaaagactgaatgtaaaagtaaaaagtgtacatagttgtaaaaaaaaggagtttttaaacatgtttattttctatgcacttttttttatttaagtgatagtttaattaataaacatgtcaagtttaaaaaaaaaaaaaaa

SEQ ID NO: 52 - protein, 3969 aa, Homo sapiens
MAHSCRWRFPARPGTTGGGGGGGRRGLGGAPRQRVPALLLPPGPPVGGGGPGAPPSPPAVAAAAAAAGSSGAGVPGGAAAASAASSSSASSSSSSSSSASSGPALLRVGPGFDAALQVSAAIGTNLRRFRAVFGESGGGGGSGEDEQFLGFGSDEEVRVRSPTRSPSVKTSPRKPRGRPRSGSDRNSAILSDPSVFSPLNKSETKSGDKIKKKDSKSIEKKRGRPPTFPGVKIKITHGKDISELPKGNKEDSLKKIKRTPSATFQQATKIKKLRAGKLSPLKSKFKTGKLQIGRKGVQIVRRRGRPPSTERIKTPSGLLINSELEKPQKVRKDKEGTPPLTKEDKTVVRQSPRRIKPVRIIPSSKRTDATIAKQLLQRAKKGAQKKIEKEAAQLQGRKVKTQVKNIRQFIMPVVSAISSRIIKTPRRFIEDEDYDPPIKIARLESTPNSRFSAPSCGSSEKSSAASQHSSQMSSDSSRSSSPSVDTSTDSQASEEIQVLPEERSDTPEVHPPLPISQSPENESNDRRSRRYSVSERSFGSRTTKKLSTLQSAPQQQTSSSPPPPLLTPPPPLQPASSISDHTPWLMPPTIPLASPFLPASTAPMQGKRKSILREPTFRWTSLKHSRSEPQYFSSAKYAKEGLIRKPIFDNFRPPPLTPEDVGFASGFSASGTAASARLFSPLHSGTRFDMHKRSPLLRAPRFTPSEAHSRIFESVTLPSNRTSAGTSSSGVSNRKRKRKVFSPIRSEPRSPSHSMRTRSGRLSSSELSPLTPPSSVSSSLSISVSPLATSALNPTFTFPSHSLTQSGESAEKNQRPRKQTSAPAEPFSSSSPTPLFPWFTPGSQTERGRNKDKAPEELSKDRDADKSVEKDKSRERDREREKENKRESRKEKRKKGSEIQSSSALYPVGRVSKEKVVGEDVATSSSAKKATGRKKSSSHDSGTDITSVTLGDTTAVKTKILIKKGRGNLEKTNLDLGPTAPSLEKEKTLCLSTPSSSTVKHSTSSIGSMLAQADKLPMTDKRVASLLKKAKAQLCKIEKSKSLKQTDQPKAQGQESDSSETSVRGPRIKHVCRRAAVALGRKRAVFPDDMPTLSALPWEEREKILSSMGNDDKSSIAGSEDAEPLAPPIKPIKPVTRNKAPQEPPVKKGRRSRRCGQCPGCQVPEDCGVCTNCLDKPKFGGRNIKKQCCKMRKCQNLQWMPSKAYLQKQAKAVKKKEKKSKTSEKKDSKESSVVKNVVDSSQKPTPSAREDPAPKKSSSEPPPRKPVEEKSEEGNVSAPGPESKQATTPASRKSSKQVSQPALVIPPQPPTTGPPRKEVPKTTPSEPKKKQPPPPESGPEQSKQKKVAPRPSIPVKQKPKEKEKPPPVNKQENAGTLNILSTLSNGNSSKQKIPADGVHRIRVDFKEDCEAENVWEMGGLGILTSVPITPRVVCFLCASSGHVEFVYCQVCCEPFHKFCLEENERPLEDQLENWCCRRCKFCHVCGRQHQATKQLLECNKCRNSYHPECLGPNYPTKPTKKKKVWICTKCVRCKSCGSTTPGKGWDAQWSHDFSLCHDCAKLFAKGNFCPLCDKCYDDDDYESKMMQCGKCDRWVHSKCENLSDEMYEILSNLPESVAYTCVNCTERHPAEWRLALEKELQISLKQVLTALLNSRTTSHLLRYRQAAKPPDLNPETEESIPSRSSPEGPDPPVLTEVSKQDDQQPLDLEGVKRKMDQGNYTSVLEFSDDIVKIIQAAINSDGGQPEIKKANSMVKSFFIRQMERVFPWFSVKKSRFWEPNKVSSNSGMLPNAVLPPSLDHNYAQWQEREENSHTEQPPLMKKIIPAPKPKGPGEPDSPTPLHPPTPPILSTDRSREDSPELNPPPGIEDNRQCALCLTYGDDSANDAGRLLYIGQNEWTHVNCALWSAEVFEDDDGSLKNVHMAVIRGKQLRCEFCQKPGATVGCCLTSCTSNYHFMCSRAKNCVFLDDKKVYCQRHRDLIKGEVVPENGFEVFRRVFVDFEGISLRRKFLNGLEPENIHMMIGSMTIDCLGILNDLSDCEDKLFPIGYQCSRVYWSTTDARKRCVYTCKIVECRPPVVEPDINSTVEHDENRTIAHSPTSFTESSSKESQNTAEIISPPSPDRPPHSQTSGSCYYHVISKVPRIRTPSYSPTQRSPGCRPLPSAGSPTPTTHEIVTVGDPLLSSGLRSIGSRRHSTSSLSPQRSKLRIMSPMRTGNTYSRNNVSSVSTTGTATDLESSAKVVDHVLGPLNSSTSLGQNTSTSSNLQRTVVTVGNKNSHLDGSSSSEMKQSSASDLVSKSSSLKGEKTKVLSSKSSEGSAHNVAYPGIPKLAPQVHNTTSRELNVSKIGSFAEPSSVSFSSKEALSFPHLHLRGQRNDRDQHTDSTQSANSSPDEDTEVKTLKLSGMSNRSSIINEHMGSSSRDRRQKGKKSCKETFKEKHSSKSFLEPGQVTTGEEGNLKPEFMDEVLTPEYMGQRPCNNVSSDKIGDKGLSMPGVPKAPPMQVEGSAKELQAPRKRTVKVTLTPLKMENESQSKNALKESSPASPLQIESTSPTEPISASENPGDGPVAQPSPNNTSCQDSQSNNYQNLPVQDRNLMLPDGPKPQEDGSFKRRYPRRSARARSNMFFGLTPLYGVRSYGEEDIPFYSSSTGKKRGKRSAEGQVDGADDLSTSDEDDLYYYNFTRTVISSGGEERLASHNLFREEEQCDLPKISQLDGVDDGTESDTSVTATTRKSSQIPKRNGKENGTENLKIDRPEDAGEKEHVTKSSVGHKNEPKMDNCHSVSRVKTQGQDSLEAQLSSLESSRRVHTSTPSDKNLLDTYNTELLKSDSDNNNSDDCGNILPSDIMDFVLKNTPSMQALGESPESSSSELLNLGEGLGLDSNREKDMGLFEVFSQQLPTTEPVDSSVSSSISAEEQFELPLELPSDLSVLTTRSPTVPSQNPSRLAVISDSGEKRVTITEKSVASSESDPALLSPGVDPTPEGHMTPDHFIQGHMDADHISSPPCGSVEQGHGNNQDLTRNSSTPGLQVPVSPTVPIQNQKYVPNSTDSPGPSQISNAAVQTTPPHLKPATEKLIVVNQNMQPLYVLQTLPNGVTQKIQLTSSVSSTPSVMETNTSVLGPMGGGLTLTTGLNPSLPTSQSLFPSASKGLLPMSHHQHLHSFPAATQSSFPPNISNPPSGLLIGVQPPPDPQLLVSESSQRTDLSTTVATPSSGLKKRPISRLQTRKNKKLAPSSTPSNIAPSDVVSNMTLINFTPSQLPNHPSLLDLGSLNTSSHRTVPNIIKRSKSSIMYFEPAPLLPQSVGGTAATAAGTSTISQDTSHLTSGSVSGLASSSSVLNVVSMQTTTTPTSSASVPGHVTLTNPRLLGTPDIGSISNLLIKASQQSLGIQDQPVALPPSSGMFPQLGTSQTPSTAAITAASSICVLPSTQTTGITAASPSGEADEHYQLQHVNQLLASKTGIHSSQRDLDSASGPQVSNFTQTVDAPNSMGLEQNKALSSAVQASPTSPGGSPSSPSSGQRSASPSVPGPTKPKPKTKRFQLPLDKGNGKKHKVSHLRTSSSEAHIPDQETTSLTSGTGTPGAEAEQQDTASVEQSSQKECGQPAGQVAVLPEVQVTQNPANEQESAEPKTVEEEESNFSSPLMLWLQQEQKRKESITEKKPKKGLVFEISSDDGFQICAESIEDAWKSLTDKVQEARSNARLKQLSFAGVNGLRMLGILHDAVVFLIEQLSGAKHCRNYKFRFHKPEEANEPPLNPHGSARAEVHLRKSAFDMFNFLASKHRQPPEYNPNDEEEEEVQLKSARRATSMDLPMPMRFRHLKKTSKEAVGVYRSPIHGRGLFCKRNIDAGEMVIEYAGNVIRSIQTDKREKYYDSKGIGCYMFRIDDSEVVDATMHGNAARFINHSCEPNCYSRVINIDGQKHIVIFAMRKIYRGEELTYDYKFPIEDASNKLPCNCGAKKCRKFLN

SEQ ID NO: 53 - DNA, 5234 bp, Homo sapiens
gccgccgccagggaaaagaaagggaggaaggaaggaacaagaaaaggaaataaagagaaaggggaggcggggaaaggcaacgagctgtccggcctccgtcaagggagttggagggaaaaagttctcaggcgccgcaggtccgagtgcctcgcagcccctcccgaggcgcagccgccagaccagtggagccggggcgcagggcgggggcggaggcgccggggcgggggatgcggggccgcggcgcagccccccggccctgagagcgaggacagcgccgcccggcccgcagccgtcgccgcttctccacctcggcccgtggagccggggcgtccgggcgtagccctcgctcgcctgggtcagggggtgcgcgtcgggggaggcagaagccatggatcccgggcagcagccgccgcctcaaccggccccccagggccaagggcagccgccttcgcagcccccgcaggggcagggcccgccgtccggacccgggcaaccggcacccgcggcgacccaggcggcgccgcaggcaccccccgccgggcatcagatcgtgcacgtccgcggggactcggagaccgacctggaggcgctcttcaacgccgtcatgaaccccaagacggccaacgtgccccagaccgtgcccatgaggctccggaagctgcccgactccttcttcaagccgccggagcccaaatcccactcccgacaggccagtactgatgcaggcactgcaggagccctgactccacagcatgttcgagctcattcctctccagcttctctgcagttgggagctgtttctcctgggacactgacccccactggagtagtctctggcccagcagctacacccacagctcagcatcttcgacagtcttcttttgagatacctgatgatgtacctctgccagcaggttgggagatggcaaagacatcttctggtcagagatacttcttaaatcacatcgatcagacaacaacatggcaggaccccaggaaggccatgctgtcccagatgaacgtcacagcccccaccagtccaccagtgcagcagaatatgatgaactcggcttcagccatgaaccagagaatcagtcagagtgctccagtgaaacagccaccacccctggctccccagagcccacagggaggcgtcatgggtggcagcaactccaaccagcagcaacagatgcgactgcagcaactgcagatggagaaggagaggctgcggctgaaacagcaagaactgcttcggcaggagttagccctgcgtagccagttaccaacactggagcaggatggtgggactcaaaatccagtgtcttctcccgggatgtctcaggaattgagaacaatgacgaccaatagctcagatcctttccttaacagtggcacctatcactctcgagatgagagtacagacagtggactaagcatgagcagctacagtgtccctcgaaccccagatgacttcctgaacagtgtggatgagatggatacaggtgatactatcaaccaaagcaccctgccctcacagcagaaccgtttcccagactaccttgaagccattcctgggacaaatgtggaccttggaacactggaaggagatggaatgaacatagaaggagaggagctgatgccaagtctgcaggaagctttgagttctgacatccttaatgacatggagtctgttttggctgccaccaagctagataaagaaagctttcttacatggttatagagccctcaggcagactgaattctaaatctgtgaaggatctaaggagacacatgcaccggaaatttccataagccagttgcagttttcaggctaatacagaaaaagatgaacaaacgtccagcaagatactttaatcctctattttgctcttccttgtccattgctgctgttaatgtattgctgacctctttcacagttggctctaaagaatcaaaagaaaaaaactttttatttcttttgctattaaaactactgttcattttgggggctgggggaagtgagcctgtttggatgatggatgccattccttttgcccagttaaatgttcaccaatcattttaactaaatactcagacttagaagtcagatgcttcatgtcacagcatttagtttgttcaacagttgtttcttcagcttcctttgtccagtggaaaaacatgatttactggtctgacaagccaaaaatgttatatctgatattaaatacttaatgctgatttgaagagatagctgaaaccaaggctgaagactgttttactttcagtattttcttttcctcctagtgctatcattagtcacataatgaccttgattttattttaggagcttataaggcatgagacaatttccatataaatatattaattattgccacatactctaatatagattttggtggataattttgtgggtgtgcattttgttctgttttgttgggttttttgttttttttgtttttggcagggtcggtgggggggttggttggttggttggttttgtcggaacctaggcaaatgaccatattagtgaatctgttaatagttgtagcttgggatggttattgtagttgttttggtaaaatcttcatttcctggttttttttaccaccttatttaaatctcgattatctgctctctcttttatatacatacacacacccaaacataacatttataatagtgtggtagtggaatgtatccttttttaggtttccctgctttccagttaatttttaaaatggtagcgctttgtatgcatttagaatacatgactagtagtttatatttcactggtagtttaaatctggttggggcagtctgcagatgtttgaagtagtttagtgttctagaaagagctattactgtggatagtgcctaggggagtgctccacgccctctgggcatacggtagatattatctgatgaattggaaaggagcaaaccagaaatggctttattttctcccttggactaatttttaagtctcgattggaattcagtgagtaggttcataatgtgcatgacagaaataagctttatagtggtttaccttcatttagctttggaagttttctttgccttagttttggaagtaaattctagtttgtagttctcatttgtaatgaacacattaacgactagattaaaatattgccttcaagattgttcttacttacaagacttgctcctacttctatgctgaaaattgaccctggatagaatactataaggttttgagttagctggaaaagtgatcagattaataaatgtatattggtagttgaatttagcaaagaaatagagataatcatgattatacctttatttttacaggaagagatgatgtaactagagtatgtgtctacaggagtaataatggtttccaaagagtattttttaaaggaacaaaacgagcatgaattaactcttcaatataagctatgaagtaatagttggttgtgaattaaagtggcaccagctagcacctctgtgttttaagggtctttcaatgtttctagaataagcccttattttcaagggttcataacaggcataaaatctcttctcctggcaaaagctgctatgaaaagcctcagcttgggaagatagatttttttccccccaattacaaaatctaagtattttggcccttcaatttggaggagggcaaaagttggaagtaagaagttttattttaagtactttcagtgctcaaaaaaatgcaatcactgtgttgtatataatagttcataggttgatcactcataataattgactctaaggcttttattaagaaaacagcagaaagattaaatcttgaattaagtctggggggaaatggccactgcagatggagttttagagtagtaatgaaattctacctagaatgcaaaattgggtatatgaattacatagcatgttgttgggattttttttaatgtgcagaagatcaaagctacttggaaggagtgcctataatttgccagtagccacagattaagattatatcttatatatcagcagattagctttagcttagggggagggtgggaaagtttggggggggggttgtgaagatttagggggaccttgatagagaactttataaacttctttctctttaataaagacttgtcttacaccgtgctgccattaaaggcagctgttctagagtttcagtcacctaagtacacccacaaaacaatatgaatatggagatcttcctttacccctcaactttaatttgcccagttatacctcagtgttgtagcagtactgtgatacctggcacagtgctttgatcttacgatgccctctgtactgacctgaaggagacctaagagtcctttccctttttgagtttgaatcatagccttgatgtggtctcttgttttatgtccttgttcctaatgtaaaagtgcttaactgcttcttggttgtattgggtagcattgggataagattttaactgggtattcttgaattgcttttacaataaaccaattttataatctttaaatttatcaactttttacatttgtgttattttcagtcagggcttcttagatctacttatggttgatggagcacattgatttggagtttcagatcttccaaagcactatttgttgtaataacttttctaaatgtagtgcctttaaaggaaaaatgaacacagggaagtgactttgctacaaataatgttgctgtgttaagtattcatattaaatacatgccttctatatggaacatggcagaaagactgaaaaataacagtaattaattgtgtaattcagaattcataccaatcagtgttgaaactcaaacattgcaaaagtgggtggcaatattcagtgcttaacacttttctagcgttggtacatctgagaaatgagtgctcaggtggattttatcctcgcaagcatgttgttataagaattgtgggtgtgcctatcataacaattgttttctgtatcttgaaaaagtattctccacattttaaatgttttatattagagaattctttaatgcacacttgtcaaatatatatatatagtaccaatgttacctttttattttttgttttagatgtaagagcatgctcatatgttaggtacttacataaattgttacattattttttcttatgtaatacctttttgtttgtttatgtggttcaaatatattctttccttaaactcttaaaaaaaaaa

SEQ ID NO: 54 - protein, 450 aa, Homo sapiens
MDPGQQPPPQPAPQGQGQPPSQPPQGQGPPSGPGQPAPAATQAAPQAPPAGHQIVHVRGDSETDLEALFNAVMNPKTANVPQTVPMRLRKLPDSFFKPPEPKSHSRQASTDAGTAGALTPQHVRAHSSPASLQLGAVSPGTLTPTGVVSGPAATPTAQHLRQSSFEIPDDVPLPAGWEMAKTSSGQRYFLNHIDQTTTWQDPRKAMLSQMNVTAPTSPPVQQNMMNSASAMNQRISQSAPVKQPPPLAPQSPQGGVMGGSNSNQQQQMRLQQLQMEKERLRLKQQELLRQELALRSQLPTLEQDGGTQNPVSSPGMSQELRTMTTNSSDPFLNSGTYHSRDESTDSGLSMSSYSVPRTPDDFLNSVDEMDTGDTINQSTLPSQQNRFPDYLEAIPGTNVDLGTLEGDGMNIEGEELMPSLQEALSSDILNDMESVLAATKLDKESFLTWL

SEQ ID NO: 55 - DNA, 3250 bp, Homo sapiens
accagggtcccggctcggggtccgggctggggaggggaacctgggcgcctgggacccgccgatgccccctgccccgcccggaggtgaaagcgggtgtgaggagcgcggcgcggcaggtcatattgaacattccagatacctatcattactcgatgctgttgataacagcaagatggctttgaactcagggtcaccaccagctattggaccttactatgaaaaccatggataccaaccggaaaacccctatcccgcacagcccactgtggtccccactgtctacgaggtgcatccggctcagtactacccgtcccccgtgccccagtacgccccgagggtcctgacgcaggcttccaaccccgtcgtctgcacgcagcccaaatccccatccgggacagtgtgcacctcaaagactaagaaagcactgtgcatcaccttgaccctggggaccttcctcgtgggagctgcgctggccgctggcctactctggaagttcatgggcagcaagtgctccaactctgggatagagtgcgactcctcaggtacctgcatcaacccctctaactggtgtgatggcgtgtcacactgccccggcggggaggacgagaatcggtgtgttcgcctctacggaccaaacttcatccttcaggtgtactcatctcagaggaagtcctggcaccctgtgtgccaagacgactggaacgagaactacgggcgggcggcctgcagggacatgggctataagaataatttttactctagccaaggaatagtggatgacagcggatccaccagctttatgaaactgaacacaagtgccggcaatgtcgatatctataaaaaactgtaccacagtgatgcctgttcttcaaaagcagtggtttctttacgctgtatagcctgcggggtcaacttgaactcaagccgccagagcaggattgtgggcggcgagagcgcgctcccgggggcctggccctggcaggtcagcctgcacgtccagaacgtccacgtgtgcggaggctccatcatcacccccgagtggatcgtgacagccgcccactgcgtggaaaaacctcttaacaatccatggcattggacggcatttgcggggattttgagacaatctttcatgttctatggagccggataccaagtagaaaaagtgatttctcatccaaattatgactccaagaccaagaacaatgacattgcgctgatgaagctgcagaagcctctgactttcaacgacctagtgaaaccagtgtgtctgcccaacccaggcatgatgctgcagccagaacagctctgctggatttccgggtggggggccaccgaggagaaagggaagacctcagaagtgctgaacgctgccaaggtgcttctcattgagacacagagatgcaacagcagatatgtctatgacaacctgatcacaccagccatgatctgtgccggcttcctgcaggggaacgtcgattcttgccagggtgacagtggagggcctctggtcacttcgaagaacaatatctggtggctgataggggatacaagctggggttctggctgtgccaaagcttacagaccaggagtgtacgggaatgtgatggtattcacggactggatttatcgacaaatgagggcagacggctaatccacatggtcttcgtccttgacgtcgttttacaagaaaacaatggggctggttttgcttccccgtgcatgatttactcttagagatgattcagaggtcacttcatttttattaaacagtgaacttgtctggctttggcactctctgccattctgtgcaggctgcagtggctcccctgcccagcctgctctccctaaccccttgtccgcaaggggtgatggccggctggttgtgggcactggcggtcaagtgtggaggagaggggtggaggctgccccattgagatcttcctgctgagtcctttccaggggccaattttggatgagcatggagctgtcacctctcagctgctggatgacttgagatgaaaaaggagagacatggaaagggagacagccaggtggcacctgcagcggctgccctctggggccacttggtagtgtccccagcctacctctccacaaggggattttgctgatgggttcttagagccttagcagccctggatggtggccagaaataaagggaccagcccttcatgggtggtgacgtggtagtcacttgtaaggggaacagaaacatttttgttcttatggggtgagaatatagacagtgcccttggtgcgagggaagcaattgaaaaggaacttgccctgagcactcctggtgcaggtctccacctgcacattgggtggggctcctgggagggagactcagccttcctcctcatcctccctgaccctgctcctagcaccctggagagtgcacatgccccttggtcctggcagggcgccaagtctggcaccatgttggcctcttcaggcctgctagtcactggaaattgaggtccatgggggaaatcaaggatgctcagtttaaggtacactgtttccatgttatgtttctacacattgctacctcagtgctcctggaaacttagcttttgatgtctccaagtagtccaccttcatttaactctttgaaactgtatcatctttgccaagtaagagtggtggcctatttcagctgctttgacaaaatgactggctcctgacttaacgttctataaatgaatgtgctgaagcaaagtgcccatggtggcggcgaagaagagaaagatgtgttttgttttggactctctgtggtcccttccaatgctgtgggtttccaaccaggggaagggtcccttttgcattgccaagtgccataaccatgagcactactctaccatggttctgcctcctggccaagcaggctggtttgcaagaatgaaatgaatgattctacagctaggacttaaccttgaaatggaaagtcatgcaatcccatttgcaggatctgtctgtgcacatgcctctgtagagagcagcattcccagggaccttggaaacagttggcactgtaaggtgcttgctccccaagacacatcctaaaaggtgttgtaatggtgaaaacgtcttccttctttattgccccttcttatttatgtgaacaactgtttgtctttttttgtatcttttttaaactgtaaagttcaattgtgaaaatgaatatcatgcaaataaattatgcaatttttttttcaaagtaaaaaaaaaa

SEQ ID NO: 56 - protein, 529 aa, Homo sapiens
MPPAPPGGESGCEERGAAGHIEHSRYLSLLDAVDNSKMALNSGSPPAIGPYYENHGYQPENPYPAQPTVVPTVYEVHPAQYYPSPVPQYAPRVLTQASNPVVCTQPKSPSGTVCTSKTKKALCITLTLGTFLVGAALAAGLLWKFMGSKCSNSGIECDSSGTCINPSNWCDGVSHCPGGEDENRCVRLYGPNFILQVYSSQRKSWHPVCQDDWNENYGRAACRDMGYKNNFYSSQGIVDDSGSTSFMKLNTSAGNVDIYKKLYHSDACSSKAVVSLRCIACGVNLNSSRQSRIVGGESALPGAWPWQVSLHVQNVHVCGGSIITPEWIVTAAHCVEKPLNNPWHWTAFAGILRQSFMFYGAGYQVEKVISHPNYDSKTKNNDIALMKLQKPLTFNDLVKPVCLPNPGMMLQPEQLCWISGWGATEEKGKTSEVLNAAKVLLIETQRCNSRYVYDNLITPAMICAGFLQGNVDSCQGDSGGPLVTSKNNIWWLIGDTSWGSGCAKAYRPGVYGNVMVFTDWIYRQMRADG

SEQ ID NO: 57 - DNA, 3409 bp, Homo sapiens
aaattcgcggtgggggcggagagcgcagggagaagtaagcccagtgcaggatcctgaggcccgtgtttgcaggaccagggccggccttccgattccccattcattccagaagcaccgaaccacgctgtgcccggatcccaagtgcagcggcacccagcgtgggcctggggttgccggttgacccggtcctcagcctggtagcagaggccaggccagtgccacaaggcacctaagtccacctgggcctggagcaggacaggttgcaaaagaaaatatctcgggacccccaaactccttatgctaagggaaacatcgagcctgggaactgagccatcaacgctgccattctttttcccaaacagaaccctgttgtcagaggtacacccagagcaactccacaccgggtgcatgccacagcaactccatcttaaataggagctggtaaaacgaggctgatacctactgggctgcattcccagacggcatagcgaggaggtgctgaagagcgcaggtttggagaatgatcacctggattggaaccatagctctaccaatatggaacccagctccttaggcctcggtcttctcatggagaacatggtgtgataatcctactcctctgggagggtggctgttaagccttggaccgcagttgccggccaggaatcccagtgtcacggtggacacgcctccctcgcgcccttgccgcccacctgctcacccagctcaggggctttggaattctgtggccacactgcgaggagatcggttctgggtcggaggctacaggaagactcccactccctgaaatctggagtgaagaacgccgccatccagccaccattccaaggaggtgcaggagaacagctctgtgataccatttaacttgttgacattacttttatttgaaggaacgtatattagagcttactttgcaaagaaggaagatggttgtttccgaagtggacatcgcaaaagctgatccagctgctgcatcccaccctctattactgaatggagatgctactgtggcccagaaaaatccaggctcggtggctgagaacaacctgtgcagccagtatgaggagaaggtgcgcccctgcatcgacctcattgactccctgcgggctctaggtgtggagcaggacctggccctgccagccatcgccgtcatcggggaccagagctcgggcaagagctccgtgttggaggcactgtcaggagttgcccttcccagaggcagcgggatcgtgaccagatgcccgctggtgctgaaactgaagaaacttgtgaacgaagataagtggagaggcaaggtcagttaccaggactacgagattgagatttcggatgcttcagaggtagaaaaggaaattaataaagcccagaatgccatcgccggggaaggaatgggaatcagtcatgagctaatcaccctggagatcagctcccgagatgtcccggatctgactctaatagaccttcctggcataaccagagtggctgtgggcaatcagcctgctgacattgggtataagatcaagacactcatcaagaagtacatccagaggcaggagacaatcagcctggtggtggtccccagtaatgtggacatcgccaccacagaggctctcagcatggcccaggaggtggaccccgagggagacaggaccatcggaatcttgacgaagcctgatctggtggacaaaggaactgaagacaaggttgtggacgtggtgcggaacctcgtgttccacctgaagaagggttacatgattgtcaagtgccggggccagcaggagatccaggaccagctgagcctgtccgaagccctgcagagagagaagatcttctttgagaaccacccatatttcagggatctgctggaggaaggaaaggccacggttccctgcctggcagaaaaacttaccagcgagctcatcacacatatctgtaaatctctgcccctgttagaaaatcaaatcaaggagactcaccagagaataacagaggagctacaaaagtatggtgtcgacataccggaagacgaaaatgaaaaaatgttcttcctgatagataaagttaatgcctttaatcaggacatcactgctctcatgcaaggagaggaaactgtaggggaggaagacattcggctgtttaccagactccgacacgagttccacaaatggagtacaataattgaaaacaattttcaagaaggccataaaattttgagtagaaaaatccagaaatttgaaaatcagtatcgtggtagagagctgccaggctttgtgaattacaggacatttgagacaatcgtgaaacagcaaatcaaggcactggaagagccggctgtggatatgctacacaccgtgacggatatggtccggcttgctttcacagatgtttcgataaaaaattttgaagagttttttaacctccacagaaccgccaagtccaaaattgaagacattagagcagaacaagagagagaaggtgagaagctgatccgcctccacttccagatggaacagattgtctactgccaggaccaggtatacaggggtgcattgcagaaggtcagagagaaggagctggaagaagaaaagaagaagaaatcctgggattttggggctttccagtccagctcggcaacagactcttccatggaggagatctttcagcacctgatggcctatcaccaggaggccagcaagcgcatctccagccacatccctttgatcatccagttcttcatgctccagacgtacggccagcagcttcagaaggccatgctgcagctcctgcaggacaaggacacctacagctggctcctgaaggagcggagcgacaccagcgacaagcggaagttcctgaaggagcggcttgcacggctgacgcaggctcggcgccggcttgcccagttccccggttaaccacactctgtccagccccgtagacgtgcacgcacactgtctgcccccgttcccgggtagccactggactgacgacttgagtgctcagtagtcagactggatagtccgtctctgcttatccgttagccgtggtgatttagcaggaagctgtgagagcagtttggtttctagcatgaagacagagccccaccctcagatgcacatgagctggcgggattgaaggatgctgtcttcgtactgggaaagggattttcagccctcagaatcgctccaccttgcagctctccccttctctgtattcctagaaactgacacatgctgaacatcacagcttatttcctcatttttataatgtcccttcacaaacccagtgttttaggagcatgagtgccgtgtgtgtgcgtcctgtcggagccctgtctcctctctctgtaataaactcatttctagcagacaaaaaaaaaaaaaaaaaa

SEQ ID NO: 58 - protein, 662 aa, Homo sapiens
MVVSEVDIAKADPAAASHPLLLNGDATVAQKNPGSVAENNLCSQYEEKVRPCIDLIDSLRALGVEQDLALPAIAVIGDQSSGKSSVLEALSGVALPRGSGIVTRCPLVLKLKKLVNEDKWRGKVSYQDYEIEISDASEVEKEINKAQNAIAGEGMGISHELITLEISSRDVPDLTLIDLPGITRVAVGNQPADIGYKIKTLIKKYIQRQETISLVVVPSNVDIATTEALSMAQEVDPEGDRTIGILTKPDLVDKGTEDKVVDVVRNLVFHLKKGYMIVKCRGQQEIQDQLSLSEALQREKIFFENHPYFRDLLEEGKATVPCLAEKLTSELITHICKSLPLLENQIKETHQRITEELQKYGVDIPEDENEKMFFLIDKVNAFNQDITALMQGEETVGEEDIRLFTRLRHEFHKWSTIIENNFQEGHKILSRKIQKFENQYRGRELPGFVNYRTFETIVKQQIKALEEPAVDMLHTVTDMVRLAFTDVSIKNFEEFFNLHRTAKSKIEDIRAEQEREGEKLIRLHFQMEQIVYCQDQVYRGALQKVREKELEEEKKKKSWDFGAFQSSSATDSSMEEIFQHLMAYHQEASKRISSHIPLIIQFFMLQTYGQQLQKAMLQLLQDKDTYSWLLKERSDTSDKRKFLKERLARLTQARRRLAQFPG

SEQ ID NO: 59 - DNA, 4334 bp, Homo sapiens
gctcttaagactagcacggtgggctggcaggcgcccgctgtcggccgaggactgtctgggcgcgcttcctggaggaggcggtgcgtttcgcgcgctcgctgccggcgagccagcctcttcccttactcaccggtgtccggaaaggtgaacgctgcgctcgggctgcctcgcctgttacctccgccgccgggcatgctcagcgtctgcagctgccggaccagctccggcatgcggtcccagtggccctcggcgcggcagcgctccagctcgctctccaccttcagatattgatgaccatgagatccctgctcagaacccccttcctgtgtggcctgctctgggccttttgtgccccaggcgccagggctgaggagcctgcagccagcttctcccaacccggcagcatgggcctggataagaacacagtgcacgaccaagagcatatcatggagcatctagaaggtgtcatcaacaaaccagaggcggagatgtcgccacaagaattgcagctccattacttcaaaatgcatgattatgatggcaataatttgcttgatggcttagaactctccacagccatcactcatgtccataaggaggaagggagtgaacaggcaccactaatgagtgaagatgaactgattaacataatagatggtgttttgagagatgatgacaagaacaatgatggatacattgactatgctgaatttgcaaaatcactgcagtagatgttatttggccatctcctggttatatacaaatgtgacccgtgataatgtgattgaacactttagtaatgcaaaataactcatttccaactactgctgcagcattttggtaaaaacctgtagcgattcgttacactggggtgagaagagataagagaaatgaaagagaagagaaatgggacatctaatagtccctaagtgctattaaataccttattggacaagggcttgcttcaagcatctgtattagtctgtattaatgctgctgataaagacgtacccgagactgggaagaaaaagaggtttacttggacttacagttccacatggctggggaggcctcagaatcatggcgggaggtgaaaggcacttcttacatggcagcaagagaaaatgaggaagaagcaaaagtggaaacccctgataagccatcagatcttgtgaaacttattcactatcacaagaatagcatgggaaagactggcccccatgattcaattacctccccttgggtctctcccacaacacgtgggaattctggtagatacaatttcaagttgagatttgggtggggacatagccaaaccatatcattctacccctggcccctccaaatctcatgtcctcactattcaaaaccaatcatgccttcctaacagtcccccaaagtcttaactcttttcagcattaacgcaaaaatccacagtccaaagtctcatctgagacaaggcaagtcccttccacctatgagcctgtaaaatcaaaagcaagctagttacttcctagataccaacaggggtacaggtattgattaaagacggctgttccaaatgggagaaattggccaaaataaaggggttacagggcccatgcaagtccgaaatccagcagggctgtcaaattttaaagttccagaataatctcctttgactccaggtctcacatccaggtcatactgatgcaagaagtgggttcccatggtcttgggcagctctgcccctgtggctttgtagggtacagcctccctcctggctgctttcacggctgttgttcagtgcctgcggcttttccaggtgcacggtgcaagctgttggtggatctaccattctggggtctggaggacggtggccctcttctcacagctccactaggcagtgccccagtagggactctgtgtgggggctcccacaccacatttcccttctgcactgccctagcagaggttctctcccctgccgctgagagggcctctcccctgcagcaaacgtttgcctgggcattgaggcatttccatacatcttctgaaaactaggcggaggtttccaaatctcaattcttgacttctgtgcacctgcaggcttaacagcacatagaagctgccaaggcttggggcttccactctgaagccacagcccgagctgtatgttggcccctttcagccatggctggagtggctgggacacaagacaccaagtccctaggctgcacacacatgtcaggggctgccctgacatggcctggagacattttccccatggtgttggggattaacattaggctccttgctacttatgcaaatttctgcagctggcttgaatttctccccagaaaatgggtttttcttttctattgcatagtcaggctgcaaatttccaaacttttatgctttgcttcccttatttataagggaatgcctttaaaagcacccaagtcacctgttgaacactttgctgcttagaaatttcttccgctagttaacctaaatcatctctctcaagttcaaagttccacaaatccctatggaaggggcaaaatgctgccagtctctttgctaaaacataacaagagtcacctttactccagttcccaacaagttcctcatcttcatctgaggccacctcagcctggactttgttgtccatattgctatcagcatttggggcaaagccattcaacaagtctgtaggaagttccaaactttcccacattttcctgttttcttctgagccctccaaactgttccagcctctgcctgttacccagttccaaagtcacttccacattttgggtatttcttcagcaggtcccaatctactggtaccaatttactgtattagtccgttttcacgctgctgataaagacatacccgagactgggaagaaaaagtggtttaattggacttaaagttccacatggctggggaggcctcagaatcatggtgggaggcaaaagacacttcttacattgtggcaagaaaaaatgaggaagaagcaaaagcagaaacccctgataaactgatcagatctcatgagacttattcactgtcacgagaatagcacgggaaagactggcccccatgattcaattacctccccctgggtctgtcccacaacacgtgggaattctgggagatacaattcaagttgagatttgtggggggacacaaccaaaccatatcagcatcctttcaagaatattagataattggagctgagtactcaggaacttgactgtagtagaatactgctagtttcttaattttaattcacatcacctgaaaagtaaaacaacaggctttgccaagtggatgcttttcagtaacagtgaagtggagtgaataccaaatgtttgccctggtggttcctatctcttcaggcaaacatggtcagtattctgtaaagttcccctggcctaaatgattacttgctctgggcaagtggatatttattaggctatttcaaagccacagcataagaatgtcagcctagccacagagtctgagattctgagttcagcctagccacagagtctaagattctgtatcctctgacattttggaaatgatacactactggcttaagtgatgactctttcagattttcagtattttatacaactactgccacatccttatactttattgcttttctgtcttcttcaacctgggagagaccctgaatttgagtgtgttctctaatcaatagtggtttagctttcttttctatttcactcgtttctagggttttttatttgcagtttaggaactattaggaatgtcaggactttatcagcaggggtaaaactaccacctggcctagcctaagtaggaagtgaaaagataattcaccaaacaatgattaatcagatagaagttctagtcaagagggatattgttgaagttacctcttttagcctagatacatggattcttttcaaatcaggaaagattagaaaaggaacccaaaaaaccctttaacagtgtgaatctttatagtatttgaaaatgagaagaagcagcagattgtaatttggtttattggatgtgatggacgttctgtaatagaaaacctgaaacgatgattgaatgggaaaaagagactacaaaatttgtcgtaggatgtatacagacttattttctttattacagtattataagaaaacatatgtatttgtaaaaatggtttcctgtgtcaagtatttgtgcagtcagagctgacttgtaaactattcttgtaatagctcattattttgaaagatttatatatgatgaattctggatatatgaccaataaaactgatgaagcaaaacctcaaaaaaaaaa

SEQ ID NO: 60 - protein, 146 aa, Homo sapiens
MTMRSLLRTPFLCGLLWAFCAPGARAEEPAASFSQPGSMGLDKNTVHDQEHIMEHLEGVINKPEAEMSPQELQLHYFKMHDYDGNNLLDGLELSTAITHVHKEEGSEQAPLMSEDELINIIDGVLRDDDKNNDGYIDYAEFAKSLQ

SEQ ID NO: 61 - DNA, 6267 bp, Homo sapiens
agctgcaagtggcgggcgcccaggcagatgcgatccagcggctctgggggcggcagcggtggtagcagctggtacctcccgccgcctctgttcggagggtcgcggggcaccgaggtgctttccggccgccctctggtcggccacccaaagccgcgggcgctgatgatgggtgaggagggggcggcaagatttcgggcgcccctgccctgaacgccctcagctgctgccgccggggccgctccagtgcctgcgaactctgaggagccgaggcgccggtgagagcaaggacgctgcaaacttgcgcagcgcgggggctgggattcacgcccagaagttcagcaggcagacagtccgaagccttcccgcagcggagagatagcttgagggtgcgcaagacggcagcctccgccctcggttcccgcccagaccgggcagaagagcttggaggagccaaaaggaacgcaaaaggcggccaggacagcgtgcagcagctgggagccgccgttctcagccttaaaagttgcagagattggaggctgccccgagaggggacagaccccagctccgactgcggggggcaggagaggacggtacccaactgccacctcccttcaaccatagtagttcctctgtaccgagcgcagcgagctacagacgggggcgcggcactcggcgcggagagcgggaggctcaaggtcccagccagtgagcccagtgtgcttgagtgtctctggactcgcccctgagcttccaggtctgtttcatttagactcctgctcgcctccgtgcagttgggggaaagcaagagacttgcgcgcacgcacagtcctctggagatcaggtggaaggagccgctgggtaccaaggactgttcagagcctcttcccatctcggggagagcgaagggtgaggctgggcccggagagcagtgtaaacggcctcctccggcgggatgggagccatcgggctcctgtggctcctgccgctgctgctttccacggcagctgtgggctccgggatggggaccggccagcgcgcgggctccccagctgcggggccgccgctgcagccccgggagccactcagctactcgcgcctgcagaggaagagtctggcagttgacttcgtggtgccctcgctcttccgtgtctacgcccgggacctactgctgccaccatcctcctcggagctgaaggctggcaggcccgaggcccgcggctcgctagctctggactgcgccccgctgctcaggttgctggggccggcgccgggggtctcctggaccgccggttcaccagccccggcagaggcccggacgctgtccagggtgctgaagggcggctccgtgcgcaagctccggcgtgccaagcagttggtgctggagctgggcgaggaggcgatcttggagggttgcgtcgggccccccggggaggcggctgtggggctgctccagttcaatctcagcgagctgttcagttggtggattcgccaaggcgaagggcgactgaggatccgcctgatgcccgagaagaaggcgtcggaagtgggcagagagggaaggctgtccgcggcaattcgcgcctcccagccccgccttctcttccagatcttcgggactggtcatagctccttggaatcaccaacaaacatgccttctccttctcctgattattttacatggaatctcacctggataatgaaagactccttccctttcctgtctcatcgcagccgatatggtctggagtgcagctttgacttcccctgtgagctggagtattcccctccactgcatgacctcaggaaccagagctggtcctggcgccgcatcccctccgaggaggcctcccagatggacttgctggatgggcctggggcagagcgttctaaggagatgcccagaggctcctttctccttctcaacacctcagctgactccaagcacaccatcctgagtccgtggatgaggagcagcagtgagcactgcacactggccgtctcggtgcacaggcacctgcagccctctggaaggtacattgcccagctgctgccccacaacgaggctgcaagagagatcctcctgatgcccactccagggaagcatggttggacagtgctccagggaagaatcgggcgtccagacaacccatttcgagtggccctggaatacatctccagtggaaaccgcagcttgtctgcagtggacttctttgccctgaagaactgcagtgaaggaacatccccaggctccaagatggccctgcagagctccttcacttgttggaatgggacagtcctccagcttgggcaggcctgtgacttccaccaggactgtgcccagggagaagatgagagccagatgtgccggaaactgcctgtgggtttttactgcaactttgaagatggcttctgtggctggacccaaggcacactgtcaccccacactcctcaatggcaggtcaggaccctaaaggatgcccggttccaggaccaccaagaccatgctctattgctcagtaccactgatgtccccgcttctgaaagtgctacagtgaccagtgctacgtttcctgcaccgatcaagagctctccatgtgagctccgaatgtcctggctcattcgtggagtcttgaggggaaacgtgtccttggtgctagtggagaacaaaaccgggaaggagcaaggcaggatggtctggcatgtcgccgcctatgaaggcttgagcctgtggcagtggatggtgttgcctctcctcgatgtgtctgacaggttctggctgcagatggtcgcatggtggggacaaggatccagagccatcgtggcttttgacaatatctccatcagcctggactgctacctcaccattagcggagaggacaagatcctgcagaatacagcacccaaatcaagaaacctgtttgagagaaacccaaacaaggagctgaaacccggggaaaattcaccaagacagacccccatctttgaccctacagttcattggctgttcaccacatgtggggccagcgggccccatggccccacccaggcacagtgcaacaacgcctaccagaactccaacctgagcgtggaggtggggagcgagggccccctgaaaggcatccagatctggaaggtgccagccaccgacacctacagcatctcgggctacggagctgctggcgggaaaggcgggaagaacaccatgatgcggtcccacggcgtgtctgtgctgggcatcttcaacctggagaaggatgacatgctgtacatcctggttgggcagcagggagaggacgcctgccccagtacaaaccagttaatccagaaagtctgcattggagagaacaatgtgatagaagaagaaatccgtgtgaacagaagcgtgcatgagtgggcaggaggcggaggaggagggggtggagccacctacgtatttaagatgaaggatggagtgccggtgcccctgatcattgcagccggaggtggtggcagggcctacggggccaagacagacacgttccacccagagagactggagaataactcctcggttctagggctaaacggcaattccggagccgcaggtggtggaggtggctggaatgataacacttccttgctctgggccggaaaatctttgcaggagggtgccaccggaggacattcctgcccccaggccatgaagaagtgggggtgggagacaagagggggtttcggagggggtggaggggggtgctcctcaggtggaggaggcggaggatatataggcggcaatgcagcctcaaacaatgaccccgaaatggatggggaagatggggtttccttcatcagtccactgggcatcctgtacaccccagctttaaaagtgatggaaggccacggggaagtgaatattaagcattatctaaactgcagtcactgtgaggtagacgaatgtcacatggaccctgaaagccacaaggtcatctgcttctgtgaccacgggacggtgctggctgaggatggcgtctcctgcattgtgtcacccaccccggagccacacctgccactctcgctgatcctctctgtggtgacctctgccctcgtggccgccctggtcctggctttctccggcatcatgattgtgtaccgccggaagcaccaggagctgcaagccatgcagatggagctgcagagccctgagtacaagctgagcaagctccgcacctcgaccatcatgaccgactacaaccccaactactgctttgctggcaagacctcctccatcagtgacctgaaggaggtgccgcggaaaaacatcaccctcattcggggtctgggccatggcgcctttggggaggtgtatgaaggccaggtgtccggaatgcccaacgacccaagccccctgcaagtggctgtgaagacgctgcctgaagtgtgctctgaacaggacgaactggatttcctcatggaagccctgatcatcagcaaattcaaccaccagaacattgttcgctgcattggggtgagcctgcaatccctgccccggttcatcctgctggagctcatggcggggggagacctcaagtccttcctccgagagacccgccctcgcccgagccagccctcctccctggccatgctggaccttctgcacgtggctcgggacattgcctgtggctgtcagtatttggaggaaaaccacttcatccaccgagacattgctgccagaaactgcctcttgacctgtccaggccctggaagagtggccaagattggagacttcgggatggcccgagacatctacagggcgagctactatagaaagggaggctgtgccatgctgccagttaagtggatgcccccagaggccttcatggaaggaatattcacttctaaaacagacacatggtcctttggagtgctgctatgggaaatcttttctcttggatatatgccataccccagcaaaagcaaccaggaagttctggagtttgtcaccagtggaggccggatggacccacccaagaactgccctgggcctgtataccggataatgactcagtgctggcaacatcagcctgaagacaggcccaactttgccatcattttggagaggattgaatactgcacccaggacccggatgtaatcaacaccgctttgccgatagaatatggtccacttgtggaagaggaagagaaagtgcctgtgaggcccaaggaccctgagggggttcctcctctcctggtctctcaacaggcaaaacgggaggaggagcgcagcccagctgccccaccacctctgcctaccacctcctctggcaaggctgcaaagaaacccacagctgcagagatctctgttcgagtccctagagggccggccgtggaagggggacacgtgaatatggcattctctcagtccaaccctccttcggagttgcacaaggtccacggatccagaaacaagcccaccagcttgtggaacccaacgtacggctcctggtttacagagaaacccaccaaaaagaataatcctatagcaaagaaggagccacacgacaggggtaacctggggctggagggaagctgtactgtcccacctaacgttgcaactgggagacttccgggggcctcactgctcctagagccctcttcgctgactgccaatatgaaggaggtacctctgttcaggctacgtcacttcccttgtgggaatgtcaattacggctaccagcaacagggcttgcccttagaagccgctactgcccctggagctggtcattacgaggataccattctgaaaagcaagaatagcatgaaccagcctgggccctgagctcggtcgcacactcacttctcttccttgggatccctaagaccgtggaggagagagaggcaatggctccttcacaaaccagagaccaaatgtcacgttttgttttgtgccaacctattttgaagtaccaccaaaaaagctgtattttgaaaatgctttagaaaggttttgagcatgggttcatcctattctttcgaaagaagaaaatatcataaaaatgagtgataaatacaaggcccagatgtggttgcataaggtttttatgcatgtttgttgtatacttccttatgcttctttcaaattgtgtgtgctctgcttcaatgtagtcagaattagctgcttctatgtttcatagttggggtcatagatgtttccttgccttgttgatgtggacatgagccatttgaggggagagggaacggaaataaaggagttatttgtaatgactaaaa

SEQ ID NO: 62 - protein, 1620 aa, Homo sapiens
MGAIGLLWLLPLLLSTAAVGSGMGTGQRAGSPAAGPPLQPREPLSYSRLQRKSLAVDFVVPSLFRVYARDLLLPPSSSELKAGRPEARGSLALDCAPLLRLLGPAPGVSWTAGSPAPAEARTLSRVLKGGSVRKLRRAKQLVLELGEEAILEGCVGPPGEAAVGLLQFNLSELFSWWIRQGEGRLRIRLMPEKKASEVGREGRLSAAIRASQPRLLFQIFGTGHSSLESPTNMPSPSPDYFTWNLTWIMKDSFPFLSHRSRYGLECSFDFPCELEYSPPLHDLRNQSWSWRRIPSEEASQMDLLDGPGAERSKEMPRGSFLLLNTSADSKHTILSPWMRSSSEHCTLAVSVHRHLQPSGRYIAQLLPHNEAAREILLMPTPGKHGWTVLQGRIGRPDNPFRVALEYISSGNRSLSAVDFFALKNCSEGTSPGSKMALQSSFTCWNGTVLQLGQACDFHQDCAQGEDESQMCRKLPVGFYCNFEDGFCGWTQGTLSPHTPQWQVRTLKDARFQDHQDHALLLSTTDVPASESATVTSATFPAPIKSSPCELRMSWLIRGVLRGNVSLVLVENKTGKEQGRMVWHVAAYEGLSLWQWMVLPLLDVSDRFWLQMVAWWGQGSRAIVAFDNISISLDCYLTISGEDKILQNTAPKSRNLFERNPNKELKPGENSPRQTPIFDPTVHWLFTTCGASGPHGPTQAQCNNAYQNSNLSVEVGSEGPLKGIQIWKVPATDTYSISGYGAAGGKGGKNTMMRSHGVSVLGIFNLEKDDMLYILVGQQGEDACPSTNQLIQKVCIGENNVIEEEIRVNRSVHEWAGGGGGGGGATYVFKMKDGVPVPLIIAAGGGGRAYGAKTDTFHPERLENNSSVLGLNGNSGAAGGGGGWNDNTSLLWAGKSLQEGATGGHSCPQAMKKWGWETRGGFGGGGGGCSSGGGGGGYIGGNAASNNDPEMDGEDGVSFISPLGILYTPALKVMEGHGEVNIKHYLNCSHCEVDECHMDPESHKVICFCDHGTVLAEDGVSCIVSPTPEPHLPLSLILSVVTSALVAALVLAFSGIMIVYRRKHQELQAMQMELQSPEYKLSKLRTSTIMTDYNPNYCFAGKTSSISDLKEVPRKNITLIRGLGHGAFGEVYEGQVSGMPNDPSPLQVAVKTLPEVCSEQDELDFLMEALIISKFNHQNIVRCIGVSLQSLPRFILLELMAGGDLKSFLRETRPRPSQPSSLAMLDLLHVARDIACGCQYLEENHFIHRDIAARNCLLTCPGPGRVAKIGDFGMARDIYRASYYRKGGCAMLPVKWMPPEAFMEGIFTSKTDTWSFGVLLWEIFSLGYMPYPSKSNQEVLEFVTSGGRMDPPKNCPGPVYRIMTQCWQHQPEDRPNFAIILERIEYCTQDPDVINTALPIEYGPLVEEEEKVPVRPKDPEGVPPLLVSQQAKREEERSPAAPPPLPTTSSGKAAKKPTAAEISVRVPRGPAVEGGHVNMAFSQSNPPSELHKVHGSRNKPTSLWNPTYGSWFTEKPTKKNNPIAKKEPHDRGNLGLEGSCTVPPNVATGRLPGASLLLEPSSLTANMKEVPLFRLRHFPCGNVNYGYQQQGLPLEAATAPGAGHYEDTILKSKNSMNQPGP

SEQ ID NO: 63 - DNA, 4576 bp, Homo sapiens
gcgaagcctggctgaggctgcgaagggcgagcggcgcagggaccccgcgggcgtctggggcttccgcggcgcccgcctctgctccctcccctcgggcgctgggtgccgaccggccggctggccggcgccgcctcctgggaagatggcgctgcacttccagagtttggctgaattggaagtgttatgtactcatctctacatagggactgatcttacacaaagaatagaggctgagaaagcactcttggaacttattgacagtccagaatgtctcagcaagtgtcaacttttattagaacaaggaacaacatcctatgctcagctccttgcagcaacatgtctttcaaaacttgtcagccgagtcagtcctttacctgttgagcagaggatggacatcagaaactacattctgaattacgtggcatcacagcccaagctggctccctttgtcatccaagctcttattcaagtcattgctaaaatcactaagttggggtggtttgaggttcagaaagaccaatttgtcttcagagaaattattgctgatgtgaagaagtttctccagggtactgtggaacactgcataataggagtaataatcctttctgaattgactcaggaaatgaacctggttgattattctagaccttcagcaaaacacaggaaaatagctacctcatttcgtgatacttctctcaaagacgttttagtgctagcatgctctcttttaaaagaggtgtttgccaaacctttaaatcttcaggatcaatgtcagcaaaatctggtaatgcaggtcttgaaactggtccttaactgccttaactttgacttcattggcagttcagcagatgaatctgcagatgatctttgcacggtgcagattccaacaacttggagaacaattttcctggaaccagaaacattggatcttttcttcaatttgtatcattcacttccaccactactatctcagttagcactttcatgtttagttcagtttgcttcgacaagaaggtccttatttaacagtcctgaacgtgccaagtaccttggtaatttaattaagggagtaaaaaggatacttgaaaaccctcagggtttgtctgatccaggtaattatcatgaattttgtcgatttttggctcgtttaaagacaaattatcagctgggagaattagttatggtgaaggaatatcctgaagttattagattgattgctaattttaccattactagcctacagcactgggaatttgctcctaacagtgttcattatttattaactctgtggcaaaggatggtagcatctgttccttttgtgaaatcaactgaaccccacctattagacacttatgcaccagaaatcacgaaggcctttatcacttctcggttggactctgttgccatagttgtgagagatcacttagatgatccactggatgatactgccactgtgtttcagcagttggagcagttgtgcacggtcagcagatgtgaatatgaaaagacatgtgctcttcttgtgcagttattcgaccaaaatgcacagaattaccaaaaacttctgcatccatattctggtgtaactgtggacatcaccattcaggaaggacgtcttgcatggctggtatacttagttgggacagttgtaggaggaagattaacatataccagtacagatgagcatgatgctatggatggagaattatcctgtcgagtttttcagcttatatctttaatggataccggattgcctcgatgttgtaatgagaaaatagagcttgcaattctgtggttcttggatcagtttcgtaaaacatatgttggtgatcaacttcaaagaacctcaaaggtatatgctcgtatgtcagaagtcttaggaataacagatgacaaccacgttctagagacgttcatgacaaaaattgttacaaaccttaaatactggggaagatatgagcctgtaatttcaaggactcttcagttcctaaatgacctttctgttggttatatccttttaaaaaaacttgtgaagatagatgctgtgaaattcatgctaaaaaaccacacgagtgaacacttcccttttcttggcatcagtgacaatcatagtctcagcgacttcaggtgtcgaacaaccttctacacagcgctcactcgccttctgatggtagatctgggtgaagatgaggatgaatttgagaatttcatgctgcctcttacagttgcttttgaaacagtattacaaatattcaacaacaactttaaacaagaagatgtaaagcgtatgttgatcgggctggcaagagatcttcgagggattgcctttgcactgaacacaaagaccagctacaccatgctgtttgactggatgtacccaacgtaccttccccttcttcagaatgctgttgaacggtggtatggagagccaacatgtacaactcccatcttgaaacttatggcagaacttatgcaaaacagatcccagcgtttgaattttgatgtatcatctcctaatggaattcttctcttcagagaagctagtaaaatggtttgcacttatggtaatcagatcctgtcccttgggagcctctcaaaagatcagatttatccaatgaaactcaagggcatctccatctgctattcagctctcaagtctgccttgtgtggaaattatgtcagctttggcgtcttcaagttgtatggggacaaccattttgacaatgtactccaggcttttgtcaaaatgctgctgtcagtgtcccacagtgacttgctacaataccggaaactgagccagtcttattatccactcctggaatgtctcactcaggaccatatgagcttcatcatcaacttagagcctcctgtactcatgtatgttctcacatctatctcagagggactcactactcttgatacagttgtctcctccagctgctgtaccagtttagactacatcgtcacctacctcttcaagcacatagcaaaagagggcaagaagccacttcgatgcagagaggctacccaggctggtcagagactattacattttatgcagcaaaacccagatgtcctgcagcagatgatgtctgtcctcatgaacaccattgtctttgaagactgtcggaaccagtggtcagtatccaggcctctcctggggctcatcctgctcaatgagaagtatttcagtgaactgagagcaagtttgataaacagccagcccctccccaagcaggaggtccttgcccagtgcttcagaaacctaatggaaggagtggagcagaacctgtccgtcaagaacagagacaggttcacccaaaatctgtctgtattcagaagagatgtggcagaggcgttgcgcagtgatggcaacactgaaccatgcagtctcgacatgatgagctgacccgacttttctgaccatgtgcggagcagcctttatcaagagactcctgaaggtctgggtctcaggacagtgatgttggctagcccaggggaatgtatttttcaaaacatacaagcaacagcaaaagccctaacttcttatacgtctagcctaattataagaatttctaacagtaccagtgtaaattcagtcttttctctgaaaagcaaaggatgtgttttcagtctttctatcaaatattatctttgttctcctaatgctctgaaaggatgtagaaacaatatttaaccaaagaacgtaataaaccaggtttgcacctaagtgtgtactagtttatggttctgcagtcaaggttgtcaatttgttggagatgcagccttcaccatggatcctggattgagacgaatgccattggaacctgttaaatgagtagtttgttatgtgtctggaagaagcagcgttagggactttgggctgtgagcatttagaacgagcctggaagcactacagagcatcccacaggaccacacgcaggcctccctgcctcagctgcatctgataaagttgagagacagtaacacaattaaatgacttagaaacaatgtttgcttttcactggcataaatctgaagtggttcagtctagaagaattaagctgtgcaattactgcctgcagagatatttcttcaggaggagtcatgtagccccagtcagaagttctgggtggtgccagcacccagtcctctgcctccatttaatttttaagagaaggtgaaggtaactattagaatataatatttgaagcagctctgccttcttagggctacccaaaacagttctaggtgctaaaattcagattttcagaggatgagaaatagctggtttccaactctccacaaaaactcttattactgttgggacttgggattctgactcaccccaaacccagaacatgaagaagacctttacagtttgtgctctactgttactaggctattaatttgagatcgtccactgtcaagtgttttactatctcactgctgtttttatgattcaggcttataacaaatattgtatcctttatttctgataagacatgaaaggttggccttactgttgaacaataagtaaatccacaggctcctgttgtaatctcaaaaaaaaaaa

SEQ ID NO: 64 - protein, 1088 aa, Homo sapiens
MALHFQSLAELEVLCTHLYIGTDLTQRIEAEKALLELIDSPECLSKCQLLLEQGTTSYAQLLAATCLSKLVSRVSPLPVEQRMDIRNYILNYVASQPKLAPFVIQALIQVIAKITKLGWFEVQKDQFVFREIIADVKKFLQGTVEHCIIGVIILSELTQEMNLVDYSRPSAKHRKIATSFRDTSLKDVLVLACSLLKEVFAKPLNLQDQCQQNLVMQVLKLVLNCLNFDFIGSSADESADDLCTVQIPTTWRTIFLEPETLDLFFNLYHSLPPLLSQLALSCLVQFASTRRSLFNSPERAKYLGNLIKGVKRILENPQGLSDPGNYHEFCRFLARLKTNYQLGELVMVKEYPEVIRLIANFTITSLQHWEFAPNSVHYLLTLWQRMVASVPFVKSTEPHLLDTYAPEITKAFITSRLDSVAIVVRDHLDDPLDDTATVFQQLEQLCTVSRCEYEKTCALLVQLFDQNAQNYQKLLHPYSGVTVDITIQEGRLAWLVYLVGTVVGGRLTYTSTDEHDAMDGELSCRVFQLISLMDTGLPRCCNEKIELAILWFLDQFRKTYVGDQLQRTSKVYARMSEVLGITDDNHVLETFMTKIVTNLKYWGRYEPVISRTLQFLNDLSVGYILLKKLVKIDAVKFMLKNHTSEHFPFLGISDNHSLSDFRCRTTFYTALTRLLMVDLGEDEDEFENFMLPLTVAFETVLQIFNNNFKQEDVKRMLIGLARDLRGIAFALNTKTSYTMLFDWMYPTYLPLLQNAVERWYGEPTCTTPILKLMAELMQNRSQRLNFDVSSPNGILLFREASKMVCTYGNQILSLGSLSKDQIYPMKLKGISICYSALKSALCGNYVSFGVFKLYGDNHFDNVLQAFVKMLLSVSHSDLLQYRKLSQSYYPLLECLTQDHMSFIINLEPPVLMYVLTSISEGLTTLDTVVSSSCCTSLDYIVTYLFKHIAKEGKKPLRCREATQAGQRLLHFMQQNPDVLQQMMSVLMNTIVFEDCRNQWSVSRPLLGLILLNEKYFSELRASLINSQPLPKQEVLAQCFRNLMEGVEQNLSVKNRDRFTQNLSVFRRDVAEALRSDGNTEPCSLDMMS

SEQ ID NO: 65 - DNA, 7182 bp, Homo sapiens
gcgctggcgcgagcccacgaagaggtacgattccggagaatcgcgaggcagagcgggagcgcgcagccaggtggaaactaattctaagccagactgctggagatcaccctgttctagtgtgtggaggcttccaccaggaggcgcattggagtgactgtctggcatcaccaagatgacactccacgccacccggggggctgcactcctctcttgggtgaacagtctacacgtggctgaccctgtggaggctgtgctgcagctccaggactgcagcatcttcatcaagatcattgacagaatccatggcactgaagagggacagcaaatcttgaagcagccggtgtcagagagactggactttgtgtgcagttttctgcagaaaaatcgaaaacatccctcttccccagaatgcctggtatctgcacagaaggtgctagagggatcagagctggaactggcgaagatgaccatgctgctcttataccactctaccatgagctccaaaagtcccagggactgggaacagtttgaatataaaattcaggctgagttggctgtcattcttaaatttgtgctggaccatgaggacgggctaaaccttaatgaggacctagagaacttcctacagaaagctcctgtgccttctacctgttctagcacattccctgaagagctctccccacctagccaccaggccaagagggagattcgcttcctagagctacagaaggttgcctcctcttccagtgggaacaactttctctcaggttctccagcttctcccatgggtgatatcctgcagaccccacagttccagatgagacggctgaagaagcagcttgctgatgagagaagtaatagggatgagctggagctggagctagctgagaaccgcaagctcctcaccgagaaggatgcacagatagccatgatgcagcagcgcattgaccgcctagccctgctgaatgagaagcaggcggccagcccactggagcccaaggagcttgaggagctgcgtgacaagaatgagagccttaccatgcggctgcatgaaaccctgaagcagtgccaggacctgaagacagagaagagccagatggatcgcaaaatcaaccagctttcggaggagaatggagacctttcctttaagctgcgggagtttgccagtcatctgcagcagctacaggatgccctcaatgagctgacggaggagcacagcaaggccactcaggagtggctagagaagcaggcccagctggagaaggagctcagcgcagccctgcaggacaagaaatgccttgaagagaagaacgaaatccttcagggaaaactttcacagctggaagaacacttgtcccagctgcaggataacccaccccaggagaagggcgaggtgctgggtgatgtcttgcagctggaaaccttgaagcaagaggcagccactcttgctgcaaacaacacacagctccaagccagggtagagatgctggagactgagcgaggccagcaggaagccaagctgcttgctgagcggggccacttcgaagaagaaaagcagcagctgtctagcctgatcactgacctgcagagctccatctccaacctcagccaggccaaggaagagctggagcaggcctcccaggctcatggggcccggttgactgcccaggtggcctctctgacctctgagctcaccacactcaatgccaccatccagcaacaggatcaagaactggctggcctgaagcagcaggccaaagagaagcaggcccagctagcacagaccctccaacagcaagaacaggcctcccagggcctccgccaccaggtggagcagctaagcagtagcctgaagcagaaggagcagcagttgaaggaggtagcggagaagcaggaggcaactaggcaggaccatgcccagcaactggccactgctgcagaggagcgagaggcctccttaagggagcgggatgcggctctcaagcagctggaggcactggagaaggagaaggctgccaagctggagattctgcagcagcaacttcaggtggctaatgaagcccgggacagtgcccagacctcagtgacacaggcccagcgggagaaggcagagctgagccggaaggtggaggaactccaggcctgtgttgagacagcccgccaggaacagcatgaggcccaggcccaggttgcagagctagagttgcagctgcggtctgagcagcaaaaagcaactgagaaagaaagggtggcccaggagaaggaccagctccaggagcagctccaggccctcaaagagtccttgaaggtcaccaagggcagccttgaagaggagaagcgcagggctgcagatgccctggaagagcagcagcgttgtatctctgagctgaaggcagagacccgaagcctggtggagcagcataagcgggaacgaaaggagctggaagaagagagggctgggcgcaaggggctggaggctcgattacagcagcttggggaggcccatcaggctgagactgaagtcctgcggcgggagctggcagaggccatggctgcccagcacacagctgagagtgagtgtgagcagctcgtcaaagaagtagctgcctggcgtgagcggtatgaggatagccagcaagaggaggcacagtatggcgccatgttccaggaacagctgatgactttgaaggaggaatgtgagaaggcccgccaggagctgcaggaggcaaaggagaaggtggcaggcatagaatcccacagcgagctccagataagccggcagcagaacgaactagctgagctccatgccaacctggccagagcactccagcaggtccaagagaaggaagtcagggcccagaagcttgcagatgacctctccactctgcaggaaaagatggctgccaccagcaaagaggtggcccgcttggagaccttggtgcgcaaggcaggtgagcagcaggaaacagcctcccgggagttagtcaaggagcctgcgagggcaggagacagacagcccgagtggctggaagagcaacagggacgccagttctgcagcacacaggcagcgctgcaggctatggagcgggaggcagagcagatgggcaatgagctggaacggctgcgggccgcgctgatggagagccaggggcagcagcaggaggagcgtgggcagcaggaaagggaggtggcgcggctgacccaggagcggggccgtgcccaggctgaccttgccctggagaaggcggccagagcagagcttgagatgcggctgcagaacgccctcaacgagcagcgtgtggagttcgctaccctgcaagaggcactggctcatgccctgacggaaaaggaaggcaaggaccaggagttggccaagcttcgtggtctggaggcagcccagataaaagagctggaggaacttcggcaaaccgtgaagcaactgaaggaacagctggctaagaaagaaaaggagcacgcatctggctcaggagcccaatctgaggctgctggcaggacagagccaacaggccccaagctggaggcactgcgggcagaggtgagcaagctggaacagcaatgccagaagcagcaggagcaggctgacagcctggaacgcagcctcgaggctgagcgggcctcccgggctgagcgggacagtgctctggagactctgcagggccagttagaggagaaggcccaggagctagggcacagtcagagtgccttagcctcggcccaacgggagttggctgccttccgcaccaaggtacaagaccacagcaaggctgaagatgagtggaaggcccaggtggcccggggccggcaagaggctgagaggaaaaatagcctcatcagcagcttggaggaggaggtgtccatcctgaatcgccaggtcctggagaaggagggggagagcaaggagttgaagcggctggtgatggccgagtcagagaagagccagaagctggaggagaggctgcgcctgctgcaggcagagacagccagcaacagtgccagagctgcagaacgcagctctgctctgcgggaggaggtgcagagcctccgggaggaggctgagaaacagcgggtggcttcagagaacctgcggcaggagctgacctcacaggctgagcgtgcggaggagctgggccaagaattgaaggcgtggcaggagaagttcttccagaaagagcaggccctctccaccctgcagctcgagcacaccagcacacaggccctggtgagtgagctgctgccagctaagcacctctgccagcagctgcaggccgagcaggccgctgccgagaaacgccaccgtgaggagctggagcagagcaagcaggccgctgggggactgcgggcagagctgctgcgggcccagcgggagcttggggagctgattcctctgcggcagaaggtggcagagcaggagcgaacagctcagcagctgcgggcagagaaggccagctatgcagagcagctgagcatgctgaagaaggcgcatggcctgctggcagaggagaaccgggggctgggtgagcgggccaaccttggccggcagtttctggaagtggagttggaccaggcccgggagaagtatgtccaagagttggcagccgtacgtgctgatgctgagacccgtctggctgaggtgcagcgagaagcacagagcactgcccgggagctggaggtgatgactgccaagtatgagggtgccaaggtcaaggtcctggaggagaggcagcggttccaggaagagaggcagaaactcactgcccaggtggagcagctagaggtatttcagagagagcaaactaagcaggtggaagaactgagtaagaaactggctgactctgaccaagccagcaaggtgcagcagcagaagctgaaggctgtccaggctcagggaggcgagagccagcaggaggcccagcgcctccaggcccagctgaatgaactgcaagcccagttgagccagaaggagcaggcagctgagcactataagctgcagatggagaaagccaaaacacattatgatgccaagaagcagcagaaccaagagctgcaggagcagctgcggagcctggagcagctgcagaaggaaaacaaagagctgcgagctgaagctgaacggctgggccatgagctacagcaggctgggctgaagaccaaggaggctgaacagacctgccgccaccttactgcccaggtgcgcagcctggaggcacaggttgcccatgcagaccagcagcttcgagacctgggcaaattccaggtggcaactgatgctttaaagagccgtgagccccaggctaagccccagctggacttgagtattgacagcctggatctgagctgcgaggaggggaccccactcagtatcaccagcaagctgcctcgtacccagccagacggcaccagcgtccctggagaaccagcctcacctatctcccagcgcctgccccccaaggtagaatccctggagagtctctacttcactcccatccctgctcggagtcaggcccccctggagagcagcctggactccctgggagacgtcttcctggactcgggtcgtaagacccgctccgctcgtcggcgcaccacgcagatcatcaacatcaccatgaccaagaagctagatgtggaagagccagacagcgccaactcatcgttctacagcacgcggtctgctcctgcttcccaggctagcctgcgagccacctcctctactcagtctctagctcgcctgggttctcccgattatggcaactcagccctgctcagcttgcctggctaccgccccaccactcgcagttctgctcgtcgttcccaggccggggtgtccagtggggcccctccaggaaggaacagcttctacatgggcacttgccaggatgagcctgagcagctggatgactggaaccgcattgcagagctgcagcagcgcaatcgagtgtgccccccacatctgaagacctgctatcccctggagtccaggccttccctgagcctgggcaccatcacagatgaggagatgaaaactggagacccccaagagaccctgcgccgagccagcatgcagccaatccagatagccgagggcactggcatcaccacccggcagcagcgcaaacgggtctccctagagccccaccagggccctggaactcctgagtctaagaaggccaccagctgtttcccacgccccatgactccccgagaccgacatgaagggcgcaaacagagcactactgaggcccagaagaaagcagctccagcttctactaaacaggctgaccggcgccagtcgatggccttcagcatcctcaacacacccaagaagctagggaacagccttctgcggcggggagcctcaaagaaggccctgtccaaggcttcccccaacactcgcagtggaacccgccgttctccgcgcattgccaccaccacagccagcgccgccactgctgccgccattggtgccacccctcgagccaagggcaaggcaaagcactaaagggccagtaccagtgagtggccccacctgtgtccccgatgctgacctcacctggtcctccgcctactgtccctctcagtgccttctctcagctcccaggccaacagtagccaaacccctagagacagtgatgcctgcccgcaccctggcctggtccctggtccttcactggcgccttctcggagctggcccagggggcctggagcatggacagtgtgggcgctctccctaccttgcctccttttttcttaaagcaaagtcacttctccatcacaaccagatttgaggctggttttgatggctgggtccttgggcctggccagtcttcctcttagcctctggatctagaagggaccataagaggagtaggccctggttcctgctgtcctggtggctgggcccagcaggggccctcactcttgaagtccaggactgggtctgacctggtgggagcacctgccagaggatgctctttcccaggacggatgggccctatgtctcaggagtggggttgggggacagccttcagcagcagctcacaccctaccttccccagacttgcactggggtgggatttggagtgatgggaaggtttttaagggccggggatggatcttttctaaatgttattacttgtaaataaagtctatttttctcccgtg

SEQ ID NO: 66 - protein, 2115 aa, Homo sapiens
MTLHATRGAALLSWVNSLHVADPVEAVLQLQDCSIFIKIIDRIHGTEEGQQILKQPVSERLDFVCSFLQKNRKHPSSPECLVSAQKVLEGSELELAKMTMLLLYHSTMSSKSPRDWEQFEYKIQAELAVILKFVLDHEDGLNLNEDLENFLQKAPVPSTCSSTFPEELSPPSHQAKREIRFLELQKVASSSSGNNFLSGSPASPMGDILQTPQFQMRRLKKQLADERSNRDELELELAENRKLLTEKDAQIAMMQQRIDRLALLNEKQAASPLEPKELEELRDKNESLTMRLHETLKQCQDLKTEKSQMDRKINQLSEENGDLSFKLREFASHLQQLQDALNELTEEHSKATQEWLEKQAQLEKELSAALQDKKCLEEKNEILQGKLSQLEEHLSQLQDNPPQEKGEVLGDVLQLETLKQEAATLAANNTQLQARVEMLETERGQQEAKLLAERGHFEEEKQQLSSLITDLQSSISNLSQAKEELEQASQAHGARLTAQVASLTSELTTLNATIQQQDQELAGLKQQAKEKQAQLAQTLQQQEQASQGLRHQVEQLSSSLKQKEQQLKEVAEKQEATRQDHAQQLATAAEEREASLRERDAALKQLEALEKEKAAKLEILQQQLQVANEARDSAQTSVTQAQREKAELSRKVEELQACVETARQEQHEAQAQVAELELQLRSEQQKATEKERVAQEKDQLQEQLQALKESLKVTKGSLEEEKRRAADALEEQQRCISELKAETRSLVEQHKRERKELEEERAGRKGLEARLQQLGEAHQAETEVLRRELAEAMAAQHTAESECEQLVKEVAAWRERYEDSQQEEAQYGAMFQEQLMTLKEECEKARQELQEAKEKVAGIESHSELQISRQQNELAELHANLARALQQVQEKEVRAQKLADDLSTLQEKMAATSKEVARLETLVRKAGEQQETASRELVKEPARAGDRQPEWLEEQQGRQFCSTQAALQAMEREAEQMGNELERLRAALMESQGQQQEERGQQEREVARLTQERGRAQADLALEKAARAELEMRLQNALNEQRVEFATLQEALAHALTEKEGKDQELAKLRGLEAAQIKELEELRQTVKQLKEQLAKKEKEHASGSGAQSEAAGRTEPTGPKLEALRAEVSKLEQQCQKQQEQADSLERSLEAERASRAERDSALETLQGQLEEKAQELGHSQSALASAQRELAAFRTKVQDHSKAEDEWKAQVARGRQEAERKNSLISSLEEEVSILNRQVLEKEGESKELKRLVMAESEKSQKLEERLRLLQAETASNSARAAERSSALREEVQSLREEAEKQRVASENLRQELTSQAERAEELGQELKAWQEKFFQKEQALSTLQLEHTSTQALVSELLPAKHLCQQLQAEQAAAEKRHREELEQSKQAAGGLRAELLRAQRELGELIPLRQKVAEQERTAQQLRAEKASYAEQLSMLKKAHGLLAEENRGLGERANLGRQFLEVELDQAREKYVQELAAVRADAETRLAEVQREAQSTARELEVMTAKYEGAKVKVLEERQRFQEERQKLTAQVEQLEVFQREQTKQVEELSKKLADSDQASKVQQQKLKAVQAQGGESQQEAQRLQAQLNELQAQLSQKEQAAEHYKLQMEKAKTHYDAKKQQNQELQEQLRSLEQLQKENKELRAEAERLGHELQQAGLKTKEAEQTCRHLTAQVRSLEAQVAHADQQLRDLGKFQVATDALKSREPQAKPQLDLSIDSLDLSCEEGTPLSITSKLPRTQPDGTSVPGEPASPISQRLPPKVESLESLYFTPIPARSQAPLESSLDSLGDVFLDSGRKTRSARRRTTQIINITMTKKLDVEEPDSANSSFYSTRSAPASQASLRATSSTQSLARLGSPDYGNSALLSLPGYRPTTRSSARRSQAGVSSGAPPGRNSFYMGTCQDEPEQLDDWNRIAELQQRNRVCPPHLKTCYPLESRPSLSLGTITDEEMKTGDPQETLRRASMQPIQIAEGTGITTRQQRKRVSLEPHQGPGTPESKKATSCFPRPMTPRDRHEGRKQSTTEAQKKAAPASTKQADRRQSMAFSILNTPKKLGNSLLRRGASKKALSKASPNTRSGTRRSPRIATTTASAATAAAIGATPRAKGKAKH

SEQ ID NO: 67 - DNA, 1878 bp, Artificial Sequence
  source: /note="Description of Artificial Sequence: Synthetic polynucleotide"
  CDS (1)..(1875)
atggctgggatcaccaccatcgaggcggtgaagcgcaagatccaggttctgcagcagcaggcagatgatgcagaggagcgagctgagcgcctccagcgagaagttgagggagaaaggcgggcccgggaacaggctgaggctgaggtggcctccttgaaccgtaggatccagctggttgaagaagagctggaccgtgctcaggagcgcctggccactgccctgcaaaagctggaagaagctgaaaaagctgctgatgagagtgagagaggtatgaaggttattgaaaaccgggccttaaaagatgaagaaaagatggaactccaggaaatccaactcaaagaagctaagcacattgcagaagaggcagataggaagtatgaagaggtggctcgtaagttggtgatcattgaaggagacttggaacgcacagaggaacgagctgagctggcagagtcccgttgccgagagatggatgagcagattagactgatggaccagaacctgaagtgtctgagtgctgctgaagaaaagtactctcaaaaagaagataaatatgaggaagaaatcaagattcttactgataaactcaaggaggcagagacccgtgctgagtttgctgagagatcggtagccaagctggaaaagacaattgatgacctggaagtctccttctcgccggtggacactaacagcacatctggagacccggtggagaagaaggacgaaacaccttttggggtctcggtggctgtgggcctggccgtctttgcctgcctcttcctttctacgctgctccttgtgctcaacaaatgtggacggagaaacaagtttgggatcaaccgcccggctgtgctggctccagaggatgggctggccatgtccctgcatttcatgacattgggtggcagctccctgtcccccaccgagggcaaaggctctgggctccaaggccacatcatcgagaacccacaatacttcagtgatgcctgtgttcaccacatcaagcgccgggacatcgtgctcaagtgggagctgggggagggcgcctttgggaaggtcttccttgctgagtgccacaacctcctgcctgagcaggacaagatgctggtggctgtcaaggcactgaaggaggcgtccgagagtgctcggcaggacttccagcgtgaggctgagctgctcaccatgctgcagcaccagcacatcgtgcgcttcttcggcgtctgcaccgagggccgccccctgctcatggtctttgagtatatgcggcacggggacctcaaccgcttcctccgatcccatggacctgatgccaagctgctggctggtggggaggatgtggctccaggccccctgggtctggggcagctgctggccgtggctagccaggtcgctgcggggatggtgtacctggcgggtctgcattttgtgcaccgggacctggccacacgcaactgtctagtgggccagggactggtggtcaagattggtgattttggcatgagcagggatatctacagcaccgactattaccgtgtgggaggccgcaccatgctgcccattcgctggatgccgcccgagagcatcctgtaccgtaagttcaccaccgagagcgacgtgtggagcttcggcgtggtgctctgggagatcttcacctacggcaagcagccctggtaccagctctccaacacggaggcaatcgactgcatcacgcagggacgtgagttggagcggccacgtgcctgcccaccagaggtctacgccatcatgcggggctgctggcagcgggagccccagcaacgccacagcatcaaggatgtgcacgcccggctgcaagccctggcccaggcacctcctgtctacctggatgtcctgggctag

SEQ ID NO: 68 - protein, 625 aa, Artificial Sequence
  source: /note="Description of Artificial Sequence: Synthetic polypeptide"
MAGITTIEAVKRKIQVLQQQADDAEERAERLQREVEGERRAREQAEAEVASLNRRIQLVEEELDRAQERLATALQKLEEAEKAADESERGMKVIENRALKDEEKMELQEIQLKEAKHIAEEADRKYEEVARKLVIIEGDLERTEERAELAESRCREMDEQIRLMDQNLKCLSAAEEKYSQKEDKYEEEIKILTDKLKEAETRAEFAERSVAKLEKTIDDLEVSFSPVDTNSTSGDPVEKKDETPFGVSVAVGLAVFACLFLSTLLLVLNKCGRRNKFGINRPAVLAPEDGLAMSLHFMTLGGSSLSPTEGKGSGLQGHIIENPQYFSDACVHHIKRRDIVLKWELGEGAFGKVFLAECHNLLPEQDKMLVAVKALKEASESARQDFQREAELLTMLQHQHIVRFFGVCTEGRPLLMVFEYMRHGDLNRFLRSHGPDAKLLAGGEDVAPGPLGLGQLLAVASQVAAGMVYLAGLHFVHRDLATRNCLVGQGLVVKIGDFGMSRDIYSTDYYRVGGRTMLPIRWMPPESILYRKFTTESDVWSFGVVLWEIFTYGKQPWYQLSNTEAIDCITQGRELERPRACPPEVYAIMRGCWQREPQQRHSIKDVHARLQALAQAPPVYLDVLG

SEQ ID NO: 69 - DNA, 3212 bp, Homo sapiens
gtcacatccgggcgggttggtgagttccggtatttcagggcgtagcaggcggaagtaagggtgagaggaggctgcaacgccgagcggaggaggcaggaaccggagcgcgagcagtagctgggtgggcaccatggctgggatcaccaccatcgaggcggtgaagcgcaagatccaggttctgcagcagcaggcagatgatgcagaggagcgagctgagcgcctccagcgagaagttgagggagaaaggcgggcccgggaacaggctgaggctgaggtggcctccttgaaccgtaggatccagctggttgaagaagagctggaccgtgctcaggagcgcctggccactgccctgcaaaagctggaagaagctgaaaaagctgctgatgagagtgagagaggtatgaaggttattgaaaaccgggccttaaaagatgaagaaaagatggaactccaggaaatccaactcaaagaagctaagcacattgcagaagaggcagataggaagtatgaagaggtggctcgtaagttggtgatcattgaaggagacttggaacgcacagaggaacgagctgagctggcagagtcccgttgccgagagatggatgagcagattagactgatggaccagaacctgaagtgtctgagtgctgctgaagaaaagtactctcaaaaagaagataaatatgaggaagaaatcaagattcttactgataaactcaaggaggcagagacccgtgctgagtttgctgagagatcggtagccaagctggaaaagacaattgatgacctggaagataaactgaaatgcaccaaagaggagcacctctgtacacaaaggatgctggaccagaccctgcttgacctgaatgagatgtagaacgccccagtcccaccctgctgctgctcctccctctgacccagactccgcctgaggccagcctgcgggaagctgacctttaactgagggctgatctttaactggaaggctgctttctcctttcaccaccccctccttccctgtgtctttttcgccaaactgtctctgcctcttcccggagaatccagctgggctagaggctgagcacctttggaaacaacatttaagggaatgtgagcacaatgcataatgtctttaaaaagcatgttgtgatgtacacattttgtaattaccttttttgttgttttgtagcaaccatttgtaaaacattccaaataattccacagtcctgaagcagcaatcgaatccctttctcacttttggaaggtgacttttcaccttaatgcatattcccctctccatagaggagaggaaaaggtgtaggcctgccttaccgagagccaaacagagcccagggagactccgctgtgggaaacctcattgttctgtacaaagtactagctaaaccagaaaggtgattccaggaggagttagccaaacaacaacaaaaacaaaaaatgtgctgttcaagttttcagctttaagatatctttggataatgttatttctattttttatttttttcattagaagttaccaaattaagatggtaagacctctgagaccaaaattttgtcccatctctaccccctcacaactgcttacagaatggatcatgtcccccttatgttgaggtgaccacttaattgctttcctgcctccttgaaagaaagaaagaaagaagactgtgtttttgccactgatttagccatgtgaaactcatctcattacccttttctgggtttgaagctgctgtctctagaagtgccatctcaattgtgctttgtatcagtcagtgctggagaaatcttgaatagcttatgtacaaaactttttaaattttatattattttgaaactttgctttgggtttgtggcaccctggccaccccatctggctgtgacagcctctgcagtccgtgggctggcagtttgttgatcttttaagtttccttccctacccagtccccattttctggtaaggtttctaggaggtctgttaggtgtacatcctgcagcttattggcttaaaatgtactctccttttatgtggtctctttggggccgattgggagaaagagaaatcaatagtgcaactgttttgatactgaatattgacaagtgtctttttgaaataaagaaccagtccctccaaccctcagacctatttgacttttatttattaaaactaaatgtgctttctccacagaagctatgaggtttgggttaaaaatagcatctttgtgggtggtagcaacaggatttattctttattattattatttttgagatgaagtttcattcttgttgcctgggctggagcgtaatggctcgatctcggctcactgcaacctccgcctcctggttcaagagattctcctgcctcagcctcccgagtagctgggattacaggcacctgccaccatgcccgggtaattttttatattttaagtagagacagggcttcaccatgttggccaggctggtctcgaactcctgaccttcaggtgatccacctgcctcagcttcccaaaatgctgggattacgggcgtgagccaccgcacccagctggagcaacaggatttaatatagagcaaatgtttagttttatcatctgtaaaatggagataagtattgtcagagtaaacatgaagattagaaagaacacttaatgtgctgggccttttataggttaacactgacatctcaggctgaactatatacattttccttcacaaccatatcaatccttataaactatggatttatgctccttaaaacaatatataatgctgatcactactataaatgcgtggttttaaccaactgtactgaaacagctttgagtttatattctgtttggatatttggagaaaacaacaagtgctctcaagagtatttgcttagaggccggctgtgtgagtggataactttgaaagctgcttttgagacgccagtgtctggcatttcctgcattctggcctggaggccggacgtgaatctgacttctagtaaaaatacacggttcccttgacaaagtcgagctgtttatcccagagactgcacaattttccgttgataggcatggaccaatgctaactggaaatcattgcaaaaagtttttttgtcgggcggagggtgtggtgttaagataaacagtgtgcaacagaagaaattaaaactggaagaaattaaagggttttttttagacttt

SEQ ID NO: 70 - protein, 248 aa, Homo sapiens
MAGITTIEAVKRKIQVLQQQADDAEERAERLQREVEGERRAREQAEAEVASLNRRIQLVEEELDRAQERLATALQKLEEAEKAADESERGMKVIENRALKDEEKMELQEIQLKEAKHIAEEADRKYEEVARKLVIIEGDLERTEERAELAESRCREMDEQIRLMDQNLKCLSAAEEKYSQKEDKYEEEIKILTDKLKEAETRAEFAERSVAKLEKTIDDLEDKLKCTKEEHLCTQRMLDQTLLDLNEM

SEQ ID NO: 71 - DNA, 2631 bp, Artificial Sequence
  source: /note="Description of Artificial Sequence: Synthetic polynucleotide"
  CDS (1)..(2628)
atggatgtagatgctgaaagagagaagataacacaggagatcaaggagctggaaaggattttggatcccggctcctcgggctcccacgtggagatctcagaatcaagtctcgagtcagattctgaagcaggtgagaccgtggagccgcccccgccggcgcagctgcacttcatgtacgtggcggcggccgcctttgtgcttctgttcttcgtgggctgcggggtgctgctgtcccgcaagcgccggcggcagcatggccagctctggttccctgagggcttcaaagtgtctgaggccagcaagaagaagcggcgggagcccctcggcgaggactccgtgggcctcaagcccctgaagaacgcttcagacggtgccctcatggacgacaaccagaatgagtggggggacgaggacctggagaccaagaagttccggttcgaggagcccgtggttctgcctgacctggacgaccagacagaccaccggcagtggactcagcagcacctggatgccgctgacctgcgcatgtctgccatggcccccacaccgccccagggtgaggttgacgccgactgcatggacgtcaatgtccgcgggcctgatggcttcaccccgctcatgatcgcctcctgcagcgggggcggcctggagacgggcaacagcgaggaagaggaggacgcgccggccgtcatctccgacttcatctaccagggcgccagcctgcacaaccagacagaccgcacgggcgagaccgccttgcacctggccgcccgctactcacgctctgatgccgccaagcgcctgctggaggccagcgcagatgccaacatccaggacaacatgggccgcaccccgctgcatgcggctgtgtctgccgacgcacaaggtgtcttccagatcctgatccggaaccgagccacagacctggatgcccgcatgcatgatggcacgacgccactgatcctggctgcccgcctggccgtggagggcatgctggaggacctcatcaactcacacgccgacgtcaacgccgtagatgacctgggcaagtccgccctgcactgggccgccgccgtgaacaatgtggatgccgcagttgtgctcctgaagaacggggctaacaaagatatgcagaacaacagggaggagacacccctgtttctggccgcccgggagggcagctacgagaccgccaaggtgctgctggaccactttgccaaccgggacatcacggatcatatggaccgcctgccgcgcgacatcgcacaggagcgcatgcatcacgacatcgtgaggctgctggacgagtacaacctggtgcgcagcccgcagctgcacggagccccgctggggggcacgcccaccctgtcgcccccgctctgctcgcccaacggctacctgggcagcctcaagcccggcgtgcagggcaagaaggtccgcaagcccagcagcaaaggcctggcctgtggaagcaaggaggccaaggacctcaaggcacggaggaagaagtcccaggacggcaagggctgcctgctggacagctccggcatgctctcgcccgtggactccctggagtcaccccatggctacctgtcagacgtggcctcgccgccactgctgccctccccgttccagcagtctccgtccgtgcccctcaaccacctgcctgggatgcccgacacccacctgggcatcgggcacctgaacgtggcggccaagcccgagatggcggcgctgggtgggggcggccggctggcctttgagactggcccacctcgtctctcccacctgcctgtggcctctggcaccagcaccgtcctgggctccagcagcggaggggccctgaatttcactgtgggcgggtccaccagtttgaatggtcaatgcgagtggctgtcccggctgcagagcggcatggtgccgaaccaatacaaccctctgcgggggagtgtggcaccaggccccctgagcacacaggccccctccctgcagcatggcatggtaggcccgctgcacagtagccttgctgccagcgccctgtcccagatgatgagctaccagggcctgcccagcacccggctggccacccagcctcacctggtgcagacccagcaggtgcagccacaaaacttacagatgcagcagcagaacctgcagccagcaaacatccagcagcagcaaagcctgcagccgccaccaccaccaccacagccgcaccttggcgtgagctcagcagccagcggccacctgggccggagcttcctgagtggagagccgagccaggcagacgtgcagccactgggccccagcagcctggcggtgcacactattctgccccaggagagccccgccctgcccacgtcgctgccatcctcgctggtcccacccgtgaccgcagcccagttcctgacgcccccctcgcagcacagctactcctcgcctgtggacaacacccccagccaccagctacaggtgcctgagcaccccttcctcaccccgtcccctgagtcccctgaccagtggtccagctcgtccccgcattccaacgtctccgactggtccgagggcgtctccagccctcccaccagcatgcagtcccagatcgcccgcattccggaggccttcaagtaa

SEQ ID NO: 72 - protein, 876 aa, Artificial Sequence
  source: /note="Description of Artificial Sequence: Synthetic polypeptide"
MDVDAEREKITQEIKELERILDPGSSGSHVEISESSLESDSEAGETVEPPPPAQLHFMYVAAAAFVLLFFVGCGVLLSRKRRRQHGQLWFPEGFKVSEASKKKRREPLGEDSVGLKPLKNASDGALMDDNQNEWGDEDLETKKFRFEEPVVLPDLDDQTDHRQWTQQHLDAADLRMSAMAPTPPQGEVDADCMDVNVRGPDGFTPLMIASCSGGGLETGNSEEEEDAPAVISDFIYQGASLHNQTDRTGETALHLAARYSRSDAAKRLLEASADANIQDNMGRTPLHAAVSADAQGVFQILIRNRATDLDARMHDGTTPLILAARLAVEGMLEDLINSHADVNAVDDLGKSALHWAAAVNNVDAAVVLLKNGANKDMQNNREETPLFLAAREGSYETAKVLLDHFANRDITDHMDRLPRDIAQERMHHDIVRLLDEYNLVRSPQLHGAPLGGTPTLSPPLCSPNGYLGSLKPGVQGKKVRKPSSKGLACGSKEAKDLKARRKKSQDGKGCLLDSSGMLSPVDSLESPHGYLSDVASPPLLPSPFQQSPSVPLNHLPGMPDTHLGIGHLNVAAKPEMAALGGGGRLAFETGPPRLSHLPVASGTSTVLGSSSGGALNFTVGGSTSLNGQCEWLSRLQSGMVPNQYNPLRGSVAPGPLSTQAPSLQHGMVGPLHSSLAASALSQMMSYQGLPSTRLATQPHLVQTQQVQPQNLQMQQQNLQPANIQQQQSLQPPPPPPQPHLGVSSAASGHLGRSFLSGEPSQADVQPLGPSSLAVHTILPQESPALPTSLPSSLVPPVTAAQFLTPPSQHSYSSPVDNTPSHQLQVPEHPFLTPSPESPDQWSSSSPHSNVSDWSEGVSSPPTSMQSQIARIPEAFK

SEQ ID NO: 73 - DNA, 4661 bp, Homo sapiens
gcgggagtcatggatgtagatgctgaaagagagaagataacacaggagatcaaggagctggaaaggattttggatcccggctcctcgggctcccacgtggagatctcagaatcaagtctcgagtcagattctgaagcagattcactgccttctgaggacttggatcctgccgatcccccgatctcggaagaagaaaggtggggcgaagccagcaatgacgaggacgatcccaaggataaaaccctccctgaagacccagaaacctgcctgcagctgaacatggtctaccaggaggtcatccaggagaagctggctgaggccaacctgctgctggcccagaaccgggagcagcaggaggaactcatgagggatctggctgggtccaaaggcaccaaggtgaaagatggcaaaagcctgcccccaagcacatacatggggcacttcatgaagccgtatttcaaggacaaggtcacgggcgtggggccacctgccaacgaggacacacgagagaaggctgcccaggggatcaaggctttcgaggagctccttgtgaccaaatggaaaaactgggaaaaggccttgctccgaaagtcagtggtgagtgaccgcctgcagcgattgcttcagcccaagttactgaagctcgagtacttgcaccagaagcagagcaaagtctccagtgagctggagaggcaagccctggagaagcagggcagggaagccgagaaggagatccaggacatcaaccagcttccagaagaggccttgctgggaaacaggctggacagccacgactgggagaagatttccaatattaactttgaaggcagccgcagtgcagaggagatccggaagttctggcagaactcggagcaccccagcatcaacaagcaggagtggagcagggaggaggaggagcggctgcaggcgatcgcggctgcacacggccacctggagtggcagaagattgcagaggagctggggaccagccgcagcgccttccagtgcctgcagaaattccagcagcacaacaaagctctgaaacgcaaggagtggacagaggaggaggaccgcatgctcacgcagctggtgcaggagatgcgcgtcggcagccacatcccctaccgcagaattgtctactatatggaagggagagactccatgcagctgatctaccgatggaccaagagcttggatcctggtctgaagaagggttactgggccccggaggaagatgctaagttgcttcaagctgttgccaaatacggggagcaggattggtttaaaatccgggaagaggtgccaggtaggagcgatgcccagtgccgagatcggtatctcaggagattacatttcagcttgaaaaagggtcggtggaatttaaaagaagaggaacagttaattgaattaatagaaaaatatggtgtcggtcactgggcaaaaatagcttctgagctgccccatcggtctggctcccagtgtctgagcaagtggaagatcatgatggggaagaagcagggtctccggaggcggcggcggagggcccgtcacagcgtccggtggagctctaccagcagcagcggcagcagcagtggcagcagtggagggagcagcagcagcagcagcagcagcagcgaggaggacgagccagagcaggcgcaggccggggagggtgacagagcgctgctgtccccacagtacatggtcccggacatggacctgtgggttcctgccaggcagagcaccagccagccatggagaggaggggcaggggcctggctgggaggccccgctgcctccctcagccctcccaaggggtccagtgccagccagggcggcagcaaggaagcttccaccacagccgcggctcctggagaggagacgagtccggtgcaggtccctgccagggcccacggccctgtcccgaggtctgcccaggcctcccactcagcagacactcgcccggcgggcgcagagaagcaggccctggagggtgggaggcgtctgctgacagtgcctgtggagaccgtgctgagggtgctcagggccaacacggctgctcggagctgcacacagaaagagcagctgaggcagccacccctgcccacctcatccccaggggtcagctctggtgacagcgtggcccgatcccatgtgcagtggctacggcacagagccacccagagtgggcagcggcgctggagacacgctctgcaccggaggctcctgaaccgcaggctgctgctggctgtgaccccttgggtaggggacgttgtcgtgccctgcacacaggcttcccagagacccgccgtagtgcagactcaagcggatggcctcagggagcagctgcagcaggcccgcctggccagcacccctgtgtttaccctgtttacccagctgttccacatcgatactgccggctgcttggaggtcgtccgagagaggaaggccctgccacccaggctgccccaggctggtgctcgggacccaccagttcatcttctgcaggcatcctcaagtgcccagagcaccccaggccacctcttcccaaacgtgccggctcaagaagcctcaaagagtgccagccacaaagggagccgaagactggcgtccagccgggtggagcgcaccctaccccaggcgtccctgctggcttcaaccggcccccggcccaagcccaagactgtgtcggagctgcttcaggagaagcggcttcaggaggcccgtgccagggaggccacccggggcccggtggtgctcccgtcccagctgctggtctcctcgtctgtgatcctccagccccctctaccacacaccccacacggccgcccagccccgggtcccaccgtcttaaatgtaccgctctctgggcctggggcccccgcggcagccaaacctggcacttctggctcctggcaggaggctgggacttcagccaaggacaagagactctccaccatgcaagccctgcccctcgctcctgtcttctcagaggccgagggcacagcccctgctgcttcccaagcccctgccctgggccccggccagatctctgtgagctgccccgagagtggtctcggacagtctcaggcccccgctgcatcccggaagcagggcctgcctgaggcgccaccctttctccccgcagcccccagccccaccccactgcccgtccagcccctcagcctgacgcacataggagggccacatgtggcgaccagtgtccccctgcctgtcacctgggtgctcacagcccaggggcttctccctgttcctgtaccagctgtggtgagccttcccaggccagcagggacccctggccccgcagggctgctggccactctgctgcctcccctgactgagactcgggcggcccagggccccagggccccagcgttgagcagctcttggcagcccccagccaatatgaacagggaaccggagccttcctgcaggacagacaccccagctcctcccacacacgccctctcccaaagtcctgcagaagcggatggcagtgtggcctttgtccctggagaggcccaggtggccagggagatacctgagcccaggacgtcctcccacgctgaccctcctgaagcagaacccccttggtccgggaggctgccagccttcggtggtgtcatcccagcaactgagccaagggggacgccggggtccccctcagggacacaggagcccagggggcctctgggcctggagaagctgcccctgcgccagcctgggcctgagaagggggccctggacctggagaagccgcccctaccccagcctgggcctgagaagggggccctggacctgggcctgctgtcccaggagggcgaggcggccacacagcagtggctggggggccagcggggggtgcgtgtgcctcttctgggcagcagactgccctatcagcccccagccctgtgcagcctgcgagctctgtccggtctcctactccacaagaaggccctggagcacaaggccacctccctggtggtggggggcgaggctgagcggccggccggagcactgcaagcctcactggggctggtgcgggggcagctccaggacaacccggcctacctcctgttgcgggcgcggttcctggcagccttcaccctccctgcgctcctggccaccctggccccccaaggcgtccgcaccaccctctcagtaccttcgagggtgggctctgagagtgaggatgaagacctcctgagtgagctggaacttgcagacagggacgggcagccgggctgcacgacagccacatgccccattcagggagccccagactctggtaaatgctctgcttcctcctgcctggatacttctaatgaccctgacgacctggacgtgctcagaacccggcatgccaggcacacccggaagcggaggcggctggtgtgagcagcaggacaagcactttctcagaagcccgtggccctgctgacgagagacagcccacccccagcctgcaagagaggcagccagaggccaggtatctgctggccgctgactgaccaggtccgcagtgaacagaggcgggcctgccgactgactgtgtggcatggagcatggctgttccccaagtgcacacctgaacacttggaggaataaagttctgtttttaattgtggaaaaaaaaaaaa

SEQ ID NO: 74 - protein, 1469 aa, Homo sapiens
MDVDAEREKITQEIKELERILDPGSSGSHVEISESSLESDSEADSLPSEDLDPADPPISEEERWGEASNDEDDPKDKTLPEDPETCLQLNMVYQEVIQEKLAEANLLLAQNREQQEELMRDLAGSKGTKVKDGKSLPPSTYMGHFMKPYFKDKVTGVGPPANEDTREKAAQGIKAFEELLVTKWKNWEKALLRKSVVSDRLQRLLQPKLLKLEYLHQKQSKVSSELERQALEKQGREAEKEIQDINQLPEEALLGNRLDSHDWEKISNINFEGSRSAEEIRKFWQNSEHPSINKQEWSREEEERLQAIAAAHGHLEWQKIAEELGTSRSAFQCLQKFQQHNKALKRKEWTEEEDRMLTQLVQEMRVGSHIPYRRIVYYMEGRDSMQLIYRWTKSLDPGLKKGYWAPEEDAKLLQAVAKYGEQDWFKIREEVPGRSDAQCRDRYLRRLHFSLKKGRWNLKEEEQLIELIEKYGVGHWAKIASELPHRSGSQCLSKWKIMMGKKQGLRRRRRRARHSVRWSSTSSSGSSSGSSGGSSSSSSSSSEEDEPEQAQAGEGDRALLSPQYMVPDMDLWVPARQSTSQPWRGGAGAWLGGPAASLSPPKGSSASQGGSKEASTTAAAPGEETSPVQVPARAHGPVPRSAQASHSADTRPAGAEKQALEGGRRLLTVPVETVLRVLRANTAARSCTQKEQLRQPPLPTSSPGVSSGDSVARSHVQWLRHRATQSGQRRWRHALHRRLLNRRLLLAVTPWVGDVVVPCTQASQRPAVVQTQADGLREQLQQARLASTPVFTLFTQLFHIDTAGCLEVVRERKALPPRLPQAGARDPPVHLLQASSSAQSTPGHLFPNVPAQEASKSASHKGSRRLASSRVERTLPQASLLASTGPRPKPKTVSELLQEKRLQEARAREATRGPVVLPSQLLVSSSVILQPPLPHTPHGRPAPGPTVLNVPLSGPGAPAAAKPGTSGSWQEAGTSAKDKRLSTMQALPLAPVFSEAEGTAPAASQAPALGPGQISVSCPESGLGQSQAPAASRKQGLPEAPPFLPAAPSPTPLPVQPLSLTHIGGPHVATSVPLPVTWVLTAQGLLPVPVPAVVSLPRPAGTPGPAGLLATLLPPLTETRAAQGPRAPALSSSWQPPANMNREPEPSCRTDTPAPPTHALSQSPAEADGSVAFVPGEAQVAREIPEPRTSSHADPPEAEPPWSGRLPAFGGVIPATEPRGTPGSPSGTQEPRGPLGLEKLPLRQPGPEKGALDLEKPPLPQPGPEKGALDLGLLSQEGEAATQQWLGGQRGVRVPLLGSRLPYQPPALCSLRALSGLLLHKKALEHKATSLVVGGEAERPAGALQASLGLVRGQLQDNPAYLLLRARFLAAFTLPALLATLAPQGVRTTLSVPSRVGSESEDEDLLSELELADRDGQPGCTTATCPIQGAPDSGKCSASSCLDTSNDPDDLDVLRTRHARHTRKRRRLV

SEQ ID NO: 75 - DNA, 9309 bp, Homo sapiens
atgccgccgctcctggcgcccctgctctgcctggcgctgctgcccgcgctcgccgcacgaggcccgcgatgctcccagcccggtgagacctgcctgaatggcgggaagtgtgaagcggccaatggcacggaggcctgcgtctgtggcggggccttcgtgggcccgcgatgccaggaccccaacccgtgcctcagcaccccctgcaagaacgccgggacatgccacgtggtggaccgcagaggcgtggcagactatgcctgcagctgtgccctgggcttctctgggcccctctgcctgacacccctggacaatgcctgcctcaccaacccctgccgcaacgggggcacctgcgacctgctcacgctgacggagtacaagtgccgctgcccgcccggctggtcagggaaatcgtgccagcaggctgacccgtgcgcctccaacccctgcgccaacggtggccagtgcctgcccttcgaggcctcctacatctgccactgcccacccagcttccatggccccacctgccggcaggatgtcaacgagtgtggccagaagcccgggctttgccgccacggaggcacctgccacaacgaggtcggctcctaccgctgcgtctgccgcgccacccacactggccccaactgcgagcggccctacgtgccctgcagcccctcgccctgccagaacgggggcacctgccgccccacgggcgacgtcacccacgagtgtgcctgcctgccaggcttcaccggccagaactgtgaggaaaatatcgacgattgtccaggaaacaactgcaagaacgggggtgcctgtgtggacggcgtgaacacctacaactgccgctgcccgccagagtggacaggtcagtactgtaccgaggatgtggacgagtgccagctgatgccaaatgcctgccagaacggcgggacctgccacaacacccacggtggctacaactgcgtgtgtgtcaacggctggactggtgaggactgcagcgagaacattgatgactgtgccagcgccgcctgcttccacggcgccacctgccatgaccgtgtggcctccttctactgcgagtgtccccatggccgcacaggtctgctgtgccacctcaacgacgcatgcatcagcaacccctgtaacgagggctccaactgcgacaccaaccctgtcaatggcaaggccatctgcacctgcccctcggggtacacgggcccggcctgcagccaggacgtggatgagtgctcgctgggtgccaacccctgcgagcatgcgggcaagtgcatcaacacgctgggctccttcgagtgccagtgtctgcagggctacacgggcccccgatgcgagatcgacgtcaacgagtgcgtctcgaacccgtgccagaacgacgccacctgcctggaccagattggggagttccagtgcatctgcatgcccggctacgagggtgtgcactgcgaggtcaacacagacgagtgtgccagcagcccctgcctgcacaatggccgctgcctggacaagatcaatgagttccagtgcgagtgccccacgggcttcactgggcatctgtgccagtacgatgtggacgagtgtgccagcaccccctgcaagaatggtgccaagtgcctggacggacccaacacttacacctgtgtgtgcacggaagggtacacggggacgcactgcgaggtggacatcgatgagtgcgaccccgacccctgccactacggctcctgcaaggacggcgtcgccaccttcacctgcctctgccgcccaggctacacgggccaccactgcgagaccaacatcaacgagtgctccagccagccctgccgccacgggggcacctgccaggaccgcgacaacgcctacctctgcttctgcctgaaggggaccacaggacccaactgcgagatcaacctggatgactgtgccagcagcccctgcgactcgggcacctgtctggacaagatcgatggctacgagtgtgcctgtgagccgggctacacagggagcatgtgtaacatcaacatcgatgagtgtgcgggcaacccctgccacaacgggggcacctgcgaggacggcatcaatggcttcacctgccgctgccccgagggctaccacgaccccacctgcctgtctgaggtcaatgagtgcaacagcaacccctgcgtccacggggcctgccgggacagcctcaacgggtacaagtgcgactgtgaccctgggtggagtgggaccaactgtgacatcaacaacaatgagtgtgaatccaacccttgtgtcaacggcggcacctgcaaagacatgaccagtggctacgtgtgcacctgccgggagggcttcagcggtcccaactgccagaccaacatcaacgagtgtgcgtccaacccatgtctgaaccagggcacgtgtattgacgacgttgccgggtacaagtgcaactgcctgctgccctacacaggtgccacgtgtgaggtggtgctggccccgtgtgcccccagcccctgcagaaacggcggggagtgcaggcaatccgaggactatgagagcttctcctgtgtctgccccacgggctggcaagggcagacctgtgaggtcgacatcaacgagtgcgttctgagcccgtgccggcacggcgcatcctgccagaacacccacggcggctaccgctgccactgccaggccggctacagtgggcgcaactgcgagaccgacatcgacgactgccggcccaacccgtgtcacaacgggggctcctgcacagacggcatcaacacggccttctgcgactgcctgcccggcttccggggcactttctgtgaggaggacatcaacgagtgtgccagtgacccctgccgcaacggggccaactgcacggactgcgtggacagctacacgtgcacctgccccgcaggcttcagcgggatccactgtgagaacaacacgcctgactgcacagagagctcctgcttcaacggtggcacctgcgtggacggcatcaactcgttcacctgcctgtgtccacccggcttcacgggcagctactgccagcacgatgtcaatgagtgcgactcacagccctgcctgcatggcggcacctgtcaggacggctgcggctcctacaggtgcacctgcccccagggctacactggccccaactgccagaaccttgtgcactggtgtgactcctcgccctgcaagaacggcggcaaatgctggcagacccacacccagtaccgctgcgagtgccccagcggctggaccggcctttactgcgacgtgcccagcgtgtcctgtgaggtggctgcgcagcgacaaggtgttgacgttgcccgcctgtgccagcatggagggctctgtgtggacgcgggcaacacgcaccactgccgctgccaggcgggctacacaggcagctactgtgaggacctggtggacgagtgctcacccagcccctgccagaacggggccacctgcacggactacctgggcggctactcctgcaagtgcgtggccggctaccacggggtgaactgctctgaggagatcgacgagtgcctctcccacccctgccagaacgggggcacctgcctcgacctccccaacacctacaagtgctcctgcccacggggcactcagggtgtgcactgtgagatcaacgtggacgactgcaatccccccgttgaccccgtgtcccggagccccaagtgctttaacaacggcacctgcgtggaccaggtgggcggctacagctgcacctgcccgccgggcttcgtgggtgagcgctgtgagggggatgtcaacgagtgcctgtccaatccctgcgacgcccgtggcacccagaactgcgtgcagcgcgtcaatgacttccactgcgagtgccgtgctggtcacaccgggcgccgctgcgagtccgtcatcaatggctgcaaaggcaagccctgcaagaatgggggcacctgcgccgtggcctccaacaccgcccgcgggttcatctgcaagtgccctgcgggcttcgagggcgccacgtgtgagaatgacgctcgtacctgcggcagcctgcgctgcctcaacggcggcacatgcatctccggcccgcgcagccccacctgcctgtgcctgggccccttcacgggccccgaatgccagttcccggccagcagcccctgcctgggcggcaacccctgctacaaccaggggacctgtgagcccacatccgagagccccttctaccgttgcctgtgccccgccaaattcaacgggctcttgtgccacatcctggactacagcttcgggggtggggccgggcgcgacatccccccgccgctgatcgaggaggcgtgcgagctgcccgagtgccaggaggacgcgggcaacaaggtctgcagcctgcagtgcaacaaccacgcgtgcggctgggacggcggtgactgctccctcaacttcaatgacccctggaagaactgcacgcagtctctgcagtgctggaagtacttcagtgacggccactgtgacagccagtgcaactcagccggctgcctcttcgacggctttgactgccagcgtgcggaaggccagtgcaaccccctgtacgaccagtactgcaaggaccacttcagcgacgggcactgcgaccagggctgcaacagcgcggagtgcgagtgggacgggctggactgtgcggagcatgtacccgagaggctggcggccggcacgctggtggtggtggtgctgatgccgccggagcagctgcgcaacagctccttccacttcctgcgggagctcagccgcgtgctgcacaccaacgtggtcttcaagcgtgacgcacacggccagcagatgatcttcccctactacggccgcgaggaggagctgcgcaagcaccccatcaagcgtgccgccgagggctgggccgcacctgacgccctgctgggccaggtgaaggcctcgctgctccctggtggcagcgagggtgggcggcggcggagggagctggaccccatggacgtccgcggctccatcgtctacctggagattgacaaccggcagtgtgtgcaggcctcctcgcagtgcttccagagtgccaccgacgtggccgcattcctgggagcgctcgcctcgctgggcagcctcaacatcccctacaagatcgaggccgtgcagagtgagaccgtggagccgcccccgccggcgcagctgcacttcatgtacgtggcggcggccgcctttgtgcttctgttcttcgtgggctgcggggtgctgctgtcccgcaagcgccggcggcagcatggccagctctggttccctgagggcttcaaagtgtctgaggccagcaagaagaagcggcgggagcccctcggcgaggactccgtgggcctcaagcccctgaagaacgcttcagacggtgccctcatggacgacaaccagaatgagtggggggacgaggacctggagaccaagaagttccggttcgaggagcccgtggttctgcctgacctggacgaccagacagaccaccggcagtggactcagcagcacctggatgccgctgacctgcgcatgtctgccatggcccccacaccgccccagggtgaggttgacgccgactgcatggacgtcaatgtccgcgggcctgatggcttcaccccgctcatgatcgcctcctgcagcgggggcggcctggagacgggcaacagcgaggaagaggaggacgcgccggccgtcatctccgacttcatctaccagggcgccagcctgcacaaccagacagaccgcacgggcgagaccgccttgcacctggccgcccgctactcacgctctgatgccgccaagcgcctgctggaggccagcgcagatgccaacatccaggacaacatgggccgcaccccgctgcatgcggctgtgtctgccgacgcacaaggtgtcttccagatcctgatccggaaccgagccacagacctggatgcccgcatgcatgatggcacgacgccactgatcctggctgcccgcctggccgtggagggcatgctggaggacctcatcaactcacacgccgacgtcaacgccgtagatgacctgggcaagtccgccctgcactgggccgccgccgtgaacaatgtggatgccgcagttgtgctcctgaagaacggggctaacaaagatatgcagaacaacagggaggagacacccctgtttctggccgcccgggagggcagctacgagaccgccaaggtgctgctggaccactttgccaaccgggacatcacggatcatatggaccgcctgccgcgcgacatcgcacaggagcgcatgcatcacgacatcgtgaggctgctggacgagtacaacctggtgcgcagcccgcagctgcacggagccccgctggggggcacgcccaccctgtcgcccccgctctgctcgcccaacggctacctgggcagcctcaagcccggcgtgcagggcaagaaggtccgcaagcccagcagcaaaggcctggcctgtggaagcaaggaggccaaggacctcaaggcacggaggaagaagtcccaggacggcaagggctgcctgctggacagctccggcatgctctcgcccgtggactccctggagtcaccccatggctacctgtcagacgtggcctcgccgccactgctgccctccccgttccagcagtctccgtccgtgcccctcaaccacctgcctgggatgcccgacacccacctgggcatcgggcacctgaacgtggcggccaagcccgagatggcggcgctgggtgggggcggccggctggcctttgagactggcccacctcgtctctcccacctgcctgtggcctctggcaccagcaccgtcctgggctccagcagcggaggggccctgaatttcactgtgggcgggtccaccagtttgaatggtcaatgcgagtggctgtcccggctgcagagcggcatggtgccgaaccaatacaaccctctgcgggggagtgtggcaccaggccccctgagcacacaggccccctccctgcagcatggcatggtaggcccgctgcacagtagccttgctgccagcgccctgtcccagatgatgagctaccagggcctgcccagcacccggctggccacccagcctcacctggtgcagacccagcaggtgcagccacaaaacttacagatgcagcagcagaacctgcagccagcaaacatccagcagcagcaaagcctgcagccgccaccaccaccaccacagccgcaccttggcgtgagctcagcagccagcggccacctgggccggagcttcctgagtggagagccgagccaggcagacgtgcagccactgggccccagcagcctggcggtgcacactattctgccccaggagagccccgccctgcccacgtcgctgccatcctcgctggtcccacccgtgaccgcagcccagttcctgacgcccccctcgcagcacagctactcctcgcctgtggacaacacccccagccaccagctacaggtgcctgagcaccccttcctcaccccgtcccctgagtcccctgaccagtggtccagctcgtccccgcattccaacgtctccgactggtccgagggcgtctccagccctcccaccagcatgcagtcccagatcgcccgcattccggaggccttcaagtaaacggcgcgccccacgagaccccggcttcctttcccaagccttcgggcgtctgtgtgcgctctgtggatgccagggccgaccagaggagcctttttaaaacacatgtttttatacaaaataagaacgaggattttaattttttttagtatttatttatgtacttttattttacacagaaacactgcctttttatttatatgtactgttttatctggccccaggtagaaacttttatctattctgagaaaacaagcaagttctgagagccagggttttcctacgtaggatgaaaagattcttctgtgtttataaaatataaacaaagattcatgatttataaatgccatttatttattgattccttttttcaaaatccaaaaagaaatgatgttggagaagggaagttgaacgagcatagtccaaaaagctcctggggcgtccaggccgcgccctttccccgacgcccacccaaccccaagccagcccggccgctccaccagcatcacctgcctgttaggagaagctgcatccagaggcaaacggaggcaaagctggctcaccttccgcacgcggattaatttgcatctgaaataggaaacaagtgaaagcatatgggttagatgttgccatgtgttttagatggtttcttgcaagcatgcttgtgaaaatgtgttctcggagtgtgtatgccaagagtgcacccatggtaccaatcatgaatctttgtttcaggttcagtattatgtagttgttcgttggttatacaagttcttggtccctccagaaccaccccggccccctgcccgttcttgaaatgtaggcatcatgcatgtcaaacatgagatgtgtggactgtggcacttgcctgggtcacacacggaggcatcctacccttttctggggaaagacactgcctgggctgaccccggtggcggccccagcacctcagcctgcacagtgtcccccaggttccgaagaagatgctccagcaacacagcctgggccccagctcgcgggacccgaccccccgtgggctcccgtgttttgtaggagacttgccagagccgggcacattgagctgtgcaacgccgtgggctgcgtcctttggtcctgtccccgcagccctggcagggggcatgcggtcgggcaggggctggagggaggcgggggctgcccttgggccacccctcctagtttgggaggagcagatttttgcaataccaagtatagcctatggcagaaaaaatgtctgtaaatatgtttttaaaggtggattttgtttaaaaaatcttaatgaatgagtctgttgtgtgtcatgccagtgagggacgtcagacttggctcagctcggggagccttagccgcccatgcactggggacgctccgctgccgtgccgcctgcactcctcagggcagcctcccccggctctacgggggccgcgtggtgccatccccagggggcatgaccagatgcgtcccaagatgttgatttttactgtgttttataaaatagagtgtagtttacagaaaaagactttaaaagtgatctacatgaggaactgtagatgatgtatttttttcatcttttttgttaactgatttgcaataaaaatgatactgatggtgaaaaaaaaaaaaaaa

SEQ ID NO: 76 - protein, 2555 aa, Homo sapiens
MPPLLAPLLCLALLPALAARGPRCSQPGETCLNGGKCEAANGTEACVCGGAFVGPRCQDPNPCLSTPCKNAGTCHVVDRRGVADYACSCALGFSGPLCLTPLDNACLTNPCRNGGTCDLLTLTEYKCRCPPGWSGKSCQQADPCASNPCANGGQCLPFEASYICHCPPSFHGPTCRQDVNECGQKPGLCRHGGTCHNEVGSYRCVCRATHTGPNCERPYVPCSPSPCQNGGTCRPTGDVTHECACLPGFTGQNCEENIDDCPGNNCKNGGACVDGVNTYNCRCPPEWTGQYCTEDVDECQLMPNACQNGGTCHNTHGGYNCVCVNGWTGEDCSENIDDCASAACFHGATCHDRVASFYCECPHGRTGLLCHLNDACISNPCNEGSNCDTNPVNGKAICTCPSGYTGPACSQDVDECSLGANPCEHAGKCINTLGSFECQCLQGYTGPRCEIDVNECVSNPCQNDATCLDQIGEFQCICMPGYEGVHCEVNTDECASSPCLHNGRCLDKINEFQCECPTGFTGHLCQYDVDECASTPCKNGAKCLDGPNTYTCVCTEGYTGTHCEVDIDECDPDPCHYGSCKDGVATFTCLCRPGYTGHHCETNINECSSQPCRHGGTCQDRDNAYLCFCLKGTTGPNCEINLDDCASSPCDSGTCLDKIDGYECACEPGYTGSMCNINIDECAGNPCHNGGTCEDGINGFTCRCPEGYHDPTCLSEVNECNSNPCVHGACRDSLNGYKCDCDPGWSGTNCDINNNECESNPCVNGGTCKDMTSGYVCTCREGFSGPNCQTNINECASNPCLNQGTCIDDVAGYKCNCLLPYTGATCEVVLAPCAPSPCRNGGECRQSEDYESFSCVCPTGWQGQTCEVDINECVLSPCRHGASCQNTHGGYRCHCQAGYSGRNCETDIDDCRPNPCHNGGSCTDGINTAFCDCLPGFRGTFCEEDINECASDPCRNGANCTDCVDSYTCTCPAGFSGIHCENNTPDCTESSCFNGGTCVDGINSFTCLCPPGFTGSYCQHDVNECDSQPCLHGGTCQDGCGSYRCTCPQGYTGPNCQNLVHWCDSSPCKNGGKCWQTHTQYRCECPSGWTGLYCDVPSVSCEVAAQRQGVDVARLCQHGGLCVDAGNTHHCRCQAGYTGSYCEDLVDECSPSPCQNGATCTDYLGGYSCKCVAGYHGVNCSEEIDECLSHPCQNGGTCLDLPNTYKCSCPRGTQGVHCEINVDDCNPPVDPVSRSPKCFNNGTCVDQVGGYSCTCPPGFVGERCEGDVNECLSNPCDARGTQNCVQRVNDFHCECRAGHTGRRCESVINGCKGKPCKNGGTCAVASNTARGFICKCPAGFEGATCENDARTCGSLRCLNGGTCISGPRSPTCLCLGPFTGPECQFPASSPCLGGNPCYNQGTCEPTSESPFYRCLCPAKFNGLLCHILDYSFGGGAGRDIPPPLIEEACELPECQEDAGNKVCSLQCNNHACGWDGGDCSLNFNDPWKNCTQSLQCWKYFSDGHCDSQCNSAGCLFDGFDCQRAEGQCNPLYDQYCKDHFSDGHCDQGCNSAECEWDGLDCAEHVPERLAAGTLVVVVLMPPEQLRNSSFHFLRELSRVLHTNVVFKRDAHGQQMIFPYYGREEELRKHPIKRAAEGWAAPDALLGQVKASLLPGGSEGGRRRRELDPMDVRGSIVYLEIDNRQCVQASSQCFQSATDVAAFLGALASLGSLNIPYKIEAVQSETVEPPPPAQLHFMYVAAAAFVLLFFVGCGVLLSRKRRRQHGQLWFPEGFKVSEASKKKRREPLGEDSVGLKPLKNASDGALMDDNQNEWGDEDLETKKFRFEEPVVLPDLDDQTDHRQWTQQHLDAADLRMSAMAPTPPQGEVDADCMDVNVRGPDGFTPLMIASCSGGGLETGNSEEEEDAPAVISDFIYQGASLHNQTDRTGETALHLAARYSRSDAAKRLLEASADANIQDNMGRTPLHAAVSADAQGVFQILIRNRATDLDARMHDGTTPLILAARLAVEGMLEDLINSHADVNAVDDLGKSALHWAAAVNNVDAAVVLLKNGANKDMQNNREETPLFLAAREGSYETAKVLLDHFANRDITDHMDRLPRDIAQERMHHDIVRLLDEYNLVRSPQLHGAPLGGTPTLSPPLCSPNGYLGSLKPGVQGKKVRKPSSKGLACGSKEAKDLKARRKKSQDGKGCLLDSSGMLSPVDSLESPHGYLSDVASPPLLPSPFQQSPSVPLNHLPGMPDTHLGIGHLNVAAKPEMAALGGGGRLAFETGPPRLSHLPVASGTSTVLGSSSGGALNFTVGGSTSLNGQCEWLSRLQSGMVPNQYNPLRGSVAPGPLSTQAPSLQHGMVGPLHSSLAASALSQMMSYQGLPSTRLATQPHLVQTQQVQPQNLQMQQQNLQPANIQQQQSLQPPPPPPQPHLGVSSAASGHLGRSFLSGEPSQADVQPLGPSSLAVHTILPQESPALPTSLPSSLVPPVTAAQFLTPPSQHSYSSPVDNTPSHQLQVPEHPFLTPSPESPDQWSSSSPHSNVSDWSEGVSSPPTSMQSQIARIPEAFK

SEQ ID NO: 77 - DNA, 7995 bp, Artificial Sequence
  source: /note="Description of Artificial Sequence: Synthetic polynucleotide"
  CDS (1)..(7992)
atggccaaaccaacaagcaaagattcaggcttgaaggagaagtttaagattctgttgggactgggaacaccgaggccaaatcccaggtctgcagagggtaaacagacggagtttatcatcaccgcggaaatactgagagaactgagcatggaatgtggcctcaacaatcgcatccggatgatagggcagatttgtgaagtcgcaaaaaccaagaaatttgaagagcacgcagtggaagcactctggaaggcggtcgcggatctgttgcagccggagcggccgctggaggcccggcacgcggtgctggctctgctgaaggccatcgtgcaggggcagggcgagcgtttgggggtcctcagagccctcttctttaaggtcatcaaggattacccttccaacgaagaccttcacgaaaggctggaggttttcaaggccctcacagacaatgggagacacatcacctacttggaggaagagctggctgactttgtcctgcagtggatggatgttggcttgtcctcggaattccttctggtgctggtgaacttggtcaaattcaatagctgttacctcgacgagtacatcgcaaggatggttcagatgatctgtctgctgtgcgtccggaccgcgtcctctgtggacatagaggtctccctgcaggtgctggacgccgtggtctgctacaactgcctgccggctgagagcctcccgctgttcatcgttaccctctgtcgcaccatcaacgtcaaggagctctgcgagccttgctggaagctgatgcggaacctccttggcacccacctgggccacagcgccatctacaacatgtgccacctcatggaggacagagcctacatggaggacgcgcccctgctgagaggagccgtgttttttgtgggcatggctctctggggagcccaccggctctattctctcaggaactcgccgacatctgtgttgccatcattttaccaggccatggcatgtccgaacgaggtggtgtcctatgagatcgtcctgtccatcaccaggctcatcaagaagtataggaaggagctccaggtggtggcgtgggacattctgctgaacatcatcgaacggctccttcagcagctccagaccttggacagcccggagctcaggaccatcgtccatgacctgttgaccacggtggaggagctgtgtgaccagaacgagttccacgggtctcaggagagatactttgaactggtggagagatgtgcggaccagaggcctgagtcctccctcctgaacctgatctcctatagagcgcagtccatccacccggccaaggacggctggattcagaacctgcaggcgctgatggagagattcttcaggagcgagtcccgaggcgccgtgcgcatcaaggtgctggacgtgctgtcctttgtgctgctcatcaacaggcagttctatgaggaggagctgattaactcagtggtcatctcgcagctctcccacatccccgaggataaagaccaccaggtccgaaagctggccacccagttgctggtggacctggcagagggctgccacacacaccacttcaacagcctgctggacatcatcgagaaggtgatggcccgctccctctccccacccccggagctggaagaaagggatgtggccgcatactcggcctccttggaggatgtgaagacagccgtcctggggcttctggtcatccttcagaccaagctgtacaccctgcctgcaagccacgccacgcgtgtgtatgagatgctggtcagccacattcagctccactacaagcacagctacaccctgccaatcgcgagcagcatccggctgcaggcctttgacttcctgttgctgctgcgggccgactcactgcaccgcctgggcctgcccaacaaggatggagtcgtgcggttcagcccctactgcgtctgcgactacatggagccagagagaggctctgagaagaagaccagcggccccctttctcctcccacagggcctcctggcccggcgcctgcaggccccgccgtgcggctggggtccgtgccctactccctgctcttccgcgtcctgctgcagtgcttgaagcaggagtctgactggaaggtgctgaagctggttctgggcaggctgcctgagtccctgcgctataaagtgctcatctttacttccccttgcagtgtggaccagctgtgctctgctctctgctccatgctttcaggcccaaagacactggagcggctccgaggcgccccagaaggcttctccagaactgacttgcacctggccgtggttccagtgctgacagcattaatctcttaccataactacctggacaaaaccaaacagcgcgagatggtctactgcctggagcagggcctcatccaccgctgtgccagccagtgcgtcgtggccttgtccatctgcagcgtggagatgcctgacatcatcatcaaggcgctgcctgttctggtggtgaagctcacgcacatctcagccacagccagcatggccgtcccactgctggagttcctgtccactctggccaggctgccgcacctctacaggaactttgccgcggagcagtatgccagtgtgttcgccatctccctgccgtacaccaacccctccaagtttaatcagtacatcgtgtgtctggcccatcacgtcatagccatgtggttcatcaggtgccgcctgcccttccggaaggattttgtccctttcatcactaagggcctgcggtccaatgtcctcttgtcttttgatgacacccccgagaaggacagcttcagggcccggagtactagtctcaacgagagacccaagaggatacagacgtccctcaccagtgccagcttggggtctgcagatgagaactccgtggcccaggctgacgatagcctgaaaaacctccacctggagctcacggaaacctgtctggacatgatggctcgatacgtcttctccaacttcacggctgtcccgaagaggtctcctgtgggcgagttcctcctagcgggtggcaggaccaaaacctggctggttgggaacaagcttgtcactgtgacgacaagcgtgggaaccgggacccggtcgttactaggcctggactcgggggagctgcagtccggcccggagtcgagctccagccccggggtgcatgtgagacagaccaaggaggcgccggccaagctggagtcccaggctgggcagcaggtgtcccgtggggcccgggatcgggtccgttccatgtcggggggccatggtcttcgagttggcgccctggacgtgccggcctcccagttcctgggcagtgccacttctccaggaccacggactgcaccagccgcgaaacctgagaaggcctcagctggcacccgggttcctgtgcaggagaagacgaacctggcggcctatgtgcccctgctgacccagggctgggcggagatcctggtccggaggcccacagggaacaccagctggctgatgagcctggagaacccgctcagccctttctcctcggacatcaacaacatgcccctgcaggagctgtctaacgccctcatggcggctgagcgcttcaaggagcaccgggacacagccctgtacaagtcactgtcggtgccggcagccagcacggccaaaccccctcctctgcctcgctccaacacagactccgccgtggtcatggaggagggaagtccgggcgaggttcctgtgctggtggagcccccagggttggaggacgttgaggcagcgctaggcatggacaggcgcacggatgcctacagcaggtcgtcctcagtctccagccaggaggagaagtcgctccacgcggaggagctggttggcaggggcatccccatcgagcgagtcgtctcctcggagggtggccggccctctgtggacctctccttccagccctcgcagcccctgagcaagtccagctcctctcccgagctgcagactctgcaggacatcctcggggaccctggggacaaggccgacgtgggccggctgagccctgaggttaaggcccggtcacagtcagggaccctggacggggaaagtgctgcctggtcggcctcgggcgaagacagtcggggccagcccgagggtcccttgccttccagctccccccgctcgcccagtggcctccggccccgaggttacaccatctccgactcggccccatcacgcaggggcaagagagtagagagggacgccttaaagagcagagccacagcctccaatgcagagaaagtgccaggcatcaaccccagtttcgtgttcctgcagctctaccattcccccttctttggcgacgagtcaaacaagccaatcctgctgcccaatgagtcacagtcctttgagcggtcggtgcagctcctcgaccagatcccatcatacgacacccacaagatcgccgtcctgtatgttggagaaggccagagcaacagcgagctcgccatcctgtccaatgagcatggctcctacaggtacacggagttcctgacgggcctgggccggctcatcgagctgaaggactgccagccggacaaggtgtacctgggaggcctggacgtgtgtggtgaggacggccagttcacctactgctggcacgatgacatcatgcaagggctgcagaccacaagactgggaaaccacttggaagaccgagtgaacaaatttttgcggcgccagaatcaccctgaagccggggaggtttttgtccgagtggtggccagctcagacaagacggtggaggtcaagcccgggatgaagtcacggtttgtggattctggggaaatgtctgaatctttcccatatcgaaccaaagctctgtttgcttttgaggaaattgacggcgtggatgtctgcttttttggaatgcacgtccaagaatacggctctgattgcccccctccaaacacgaggcgtgtgtacatttcttatctggatagtattcatttcttccggccacgttgcctccgcacagccgtttaccatgagatccttattggatatttagagtatgtgaagaaattagggtatgtgacagggcacatctgggcctgtcctccaagtgaaggagatgattacatcttccattgccacccacctgatcaaaaaatacccaagccaaaacgactgcaggagtggtacaaaaagatgctggacaaggcgtttgcagagcggatcatccatgactacaaggatattttcaaacaagcaactgaagacaggctcaccagtgccaaggaactgccctattttgaaggtgatttctggcccaatgtgttagaagagagcattaaggaactagaacaagaagaagaggagaggaaaaaggaagagagcactgcagccagtgaaaccactgagggcagtcagggcgacagcaagaatgccaagaagaagaacaacaagaaaaccaacaagaacaaaagcagcatcagccgcgccaacaagaagaagcccagcatgcccaacgtgtccaatgacctgtcccagaagctgtatgccaccatggagaagcacaaggaggtcttcttcgtgatccacctgcacgctgggcctgtcatcaacaccctgccccccatcgtcgaccccgaccccctgctcagctgtgacctcatggatgggcgcgacgccttcctcaccctcgccagagacaagcactgggagttctcctccttgcgccgctccaagtggtccacgctctgcatgctggtggagctgcacacccagggccaggaccgctttgtctacacctgcaacgagtgcaagcaccacgtggagacgcgctggcactgcactgtgtgcgaggactacgacctctgcatcaactgctataacacgaagagccatgcccataagatggtgaagtgggggctgggcctggatgacgagggcagcagccagggcgagccacagtcaaagagcccccaggagtcacgccggctgagcatccagcgctgcatccagtcgctggtgcacgcgtgccagtgccgcaacgccaactgctcgctgccatcctgccagaagatgaagcgggtggtgcagcacaccaagggctgcaaacgcaagaccaacgggggctgcccggtgtgcaagcagctcatcgccctctgctgctaccacgccaagcactgccaagaaaacaaatgccccgtgcccttctgcctcaacatcaaacacaagctccgccagcagcagatccagcaccgcctgcagcaggcccagctcatgcgccggcggatggccaccatgaacacccgcaacgtgcctcagcagagtctgccttctcctacctcagcaccgcccgggacccccacacagcagcccagcacaccccagacgccgcagccccctgcccagccccaaccctcacccgtgagcatgtcaccagctggcttccccagcgtggcccggactcagccccccaccacggtgtccacagggaagcctaccagccaggtgccggcccccccacccccggcccagccccctcctgcagcggtggaagcggctcggcagatcgagcgtgaggcccagcagcagcagcacctgtaccgggtgaacatcaacaacagcatgcccccaggacgcacgggcatggggaccccggggagccagatggcccccgtgagcctgaatgtgccccgacccaaccaggtgagcgggcccgtcatgcccagcatgcctcccgggcagtggcagcaggcgccccttccccagcagcagcccatgccaggcttgcccaggcctgtgatatccatgcaggcccaggcggccgtggctgggccccggatgcccagcgtgcagccacccaggagcatctcacccagcgctctgcaagacctgctgcggaccctgaagtcgcccagctcccctcagcagcaacagcaggtgctgaacattctcaaatcaaacccgcagctaatggcagctttcatcaaacagcgcacagccaagtacgtggccaatcagcccggcatgcagccccagcctggcctccagtcccagcccggcatgcaaccccagcctggcatgcaccagcagcccagcctgcagaacctgaatgccatgcaggctggcgtgccgcggcccggtgtgcctccacagcagcaggcgatgggaggcctgaacccccagggccaggccttgaacatcatgaacccaggacacaaccccaacatggcgagtatgaatccacagtaccgagaaatgttacggaggcagctgctgcagcagcagcagcaacagcagcagcaacaacagcagcaacagcagcagcagcaagggagtgccggcatggctgggggcatggcggggcacggccagttccagcagcctcaaggacccggaggctacccaccggccatgcagcagcagcagcgcatgcagcagcatctccccctccagggcagctccatgggccagatggcggctcagatgggacagcttggccagatggggcagccggggctgggggcagacagcacccccaacatccagcaagccctgcagcagcggattctgcagcaacagcagatgaagcagcagattgggtccccaggccagccgaaccccatgagcccccagcaacacatgctctcaggacagccacaggcctcgcatctccctggccagcagatcgccacgtcccttagtaaccaggtgcggtctccagcccctgtccagtctccacggccccagtcccagcctccacattccagcccgtcaccacggatacagccccagccttcgccacaccacgtctcaccccagactggttccccccaccccggactcgcagtcaccatggccagctccatagatcagggacacttggggaaccccgaacagagtgcaatgctcccccagctgaacacccccagcaggagtgcgctgtccagcgaactgtccctggtcggggacaccacgggggacacgctagagaagtttgtggagggcttgtag

SEQ ID NO: 78 - protein, 2664 aa, Artificial Sequence
  source: /note="Description of Artificial Sequence: Synthetic polypeptide"
MAKPTSKDSGLKEKFKILLGLGTPRPNPRSAEGKQTEFIITAEILRELSMECGLNNRIRMIGQICEVAKTKKFEEHAVEALWKAVADLLQPERPLEARHAVLALLKAIVQGQGERLGVLRALFFKVIKDYPSNEDLHERLEVFKALTDNGRHITYLEEELADFVLQWMDVGLSSEFLLVLVNLVKFNSCYLDEYIARMVQMICLLCVRTASSVDIEVSLQVLDAVVCYNCLPAESLPLFIVTLCRTINVKELCEPCWKLMRNLLGTHLGHSAIYNMCHLMEDRAYMEDAPLLRGAVFFVGMALWGAHRLYSLRNSPTSVLPSFYQAMACPNEVVSYEIVLSITRLIKKYRKELQVVAWDILLNIIERLLQQLQTLDSPELRTIVHDLLTTVEELCDQNEFHGSQERYFELVERCADQRPESSLLNLISYRAQSIHPAKDGWIQNLQALMERFFRSESRGAVRIKVLDVLSFVLLINRQFYEEELINSVVISQLSHIPEDKDHQVRKLATQLLVDLAEGCHTHHFNSLLDIIEKVMARSLSPPPELEERDVAAYSASLEDVKTAVLGLLVILQTKLYTLPASHATRVYEMLVSHIQLHYKHSYTLPIASSIRLQAFDFLLLLRADSLHRLGLPNKDGVVRFSPYCVCDYMEPERGSEKKTSGPLSPPTGPPGPAPAGPAVRLGSVPYSLLFRVLLQCLKQESDWKVLKLVLGRLPESLRYKVLIFTSPCSVDQLCSALCSMLSGPKTLERLRGAPEGFSRTDLHLAVVPVLTALISYHNYLDKTKQREMVYCLEQGLIHRCASQCVVALSICSVEMPDIIIKALPVLVVKLTHISATASMAVPLLEFLSTLARLPHLYRNFAAEQYASVFAISLPYTNPSKFNQYIVCLAHHVIAMWFIRCRLPFRKDFVPFITKGLRSNVLLSFDDTPEKDSFRARSTSLNERPKRIQTSLTSASLGSADENSVAQADDSLKNLHLELTETCLDMMARYVFSNFTAVPKRSPVGEFLLAGGRTKTWLVGNKLVTVTTSVGTGTRSLLGLDSGELQSGPESSSSPGVHVRQTKEAPAKLESQAGQQVSRGARDRVRSMSGGHGLRVGALDVPASQFLGSATSPGPRTAPAAKPEKASAGTRVPVQEKTNLAAYVPLLTQGWAEILVRRPTGNTSWLMSLENPLSPFSSDINNMPLQELSNALMAAERFKEHRDTALYKSLSVPAASTAKPPPLPRSNTDSAVVMEEGSPGEVPVLVEPPGLEDVEAALGMDRRTDAYSRSSSVSSQEEKSLHAEELVGRGIPIERVVSSEGGRPSVDLSFQPSQPLSKSSSSPELQTLQDILGDPGDKADVGRLSPEVKARSQSGTLDGESAAWSASGEDSRGQPEGPLPSSSPRSPSGLRPRGYTISDSAPSRRGKRVERDALKSRATASNAEKVPGINPSFVFLQLYHSPFFGDESNKPILLPNESQSFERSVQLLDQIPSYDTHKIAVLYVGEGQSNSELAILSNEHGSYRYTEFLTGLGRLIELKDCQPDKVYLGGLDVCGEDGQFTYCWHDDIMQGLQTTRLGNHLEDRVNKFLRRQNHPEAGEVFVRVVASSDKTVEVKPGMKSRFVDSGEMSESFPYRTKALFAFEEIDGVDVCFFGMHVQEYGSDCPPPNTRRVYISYLDSIHFFRPRCLRTAVYHEILIGYLEYVKKLGYVTGHIWACPPSEGDDYIFHCHPPDQKIPKPKRLQEWYKKMLDKAFAERIIHDYKDIFKQATEDRLTSAKELPYFEGDFWPNVLEESIKELEQEEEERKKEESTAASETTEGSQGDSKNAKKKNNKKTNKNKSSISRANKKKPSMPNVSNDLSQKLYATMEKHKEVFFVIHLHAGPVINTLPPIVDPDPLLSCDLMDGRDAFLTLARDKHWEFSSLRRSKWSTLCMLVELHTQGQDRFVYTCNECKHHVETRWHCTVCEDYDLCINCYNTKSHAHKMVKWGLGLDDEGSSQGEPQSKSPQESRRLSIQRCIQSLVHACQCRNANCSLPSCQKMKRVVQHTKGCKRKTNGGCPVCKQLIALCCYHAKHCQENKCPVPFCLNIKHKLRQQQIQHRLQQAQLMRRRMATMNTRNVPQQSLPSPTSAPPGTPTQQPSTPQTPQPPAQPQPSPVSMSPAGFPSVARTQPPTTVSTGKPTSQVPAPPPPAQPPPAAVEAARQIEREAQQQQHLYRVNINNSMPPGRTGMGTPGSQMAPVSLNVPRPNQVSGPVMPSMPPGQWQQAPLPQQQPMPGLPRPVISMQAQAAVAGPRMPSVQPPRSISPSALQDLLRTLKSPSSPQQQQQVLNILKSNPQLMAAFIKQRTAKYVANQPGMQPQPGLQSQPGMQPQPGMHQQPSLQNLNAMQAGVPRPGVPPQQQAMGGLNPQGQALNIMNPGHNPNMASMNPQYREMLRRQLLQQQQQQQQQQQQQQQQQQGSAGMAGGMAGHGQFQQPQGPGGYPPAMQQQQRMQQHLPLQGSSMGQMAAQMGQLGQMGQPGLGADSTPNIQQALQQRILQQQQMKQQIGSPGQPNPMSPQQHMLSGQPQASHLPGQQIATSLSNQVRSPAPVQSPRPQSQPPHSSPSPRIQPQPSPHHVSPQTGSPHPGLAVTMASSIDQGHLGNPEQSAMLPQLNTPSRSALSSELSLVGDTTGDTLEKFVEGL

SEQ ID NO: 79 - DNA, 5474 bp, Homo sapiens
ccggcggcgtcccggggccaggggggtgcgcctttctccgcgtcggggcggcccggagcgcggtggcgcggcgcgggaggggttttctggtgcgtcctggtccaccatggccaaaccaacaagcaaagattcaggcttgaaggagaagtttaagattctgttgggactgggaacaccgaggccaaatcccaggtctgcagagggtaaacagacggagtttatcatcaccgcggaaatactgagagaactgagcatggaatgtggcctcaacaatcgcatccggatgatagggcagatttgtgaagtcgcaaaaaccaagaaatttgaagagcacgcagtggaagcactctggaaggcggtcgcggatctgttgcagccggagcggccgctggaggcccggcacgcggtgctggctctgctgaaggccatcgtgcaggggcagggcgagcgtttgggggtcctcagagccctcttctttaaggtcatcaaggattacccttccaacgaagaccttcacgaaaggctggaggttttcaaggccctcacagacaatgggagacacatcacctacttggaggaagagctggctgactttgtcctgcagtggatggatgttggcttgtcctcggaattccttctggtgctggtgaacttggtcaaattcaatagctgttacctcgacgagtacatcgcaaggatggttcagatgatctgtctgctgtgcgtccggaccgcgtcctctgtggacatagaggtctccctgcaggtgctggacgccgtggtctgctacaactgcctgccggctgagagcctcccgctgttcatcgttaccctctgtcgcaccatcaacgtcaaggagctctgcgagccttgctggaagctgatgcggaacctccttggcacccacctgggccacagcgccatctacaacatgtgccacctcatggaggacagagcctacatggaggacgcgcccctgctgagaggagccgtgttttttgtgggcatggctctctggggagcccaccggctctattctctcaggaactcgccgacatctgtgttgccatcattttaccaggccatggcatgtccgaacgaggtggtgtcctatgagatcgtcctgtccatcaccaggctcatcaagaagtataggaaggagctccaggtggtggcgtgggacattctgctgaacatcatcgaacggctccttcagcagctccagaccttggacagcccggagctcaggaccatcgtccatgacctgttgaccacggtggaggagctgtgtgaccagaacgagttccacgggtctcaggagagatactttgaactggtggagagatgtgcggaccagaggcctgagtcctccctcctgaacctgatctcctatagagcgcagtccatccacccggccaaggacggctggattcagaacctgcaggcgctgatggagagattcttcaggagcgagtcccgaggcgccgtgcgcatcaaggtgctggacgtgctgtcctttgtgctgctcatcaacaggcagttctatgaggaggagctgattaactcagtggtcatctcgcagctctcccacatccccgaggataaagaccaccaggtccgaaagctggccacccagttgctggtggacctggcagagggctgccacacacaccacttcaacagcctgctggacatcatcgagaaggtgatggcccgctccctctccccacccccggagctggaagaaagggatgtggccgcatactcggcctccttggaggatgtgaagacagccgtcctggggcttctggtcatccttcagaccaagctgtacaccctgcctgcaagccacgccacgcgtgtgtatgagatgctggtcagccacattcagctccactacaagcacagctacaccctgccaatcgcgagcagcatccggctgcaggcctttgacttcctgttgctgctgcgggccgactcactgcaccgcctgggcctgcccaacaaggatggagtcgtgcggttcagcccctactgcgtctgcgactacatggagccagagagaggctctgagaagaagaccagcggccccctttctcctcccacagggcctcctggcccggcgcctgcaggccccgccgtgcggctggggtccgtgccctactccctgctcttccgcgtcctgctgcagtgcttgaagcaggagtctgactggaaggtgctgaagctggttctgggcaggctgcctgagtccctgcgctataaagtgctcatctttacttccccttgcagtgtggaccagctgtgctctgctctctgctccatgctttcaggcccaaagacactggagcggctccgaggcgccccagaaggcttctccagaactgacttgcacctggccgtggttccagtgctgacagcattaatctcttaccataactacctggacaaaaccaaacagcgcgagatggtctactgcctggagcagggcctcatccaccgctgtgccagccagtgcgtcgtggccttgtccatctgcagcgtggagatgcctgacatcatcatcaaggcgctgcctgttctggtggtgaagctcacgcacatctcagccacagccagcatggccgtcccactgctggagttcctgtccactctggccaggctgccgcacctctacaggaactttgccgcggagcagtatgccagtgtgttcgccatctccctgccgtacaccaacccctccaagtttaatcagtacatcgtgtgtctggcccatcacgtcatagccatgtggttcatcaggtgccgcctgcccttccggaaggattttgtccctttcatcactaagggcctgcggtccaatgtcctcttgtcttttgatgacacccccgagaaggacagcttcagggcccggagtactagtctcaacgagagacccaagaggatacagacgtccctcaccagtgccagcttggggtctgcagatgagaactccgtggcccaggctgacgatagcctgaaaaacctccacctggagctcacggaaacctgtctggacatgatggctcgatacgtcttctccaacttcacggctgtcccgaagaggtctcctgtgggcgagttcctcctagcgggtggcaggaccaaaacctggctggttgggaacaagcttgtcactgtgacgacaagcgtgggaaccgggacccggtcgttactaggcctggactcgggggagctgcagtccggcccggagtcgagctccagccccggggtgcatgtgagacagaccaaggaggcgccggccaagctggagtcccaggctgggcagcaggtgtcccgtggggcccgggatcgggtccgttccatgtcggggggccatggtcttcgagttggcgccctggacgtgccggcctcccagttcctgggcagtgccacttctccaggaccacggactgcaccagccgcgaaacctgagaaggcctcagctggcacccgggttcctgtgcaggagaagacgaacctggcggcctatgtgcccctgctgacccagggctgggcggagatcctggtccggaggcccacagggaacaccagctggctgatgagcctggagaacccgctcagccctttctcctcggacatcaacaacatgcccctgcaggagctgtctaacgccctcatggcggctgagcgcttcaaggagcaccgggacacagccctgtacaagtcactgtcggtgccggcagccagcacggccaaaccccctcctctgcctcgctccaacacagactccgccgtggtcatggaggagggaagtccgggcgaggttcctgtgctggtggagcccccagggttggaggacgttgaggcagcgctaggcatggacaggcgcacggatgcctacagcaggtcgtcctcagtctccagccaggaggagaagtcgctccacgcggaggagctggttggcaggggcatccccatcgagcgagtcgtctcctcggagggtggccggccctctgtggacctctccttccagccctcgcagcccctgagcaagtccagctcctctcccgagctgcagactctgcaggacatcctcggggaccctggggacaaggccgacgtgggccggctgagccctgaggttaaggcccggtcacagtcagggaccctggacggggaaagtgctgcctggtcggcctcgggcgaagacagtcggggccagcccgagggtcccttgccttccagctccccccgctcgcccagtggcctccggccccgaggttacaccatctccgactcggccccatcacgcaggggcaagagagtagagagggacgccttaaagagcagagccacagcctccaatgcagagaaagtgccaggcatcaaccccagtttcgtgttcctgcagctctaccattcccccttctttggcgacgagtcaaacaagccaatcctgctgcccaatgagtcacagtcctttgagcggtcggtgcagctcctcgaccagatcccatcatacgacacccacaagatcgccgtcctgtatgttggagaaggccagagcaacagcgagctcgccatcctgtccaatgagcatggctcctacaggtacacggagttcctgacgggcctgggccggctcatcgagctgaaggactgccagccggacaaggtgtacctgggaggcctggacgtgtgtggtgaggacggccagttcacctactgctggcacgatgacatcatgcaagccgtcttccacatcgccaccctgatgcccaccaaggacgtggacaagcaccgctgcgacaagaagcgccacctgggcaacgactttgtgtccattgtctacaatgactccggtgaggacttcaagcttggcaccatcaagggccagttcaactttgtccacgtgatcgtcaccccgctggactacgagtgcaacctggtgtccctgcagtgcaggaaagacatggagggccttgtggacaccagcgtggccaagatcgtgtctgaccgcaacctgcccttcgtggcccgccagatggccctgcacgcaaatatggcctcacaggtgcatcatagccgctccaaccccaccgatatctacccctccaagtggattgcccggctccgccacatcaagcggctccgccagcggatctgcgaggaagccgcctactccaaccccagcctacctctggtgcaccctccgtcccatagcaaagcccctgcacagactccagccgagcccacacctggctatgaggtgggccagcggaagcgcctcatctcctcggtggaggacttcaccgagtttgtgtgaggccggggccctccctcctgcactggccttggacggtattgcctgtcagtgaaataaataaagtcctgaccccagtgcacagacatagaggcacagattgcaaaaaaaaaaaaaaaaaaaaaaaaaaaaaaaaaaaaaaaaaaaa

SEQ ID NO: 80 - protein, 1740 aa, Homo sapiens
MAKPTSKDSGLKEKFKILLGLGTPRPNPRSAEGKQTEFIITAEILRELSMECGLNNRIRMIGQICEVAKTKKFEEHAVEALWKAVADLLQPERPLEARHAVLALLKAIVQGQGERLGVLRALFFKVIKDYPSNEDLHERLEVFKALTDNGRHITYLEEELADFVLQWMDVGLSSEFLLVLVNLVKFNSCYLDEYIARMVQMICLLCVRTASSVDIEVSLQVLDAVVCYNCLPAESLPLFIVTLCRTINVKELCEPCWKLMRNLLGTHLGHSAIYNMCHLMEDRAYMEDAPLLRGAVFFVGMALWGAHRLYSLRNSPTSVLPSFYQAMACPNEVVSYEIVLSITRLIKKYRKELQVVAWDILLNIIERLLQQLQTLDSPELRTIVHDLLTTVEELCDQNEFHGSQERYFELVERCADQRPESSLLNLISYRAQSIHPAKDGWIQNLQALMERFFRSESRGAVRIKVLDVLSFVLLINRQFYEEELINSVVISQLSHIPEDKDHQVRKLATQLLVDLAEGCHTHHFNSLLDIIEKVMARSLSPPPELEERDVAAYSASLEDVKTAVLGLLVILQTKLYTLPASHATRVYEMLVSHIQLHYKHSYTLPIASSIRLQAFDFLLLLRADSLHRLGLPNKDGVVRFSPYCVCDYMEPERGSEKKTSGPLSPPTGPPGPAPAGPAVRLGSVPYSLLFRVLLQCLKQESDWKVLKLVLGRLPESLRYKVLIFTSPCSVDQLCSALCSMLSGPKTLERLRGAPEGFSRTDLHLAVVPVLTALISYHNYLDKTKQREMVYCLEQGLIHRCASQCVVALSICSVEMPDIIIKALPVLVVKLTHISATASMAVPLLEFLSTLARLPHLYRNFAAEQYASVFAISLPYTNPSKFNQYIVCLAHHVIAMWFIRCRLPFRKDFVPFITKGLRSNVLLSFDDTPEKDSFRARSTSLNERPKRIQTSLTSASLGSADENSVAQADDSLKNLHLELTETCLDMMARYVFSNFTAVPKRSPVGEFLLAGGRTKTWLVGNKLVTVTTSVGTGTRSLLGLDSGELQSGPESSSSPGVHVRQTKEAPAKLESQAGQQVSRGARDRVRSMSGGHGLRVGALDVPASQFLGSATSPGPRTAPAAKPEKASAGTRVPVQEKTNLAAYVPLLTQGWAEILVRRPTGNTSWLMSLENPLSPFSSDINNMPLQELSNALMAAERFKEHRDTALYKSLSVPAASTAKPPPLPRSNTDSAVVMEEGSPGEVPVLVEPPGLEDVEAALGMDRRTDAYSRSSSVSSQEEKSLHAEELVGRGIPIERVVSSEGGRPSVDLSFQPSQPLSKSSSSPELQTLQDILGDPGDKADVGRLSPEVKARSQSGTLDGESAAWSASGEDSRGQPEGPLPSSSPRSPSGLRPRGYTISDSAPSRRGKRVERDALKSRATASNAEKVPGINPSFVFLQLYHSPFFGDESNKPILLPNESQSFERSVQLLDQIPSYDTHKIAVLYVGEGQSNSELAILSNEHGSYRYTEFLTGLGRLIELKDCQPDKVYLGGLDVCGEDGQFTYCWHDDIMQAVFHIATLMPTKDVDKHRCDKKRHLGNDFVSIVYNDSGEDFKLGTIKGQFNFVHVIVTPLDYECNLVSLQCRKDMEGLVDTSVAKIVSDRNLPFVARQMALHANMASQVHHSRSNPTDIYPSKWIARLRHIKRLRQRICEEAAYSNPSLPLVHPPSHSKAPAQTPAEPTPGYEVGQRKRLISSVEDFTEFV

SEQ ID NO: 81 - DNA, 10197 bp, Homo sapiens
ctgcggggcgctgttgctgtggctgagatttggccgccgcctcccccacccggcctgcgccctccctctccctcggcgcccgcccgcccgctcgcggcccgcgctcgctcctctccctcgcagccggcagggcccccgacccccgtccgggccctcgccggcccggccgcccgtgcccggggctgttttcgcgagcaggtgaaaatggctgagaacttgctggacggaccgcccaaccccaaaagagccaaactcagctcgcccggtttctcggcgaatgacagcacagattttggatcattgtttgacttggaaaatgatcttcctgatgagctgatacccaatggaggagaattaggccttttaaacagtgggaaccttgttccagatgctgcttccaaacataaacaactgtcggagcttctacgaggaggcagcggctctagtatcaacccaggaataggaaatgtgagcgccagcagccccgtgcagcagggcctgggtggccaggctcaagggcagccgaacagtgctaacatggccagcctcagtgccatgggcaagagccctctgagccagggagattcttcagcccccagcctgcctaaacaggcagccagcacctctgggcccacccccgctgcctcccaagcactgaatccgcaagcacaaaagcaagtggggctggcgactagcagccctgccacgtcacagactggacctggtatctgcatgaatgctaactttaaccagacccacccaggcctcctcaatagtaactctggccatagcttaattaatcaggcttcacaagggcaggcgcaagtcatgaatggatctcttggggctgctggcagaggaaggggagctggaatgccgtaccctactccagccatgcagggcgcctcgagcagcgtgctggctgagaccctaacgcaggtttccccgcaaatgactggtcacgcgggactgaacaccgcacaggcaggaggcatggccaagatgggaataactgggaacacaagtccatttggacagccctttagtcaagctggagggcagccaatgggagccactggagtgaacccccagttagccagcaaacagagcatggtcaacagtttgcccaccttccctacagatatcaagaatacttcagtcaccaacgtgccaaatatgtctcagatgcaaacatcagtgggaattgtacccacacaagcaattgcaacaggccccactgcagatcctgaaaaacgcaaactgatacagcagcagctggttctactgcttcatgctcataagtgtcagagacgagagcaagcaaacggagaggttcgggcctgctcgctcccgcattgtcgaaccatgaaaaacgttttgaatcacatgacgcattgtcaggctgggaaagcctgccaagttgcccattgtgcatcttcacgacaaatcatctctcattggaagaactgcacacgacatgactgtcctgtttgcctccctttgaaaaatgccagtgacaagcgaaaccaacaaaccatcctggggtctccagctagtggaattcaaaacacaattggttctgttggcacagggcaacagaatgccacttctttaagtaacccaaatcccatagaccccagctccatgcagcgagcctatgctgctctcggactcccctacatgaaccagccccagacgcagctgcagcctcaggttcctggccagcaaccagcacagcctcaaacccaccagcagatgaggactctcaaccccctgggaaataatccaatgaacattccagcaggaggaataacaacagatcagcagcccccaaacttgatttcagaatcagctcttccgacttccctgggggccacaaacccactgatgaacgatggctccaactctggtaacattggaaccctcagcactataccaacagcagctcctccttctagcaccggtgtaaggaaaggctggcacgaacatgtcactcaggacctgcggagccatctagtgcataaactcgtccaagccatcttcccaacacctgatcccgcagctctaaaggatcgccgcatggaaaacctggtagcctatgctaagaaagtggaaggggacatgtacgagtctgccaacagcagggatgaatattatcacttattagcagagaaaatctacaagatacaaaaagaactagaagaaaaacggaggtcgcgtttacataaacaaggcatcttggggaaccagccagccttaccagccccgggggctcagccccctgtgattccacaggcacaacctgtgagacctccaaatggacccctgtccctgccagtgaatcgcatgcaagtttctcaagggatgaattcatttaaccccatgtccttggggaacgtccagttgccacaagcacccatgggacctcgtgcagcctccccaatgaaccactctgtccagatgaacagcatgggctcagtgccagggatggccatttctccttcccgaatgcctcagcctccgaacatgatgggtgcacacaccaacaacatgatggcccaggcgcccgctcagagccagtttctgccacagaaccagttcccgtcatccagcggggcgatgagtgtgggcatggggcagccgccagcccaaacaggcgtgtcacagggacaggtgcctggtgctgctcttcctaaccctctcaacatgctggggcctcaggccagccagctaccttgccctccagtgacacagtcaccactgcacccaacaccgcctcctgcttccacggctgctggcatgccatctctccagcacacgacaccacctgggatgactcctccccagccagcagctcccactcagccatcaactcctgtgtcgtcttccgggcagactcccaccccgactcctggctcagtgcccagtgctacccaaacccagagcacccctacagtccaggcagcagcccaggcccaggtgaccccgcagcctcaaaccccagttcagcccccgtctgtggctacccctcagtcatcgcagcaacagccgacgcctgtgcacgcccagcctcctggcacaccgctttcccaggcagcagccagcattgataacagagtccctaccccctcctcggtggccagcgcagaaaccaattcccagcagccaggacctgacgtacctgtgctggaaatgaagacggagacccaagcagaggacactgagcccgatcctggtgaatccaaaggggagcccaggtctgagatgatggaggaggatttgcaaggagcttcccaagttaaagaagaaacagacatagcagagcagaaatcagaaccaatggaagtggatgaaaagaaacctgaagtgaaagtagaagttaaagaggaagaagagagtagcagtaacggcacagcctctcagtcaacatctccttcgcagccgcgcaaaaaaatctttaaaccagaggagttacgccaggccctcatgccaaccctagaagcactgtatcgacaggacccagagtcattacctttccggcagcctgtagatccccagctcctcggaattccagactattttgacatcgtaaagaatcccatggacctctccaccatcaagcggaagctggacacagggcaataccaagagccctggcagtacgtggacgacgtctggctcatgttcaacaatgcctggctctataatcgcaagacatcccgagtctataagttttgcagtaagcttgcagaggtctttgagcaggaaattgaccctgtcatgcagtcccttggatattgctgtggacgcaagtatgagttttccccacagactttgtgctgctatgggaagcagctgtgtaccattcctcgcgatgctgcctactacagctatcagaataggtatcatttctgtgagaagtgtttcacagagatccagggcgagaatgtgaccctgggtgacgacccttcacagccccagacgacaatttcaaaggatcagtttgaaaagaagaaaaatgataccttagaccccgaacctttcgttgattgcaaggagtgtggccggaagatgcatcagatttgcgttctgcactatgacatcatttggccttcaggttttgtgtgcgacaactgcttgaagaaaactggcagacctcgaaaagaaaacaaattcagtgctaagaggctgcagaccacaagactgggaaaccacttggaagaccgagtgaacaaatttttgcggcgccagaatcaccctgaagccggggaggtttttgtccgagtggtggccagctcagacaagacggtggaggtcaagcccgggatgaagtcacggtttgtggattctggggaaatgtctgaatctttcccatatcgaaccaaagctctgtttgcttttgaggaaattgacggcgtggatgtctgcttttttggaatgcacgtccaagaatacggctctgattgcccccctccaaacacgaggcgtgtgtacatttcttatctggatagtattcatttcttccggccacgttgcctccgcacagccgtttaccatgagatccttattggatatttagagtatgtgaagaaattagggtatgtgacagggcacatctgggcctgtcctccaagtgaaggagatgattacatcttccattgccacccacctgatcaaaaaatacccaagccaaaacgactgcaggagtggtacaaaaagatgctggacaaggcgtttgcagagcggatcatccatgactacaaggatattttcaaacaagcaactgaagacaggctcaccagtgccaaggaactgccctattttgaaggtgatttctggcccaatgtgttagaagagagcattaaggaactagaacaagaagaagaggagaggaaaaaggaagagagcactgcagccagtgaaaccactgagggcagtcagggcgacagcaagaatgccaagaagaagaacaacaagaaaaccaacaagaacaaaagcagcatcagccgcgccaacaagaagaagcccagcatgcccaacgtgtccaatgacctgtcccagaagctgtatgccaccatggagaagcacaaggaggtcttcttcgtgatccacctgcacgctgggcctgtcatcaacaccctgccccccatcgtcgaccccgaccccctgctcagctgtgacctcatggatgggcgcgacgccttcctcaccctcgccagagacaagcactgggagttctcctccttgcgccgctccaagtggtccacgctctgcatgctggtggagctgcacacccagggccaggaccgctttgtctacacctgcaacgagtgcaagcaccacgtggagacgcgctggcactgcactgtgtgcgaggactacgacctctgcatcaactgctataacacgaagagccatgcccataagatggtgaagtgggggctgggcctggatgacgagggcagcagccagggcgagccacagtcaaagagcccccaggagtcacgccggctgagcatccagcgctgcatccagtcgctggtgcacgcgtgccagtgccgcaacgccaactgctcgctgccatcctgccagaagatgaagcgggtggtgcagcacaccaagggctgcaaacgcaagaccaacgggggctgcccggtgtgcaagcagctcatcgccctctgctgctaccacgccaagcactgccaagaaaacaaatgccccgtgcccttctgcctcaacatcaaacacaagctccgccagcagcagatccagcaccgcctgcagcaggcccagctcatgcgccggcggatggccaccatgaacacccgcaacgtgcctcagcagagtctgccttctcctacctcagcaccgcccgggacccccacacagcagcccagcacaccccagacgccgcagccccctgcccagccccaaccctcacccgtgagcatgtcaccagctggcttccccagcgtggcccggactcagccccccaccacggtgtccacagggaagcctaccagccaggtgccggcccccccacccccggcccagccccctcctgcagcggtggaagcggctcggcagatcgagcgtgaggcccagcagcagcagcacctgtaccgggtgaacatcaacaacagcatgcccccaggacgcacgggcatggggaccccggggagccagatggcccccgtgagcctgaatgtgccccgacccaaccaggtgagcgggcccgtcatgcccagcatgcctcccgggcagtggcagcaggcgccccttccccagcagcagcccatgccaggcttgcccaggcctgtgatatccatgcaggcccaggcggccgtggctgggccccggatgcccagcgtgcagccacccaggagcatctcacccagcgctctgcaagacctgctgcggaccctgaagtcgcccagctcccctcagcagcaacagcaggtgctgaacattctcaaatcaaacccgcagctaatggcagctttcatcaaacagcgcacagccaagtacgtggccaatcagcccggcatgcagccccagcctggcctccagtcccagcccggcatgcaaccccagcctggcatgcaccagcagcccagcctgcagaacctgaatgccatgcaggctggcgtgccgcggcccggtgtgcctccacagcagcaggcgatgggaggcctgaacccccagggccaggccttgaacatcatgaacccaggacacaaccccaacatggcgagtatgaatccacagtaccgagaaatgttacggaggcagctgctgcagcagcagcagcaacagcagcagcaacaacagcagcaacagcagcagcagcaagggagtgccggcatggctgggggcatggcggggcacggccagttccagcagcctcaaggacccggaggctacccaccggccatgcagcagcagcagcgcatgcagcagcatctccccctccagggcagctccatgggccagatggcggctcagatgggacagcttggccagatggggcagccggggctgggggcagacagcacccccaacatccagcaagccctgcagcagcggattctgcagcaacagcagatgaagcagcagattgggtccccaggccagccgaaccccatgagcccccagcaacacatgctctcaggacagccacaggcctcgcatctccctggccagcagatcgccacgtcccttagtaaccaggtgcggtctccagcccctgtccagtctccacggccccagtcccagcctccacattccagcccgtcaccacggatacagccccagccttcgccacaccacgtctcaccccagactggttccccccaccccggactcgcagtcaccatggccagctccatagatcagggacacttggggaaccccgaacagagtgcaatgctcccccagctgaacacccccagcaggagtgcgctgtccagcgaactgtccctggtcggggacaccacgggggacacgctagagaagtttgtggagggcttgtagcattgtgagagcatcaccttttccctttcatgttcttggaccttttgtactgaaaatccaggcatctaggttctttttattcctagatggaactgcgacttccgagccatggaagggtggattgatgtttaaagaaacaatacaaagaatatatttttttgttaaaaaccagttgatttaaatatctggtctctctctttggtttttttttggcgggggggtggggggggttcttttttttccgttttgtttttgtttggggggaggggggttttgtttggattctttttgtcgtcattgctggtgactcatgcctttttttaacgggaaaaacaagttcattatattcatattttttatttgtattttcaagactttaaacatttatgtttaaaagtaagaagaaaaataatattcagaactgattcctgaaataatgcaagcttataatgtatcccgataactttgtgatgtttcgggaagatttttttctatagtgaactctgtgggcgtctcccagtattaccctggatgataggaattgactccggcgtgcacacacgtacacacccacacacatctatctatacataatggctgaagccaaacttgtcttgcagatgtagaaattgttgctttgtttctctgataaaactggttttagacaaaaaatagggatgatcactcttagaccatgctaatgttactagagaagaagccttcttttctttcttctatgtgaaacttgaaatgaggaaaagcaattctagtgtaaatcatgcaagcgctctaattcctataaatacgaaactcgagaagattcaatcactgtatagaatggtaaaataccaactcatttcttatatcatattgttaaataaactgtgtgcaacagacaaaaagggtggtccttcttgaattcatgtacatggtattaacacttagtgttcggggttttttgttatgaaaatgctgttttcaacattgtatttggactatgcatgtgttttttccccattgtatataaagtaccgcttaaaattgatataaattactgaggtttttaacatgtattctgttctttaagatccctgtaagaatgtttaaggtttttatttatttatatatattttttgagtctgttctttgtaagacatggttctggttgttcgctcatagcggagaggctggggctgcggttgtggttgtggcggcgtgggtggtggctgggaactgtggcccaggcttagcggccgcccggaggcttttcttcccggagactgaggtgggcgactgaggtgggcggctcagcgttggccccacacattcgaggctcacaggtgattgtcgctcacacagttagggtcgtcagttggtctgaaactgcatttggcccactcctccatcctccctgtccgtcgtagctgccacccccagaggcggcgcttcttcccgtgttcaggcggctccccccccccgtacacgactcccagaatctgaggcagagagtgctccaggctcgcgaggtgctttctgacttccccccaaatcctgccgctgccgcgcagcatgtcccgtgtggcgtttgaggaaatgctgagggacagacaccttggagcaccagctccggtccctgttacagtgagaaaggtcccccacttcgggggatacttgcacttagccacatggtcctgcctcccttggagtccagttccaggctcccttactgagtgggtgagacaagttcacaaaaaccgtaaaactgagaggaggaccatgggcaggggagctgaagttcatcccctaagtctaccacccccagcacccagagaacccactttatccctagtcccccaacaaaggctggtctaggtgggggtgatggtaattttagaaatcacgccccaaatagcttccgtttgggcccttacattcacagataggttttaaatagctgaatacttggtttgggaatctgaattcgaggaacctttctaagaagttggaaaggtccgatctagttttagcacagagctttgaaccttgagttataaaatgcagaataattcaagtaaaaataagaccaccatctggcacccctgaccagcccccattcaccccatcccaggaggggaagcacaggccgggcctccggtggagattgctgccactgctcggcctgctgggttcttaacctccagtgtcctcttcatcttttccacccgtagggaaaccttgagccatgtgttcaaacaagaagtggggctagagcccgagagcagcagctctaagcccacactcagaaagtggcgccctcctggttgtgcagccttttaatgtgggcagtggaggggcctctgtttcaggttatcctggaattcaaaacgttatgtaccaacctcatcctctttggagtctgcatcctgtgcaaccgtcttgggcaatccagatgtcgaaggatgtgaccgagagcatggtctgtggatgctaaccctaagtttgtcgtaaggaaatttctgtaagaaacctggaaagccccaacgctgtgtctcatgctgtatacttaagaggagaagaaaaagtcctatatttgtgatcaaaaagaggaaacttgaaatgtgatggtgtttataataaaagatggtaaaactacttggattcaaa

SEQ ID NO: 82 - protein, 2442 aa, Homo sapiens
MAENLLDGPPNPKRAKLSSPGFSANDSTDFGSLFDLENDLPDELIPNGGELGLLNSGNLVPDAASKHKQLSELLRGGSGSSINPGIGNVSASSPVQQGLGGQAQGQPNSANMASLSAMGKSPLSQGDSSAPSLPKQAASTSGPTPAASQALNPQAQKQVGLATSSPATSQTGPGICMNANFNQTHPGLLNSNSGHSLINQASQGQAQVMNGSLGAAGRGRGAGMPYPTPAMQGASSSVLAETLTQVSPQMTGHAGLNTAQAGGMAKMGITGNTSPFGQPFSQAGGQPMGATGVNPQLASKQSMVNSLPTFPTDIKNTSVTNVPNMSQMQTSVGIVPTQAIATGPTADPEKRKLIQQQLVLLLHAHKCQRREQANGEVRACSLPHCRTMKNVLNHMTHCQAGKACQVAHCASSRQIISHWKNCTRHDCPVCLPLKNASDKRNQQTILGSPASGIQNTIGSVGTGQQNATSLSNPNPIDPSSMQRAYAALGLPYMNQPQTQLQPQVPGQQPAQPQTHQQMRTLNPLGNNPMNIPAGGITTDQQPPNLISESALPTSLGATNPLMNDGSNSGNIGTLSTIPTAAPPSSTGVRKGWHEHVTQDLRSHLVHKLVQAIFPTPDPAALKDRRMENLVAYAKKVEGDMYESANSRDEYYHLLAEKIYKIQKELEEKRRSRLHKQGILGNQPALPAPGAQPPVIPQAQPVRPPNGPLSLPVNRMQVSQGMNSFNPMSLGNVQLPQAPMGPRAASPMNHSVQMNSMGSVPGMAISPSRMPQPPNMMGAHTNNMMAQAPAQSQFLPQNQFPSSSGAMSVGMGQPPAQTGVSQGQVPGAALPNPLNMLGPQASQLPCPPVTQSPLHPTPPPASTAAGMPSLQHTTPPGMTPPQPAAPTQPSTPVSSSGQTPTPTPGSVPSATQTQSTPTVQAAAQAQVTPQPQTPVQPPSVATPQSSQQQPTPVHAQPPGTPLSQAAASIDNRVPTPSSVASAETNSQQPGPDVPVLEMKTETQAEDTEPDPGESKGEPRSEMMEEDLQGASQVKEETDIAEQKSEPMEVDEKKPEVKVEVKEEEESSSNGTASQSTSPSQPRKKIFKPEELRQALMPTLEALYRQDPESLPFRQPVDPQLLGIPDYFDIVKNPMDLSTIKRKLDTGQYQEPWQYVDDVWLMFNNAWLYNRKTSRVYKFCSKLAEVFEQEIDPVMQSLGYCCGRKYEFSPQTLCCYGKQLCTIPRDAAYYSYQNRYHFCEKCFTEIQGENVTLGDDPSQPQTTISKDQFEKKKNDTLDPEPFVDCKECGRKMHQICVLHYDIIWPSGFVCDNCLKKTGRPRKENKFSAKRLQTTRLGNHLEDRVNKFLRRQNHPEAGEVFVRVVASSDKTVEVKPGMKSRFVDSGEMSESFPYRTKALFAFEEIDGVDVCFFGMHVQEYGSDCPPPNTRRVYISYLDSIHFFRPRCLRTAVYHEILIGYLEYVKKLGYVTGHIWACPPSEGDDYIFHCHPPDQKIPKPKRLQEWYKKMLDKAFAERIIHDYKDIFKQATEDRLTSAKELPYFEGDFWPNVLEESIKELEQEEEERKKEESTAASETTEGSQGDSKNAKKKNNKKTNKNKSSISRANKKKPSMPNVSNDLSQKLYATMEKHKEVFFVIHLHAGPVINTLPPIVDPDPLLSCDLMDGRDAFLTLARDKHWEFSSLRRSKWSTLCMLVELHTQGQDRFVYTCNECKHHVETRWHCTVCEDYDLCINCYNTKSHAHKMVKWGLGLDDEGSSQGEPQSKSPQESRRLSIQRCIQSLVHACQCRNANCSLPSCQKMKRVVQHTKGCKRKTNGGCPVCKQLIALCCYHAKHCQENKCPVPFCLNIKHKLRQQQIQHRLQQAQLMRRRMATMNTRNVPQQSLPSPTSAPPGTPTQQPSTPQTPQPPAQPQPSPVSMSPAGFPSVARTQPPTTVSTGKPTSQVPAPPPPAQPPPAAVEAARQIEREAQQQQHLYRVNINNSMPPGRTGMGTPGSQMAPVSLNVPRPNQVSGPVMPSMPPGQWQQAPLPQQQPMPGLPRPVISMQAQAAVAGPRMPSVQPPRSISPSALQDLLRTLKSPSSPQQQQQVLNILKSNPQLMAAFIKQRTAKYVANQPGMQPQPGLQSQPGMQPQPGMHQQPSLQNLNAMQAGVPRPGVPPQQQAMGGLNPQGQALNIMNPGHNPNMASMNPQYREMLRRQLLQQQQQQQQQQQQQQQQQQGSAGMAGGMAGHGQFQQPQGPGGYPPAMQQQQRMQQHLPLQGSSMGQMAAQMGQLGQMGQPGLGADSTPNIQQALQQRILQQQQMKQQIGSPGQPNPMSPQQHMLSGQPQASHLPGQQIATSLSNQVRSPAPVQSPRPQSQPPHSSPSPRIQPQPSPHHVSPQTGSPHPGLAVTMASSIDQGHLGNPEQSAMLPQLNTPSRSALSSELSLVGDTTGDTLEKFVEGL

SEQ ID NO: 83 - DNA, 10686 bp, Artificial Sequence
  source: /note="Description of Artificial Sequence: Synthetic polynucleotide"
  CDS (1)..(10683)
atggagataagattagaaatcttgacatcaacaggtattaagcagaaaaaaccatggccacgtgtctcctggttgggaaaggaaaaagaagccgtttttcttttggatgataaattcataaatgaaattaatttgctatcaggaaagataaagaagaaaattcctagtctgcagcctttcttgaaggatgttattgtcctaacaacatccagtaatgatgcctggctggctggggtactaactacaggagagcttttcctttggaacaaagatcaagattgtttgaaaactataccaataactgaaaagcctaaggaaatgatcaaagctacagtcgcaagctctttgagactgtacttgtatgtatctggaaatgggaaaagaattgtgctcataacaccttctggatgcatatttctttgggaatatttggaattaaagaatatcttatcttctaaaagcctttcattggcgggtcggtggtcccaggtcatacctgaagaagcagttctcttgccttccaccgaagataaagaagctgtagtgaatgctgtttttataaaaaatgagttatttggagactgctgcctgtgttcatttactttttattctggggaatgcctgaagttaacatttctagcaattcggtggcatgagaatgtatttacatctgtaagatcattgccataccatgttcattgggctcaacaagactgtcatctctgtagtttaattcctaaatgtgaatcagtaaagtcaagaggagctctaatttctgccttttcaagagatggccttaccctggcagtaactcttaatcagaaagaccccaaggcaactcaggtattatttataaacacactgaattttgttactctctgtggtagccttaaaggatgtagtaacaagagtcccgtggttccagctacacttattaggtcctactgggtaggtgatatcagctggacgcatgatagtctttttctggcttgtatgttaaaacgtggctctctggttttattgacctgccaaggtgaattgctaacattaattacatttggttgctctatagaatttggcccagcagaatttattcctcttcatccactaataacgtatagaccacagcagtttacgtttcaagattcaaataattctgttgattcatcagcttctgatagtgaccctatgagacagagattttctataaaagcacactcacggttaccctacctcgttatatctgatggatatatggtcacaacccttcgatttcttgatagcctatctccatcagtacacatgagatcacttctacttgattcaacccagaggcttgagaaaatatatcaaagtgtgatattgtctaagccaaaaggcaaaggactgaacttgcgatcactgaattccctaaggtctagcctgttagaacaccaaggaaatgaaagttcagccgatttcactgtccccaaattcttgcaggcagaagaaacaataaatgaaaatgcagcagattttcaggattttgaagcagaagaaactaacgaaggcagacactttccagacaacttatgtcctttttggaacaaaagagatgatgtgctgtgtagtagtatgaaggaaggaagattggaatttgcatctatgtttgatacgatacatgcaaaggatgatagtgaggagacagatagaaccattacagaactgcattctatccagaaaagtctacttgcagcgtggactataggaatttcaaaaactgtgacagaaaaaaatttaatgttaaattacatagtagtttgtatcactcattttttttacattcttcaatttataaaatgtccttttcctaaacttgatcttgttttaagcaaaagctcaagacataatgcatggatactttgtatctttcaactttttcatcagtgtttatcaatccattattgggatataagatacaaacaagatgtggggcatttgataaagctgacctcaaatactgtaaaacttttgctgactcagcaacaaaagggtcagttattctcagagaaacttttagcttgtttttatttactcaaaatggtagctgacaatttaaatggtgtatacattcttcaacctgaagttatttcagcatcagctgatggaagtaaaataacagctcaagactcattggtggtacctatttttcagatgtttcaagatagtggttttcagaaaaactggtcttggaactcatttttcaagattcatcctcaagtagtaaatcctgtgcaacagccaggacacagattgcttattctctggagaatactgtacaaaaaaactttatggtatcaagcacaattaaatcgaagagttcctgaagctgatagtcagttaactgaaaagatgacacatgaagcatctactgtcaagtccctgttatgtcatttgcaggctaacctacagagtactggagattgcttgaatcaaaccttagaacttaaatctatcaatggggaagaatgttttttattaggatcatatgaaaagtctgttcagctgtggaaaaaagctctacaagaaatcgaagagaaaggaggaagaaggacgtattttcttcagatacgctattatctttctctcttatactgccacctctatagctataatttaaatgatgctcaaggattgtgtgatcagctagcaagagaaatcctgagatggtcccaactacctgtaaaagaaaataaagatttttcaggtgctgcaaagtctcattttgagtgtggaatggtgggcggtgttcatcctgaggcagcagtgagagtcgtccagtccatggctcgtttcatggctgcctatttcaccaatcagcagctttgcattttgccccctcatcatgtgaatgttcttcccccacttcatattaaaacagagcagtcctttcgacttattcctctgcaacactctaaggtggccagtgttgttagagatcagaatctctctaatgtgtggacagttgaatatgcacttgaattactatttattggtggcctggttccagaggctgtgtggttggcatataaacttggagactggaagacgtctgtttcaattggtgtggctttccagctgttctgtaaacgtgatagcaatttcatgaggtccaagaaaaagagtctgaatctaccactccgtatgactccagcacagatttttcaggaaaaactgcagtgtgttttaggtcaaccagcctctttggaagcaaaaaatgaaatgggctcaaaatataaacagtttacagatcccattgaagaggaagatgcaaatctgctatttggttcagtacaagaagtactgaaagcatcagttatggccgatgcagatattctttcggagacatttcaacttctgatagactctgccaaggacttcagtaaaagactgtggggcttagtgccattcggcttgtatcttccagctcctccattgtactgtccccagccagctattcttagtgaagaagatggtgatgatcttcttttaaaagctgaaaaaaataatcgccagaaggtatctggaatccttcagcgtgttctcctgcttttccgggcggctcagtgttcttttcctgtagcacagtggtatatattgcagttgaggtgggcaagaaaagtcatgcagaagattcgaatgaaaggatcccttccttcactgagtccttttcctcagtcattacttaattactgtaaaggaggtatcgcattttttagacctggagcagctggagaccacaagcttgatgaagtttccattagagcaataggttgcttcagagaactttgtgctctgtgttggatgctgcatgtccgtgataagttatcctatagttgcaggcaatatcagaaagcaagagaaaatgtaaaaggagaaaaggaccttgaagtggagtttgattcttgtatgattgagcactgtcttagtgcagtggaatgggcttatagaatgctgcctttctctcggttttttaatatggaagaacttattcaggatataattttgagccttattggagaactgccaccaatcagaaaggtagcagaaattttcgtgaaagcatttccctatcctgaggacgtgagggttcctttaagagacaaatatcactctcttcaccagagactcagacactgtgttgtgaaaggaccccagactgaggaaatgatgtctgttgtcatgcattctatccagaaagtgagggtgaaagctctaaaacgtgtgcagagaaatataggctcttttgaagtgaatatatgggaaccaattgaagaagagaaaccagatgaggctccaggtgttgacagatattccctggggactagtttgagcagaagtacactcacagaactaggagattctgtggttcacagtgatgcagatacgttctctgaagctttgtcggttgaagaaaaaagtaggataaatatctatcaaagaaatgccccaaatcacatggaattaacatcaattcataagccaactgataaaaggaaaatgtgtaatcagaaagaaaatcctacaaagaaagaagatcatgaaaagttatcacaaaatacacttcctgtaataggtgtttgggaatttgaacgtgatgatgatgaatatattaaattccttgatctgtttttgagttacattcttgaaagagacctaccttattccagggatgctgacattccatttctaactagtttttctggaaagcttagagaacatgaacttaattctttactttttgatgtacatacaacattaaaacgacatcagagcaaaactaaaagccagaatgtgtttagagctggttcttgctttgttgttgctcctgagtcctatgaatcagaaaaatcatcctctttaaatgatgaatatggcatgcatttagaaaaccagaaactttcatcatcagtactggttaatcaagggatcaaaccttttttacaatatccttcgaatgaagtcaataagaatgaaggaatgagtggattatttggtttaaaacaaaggtcaatttacaaaatacaagatgacactagagagaaatgtctaatccagagatcatcaaaccacattttttggactcccaagtccattaaaactagaagatgtattttcaaagctattcagtgcaatgatattaaccctcaagaagatcttcctttagcactaaacacttttggcagtataggaagactgctggaatggatgataaggtggtctaatagaaggctactctgtgattctggtataactgagtcatcctctgagtacagtccagtaattcgtgtaaagacctctacagctgccattcttacatcattatggcttttggaacaaccctattttgctacatataaggcaaaaaatgccattattaagatggtagagaatcgtgacactgggtgtcagattggacccaatattgagagggagagcaaatcagatgctggcggttcagttgcagtagcaactccaggtggaactgaggaaagaaatggtcagaataaatcttgtcaaaatatcttgaatagaatgccaactgaagcaaaaaatcctgatataaaagaaatcaatgatgatattatttccatcactcataatactaaaaaagaatttatagatattgatgagaatcttttagaagtagaagcatttacagaagaggaaatggatatgcacatatcagactatgaagaagacattgaagaatctgttggaggtttcagaagtcccagtcttgccatttgcatgatgactttaccacagcagttagaagaagagttcacagaagaggttcagtgtcaaagggaagaaccactggagacaattatggaggaaaaatcgactgaacaaaaaggtatgatcgaagccttttcacatcctgggcataccactcctcaatcaatgcaagtagatacgagttcagaaatttctagtgcacagatttctacatataaagaaaaatcttcctcagttccacttctgatatcaaatggagtcaatgttgcttcacaaccacctgctccaacacctcagaagacccagagaaatgaattcacggctcagttaccagattgttcggagtccgttaggcagatgctgcaagatgaaatgtttaaattagttcagctgcaacagatcaacttcatgagcctaatgcaaatagtaggatcatcctttgctaatctcccagatacacaacaacttgtacagcagtctcagtctgtgcatttaggggaaagccaagaatcaaacctaagaggatgtggtgatgttgaagacagcaacaaaaatcttaaggagagattttttattaaaccacagtcaatgggagagaacgccagagagcctcgcaagaacagcccacactgccatgaaggaactatcccatctggtcaaaatagtactggaaacgtacagaatgttccacatgggagtattcctttatgtcaattaaatggccagccccggaaaaaaggaccaattccatcatctcaaaacttaccatccacttcgttttatccagctcctgctggaaatactcacctctaccttttgtccacaccttctgttgttcagaaggcacctagacttatcccacatgcaaaaacatttagtcctggtgatggctttcctttgcttcaatttaagtctaaacaagaattccagccccttttcttacatacaggaagtattccacaagttcccttcaggcctttgccacaaccaagagaggcttggggattatctgactccttccaacctgctctgccacagagagcagcacaaactactccagcatcccatttgaatgtaagccagtataacactgaagccagaaaaaaagaagttgagcagaagacgtgggcagaaactgtaattacagaaattcctaatcatgtgaacttggatcaatatgttggacaagaaaatttgacacctcaacaggactcttcagtgtttataaaaccagaaaaactatttgatgttaagccagggacccttgagatatctcctcaccattcctttggacttccgttactatacctgccacttaaacctcctaatatgtttccatcaacctcaagagcatctattacagttccctcaacacctatccaacctatagcagaagaaagaaaatacccaagattgtcattacttcattcacatttgtccccagaaaataggtgcaaaaaaacacaacttatcccacttgaaaacctcattgcgtttaaacaaagccaacagaaactaacacataatttatttgaacaaggtgatgctggacaccttcaacttctaaaggtcaaaatagaaccacctgaagtaagacaaggaaaggacagtaaaaaaaggcaaagaagaagagctgagaaagagctgcaagaaaaaagatgtgagaaactgaggagaaaaccaaatgtgacttttcgaccagagaattccataattaataatgatgattcagaaatcattaagaaacccaaggaacaacaagaacattgtggttcccatcctttggatgacttcgacgttccttttgaaatgctacaagatgataatacttcagctggattgcatttcatggcctctgtaaaaaagaaagctataggaagtcaagatgcaagtacaaatacagacccagaacatgagcctttgactgctcctcagctcttggtcccagatgtctatctaaatctgaagctttccagtgaaatgtcagagaaaccttggtcaccctcaatacctcatacagtaacaaacttggaattacctgtgagagaagagccttcaaatgataatgttatcaaacagcaaagcgatcatctagcagttccatcgtctgcagagttacattatatggcagcttcagttactaatgctgttcccccacataattttaagagtcaaggtttcctgaacatacagtcatggccaccaaacatgactgacttcagtgttttttctaacctggtgaccattggtggaagagtactctatagtggcctgtccttgcttatcctcaagcaacagggcatcacctctctacagttccagtccctgaaggaaatcagcgcaggaaacatctatattactgacaacagcaacctgtgttattatcataccattaactggacaacactcttcagcacaatcaaccagagaatagtaatccgggacaacagaaaagctgaaaattgtactgctgaaggaatggtgtgcaaccatctgtgttccagtgatggctgttggggacctgggccagaccaatgtctgtcgtgtcgccgcttcagtagaggaaggatctgcatagagtcttgtaacctctatgatggtgaatttcgggagtttgagaatggctccatctgtgtggagtgtgacccccagtgtgagaagatggaagatggcctcctcacatgccatggaccgggtcctgacaactgtacaaagtgctctcattttaaagatggcccaaactgtgtggaaaaatgtccagatggcttacagggggcaaacagtttcattttcaagtatgctgatccagatcgggagtgccacccatgccatccaaactgcacccaagggtgtaacggtcccactagtcatgactgcatttactacccatggacgggccattccactttaccacaacatgctagaactcccctgattgcagctggagtaattggtgggctcttcattctggtcattgtgggtctgacatttgctgtttatgttagaaggaagagcatcaaaaagaaaagagccttgagaagattcttggaaacagagttggtggaaccattaactcccagtggcacagcacccaatcaagctcaacttcgtattttgaaagaaactgagctgaagagggtaaaagtccttggctcaggtgcttttggaacggtttataaaggtatttgggtacctgaaggagaaactgtgaagattcctgtggctattaagattcttaatgagacaactggtcccaaggcaaatgtggagttcatggatgaagctctgatcatggcaagtatggatcatccacacctagtccggttgctgggtgtgtgtctgagcccaaccatccagctggttactcaacttatgccccatggctgcctgttggagtatgtccacgagcacaaggataacattggatcacaactgctgcttaactggtgtgtccagatagctaagggaatgatgtacctggaagaaagacgactcgttcatcgggatttggcagcccgtaatgtcttagtgaaatctccaaaccatgtgaaaatcacagattttgggctagccagactcttggaaggagatgaaaaagagtacaatgctgatggaggaaagatgccaattaaatggatggctctggagtgtatacattacaggaaattcacccatcagagtgacgtttggagctatggagttactatatgggaactgatgacctttggaggaaaaccctatgatggaattccaacgcgagaaatccctgatttattagagaaaggagaacgtttgcctcagcctcccatctgcactattgacgtttacatggtcatggtcaaatgttggatgattgatgctgacagtagacctaaatttaaggaactggctgctgagttttcaaggatggctcgagaccctcaaagatacctagttattcagggtgatgatcgtatgaagcttcccagtccaaatgacagcaagttctttcagaatctcttggatgaagaggatttggaagatatgatggatgctgaggagtacttggtccctcaggctttcaacatcccacctcccatctatacttccagagcaagaattgactcgaataggagtgaaattggacacagccctcctcctgcctacacccccatgtcaggaaaccagtttgtataccgagatggaggttttgctgctgaacaaggagtgtctgtgccctacagagccccaactagcacaattccagaagctcctgtggcacagggtgctactgctgagatttttgatgactcctgctgtaatggcaccctacgcaagccagtggcaccccatgtccaagaggacagtagcacccagaggtacagtgctgaccccaccgtgtttgccccagaacggagcccacgaggagagctggatgaggaaggttacatgactcctatgcgagacaaacccaaacaagaatacctgaatccagtggaggagaacccttttgtttctcggagaaaaaatggagaccttcaagcattggataatcccgaatatcacaatgcatccaatggtccacccaaggccgaggatgagtatgtgaatgagccactgtacctcaacacctttgccaacaccttgggaaaagctgagtacctgaagaacaacatactgtcaatgccagagaaggccaagaaagcgtttgacaaccctgactactggaaccacagcctgccacctcggagcacccttcagcacccagactacctgcaggagtacagcacaaaatatttttataaacagaatgggcggatccggcctattgtggcagagaatcctgaatacctctctgagttctccctgaagccaggcactgtgctgccgcctccaccttacagacaccggaatactgtggtgtaa

SEQ ID NO: 84 - protein, 3561 aa, Artificial Sequence
  source: /note="Description of Artificial Sequence: Synthetic polypeptide"
MEIRLEILTSTGIKQKKPWPRVSWLGKEKEAVFLLDDKFINEINLLSGKIKKKIPSLQPFLKDVIVLTTSSNDAWLAGVLTTGELFLWNKDQDCLKTIPITEKPKEMIKATVASSLRLYLYVSGNGKRIVLITPSGCIFLWEYLELKNILSSKSLSLAGRWSQVIPEEAVLLPSTEDKEAVVNAVFIKNELFGDCCLCSFTFYSGECLKLTFLAIRWHENVFTSVRSLPYHVHWAQQDCHLCSLIPKCESVKSRGALISAFSRDGLTLAVTLNQKDPKATQVLFINTLNFVTLCGSLKGCSNKSPVVPATLIRSYWVGDISWTHDSLFLACMLKRGSLVLLTCQGELLTLITFGCSIEFGPAEFIPLHPLITYRPQQFTFQDSNNSVDSSASDSDPMRQRFSIKAHSRLPYLVISDGYMVTTLRFLDSLSPSVHMRSLLLDSTQRLEKIYQSVILSKPKGKGLNLRSLNSLRSSLLEHQGNESSADFTVPKFLQAEETINENAADFQDFEAEETNEGRHFPDNLCPFWNKRDDVLCSSMKEGRLEFASMFDTIHAKDDSEETDRTITELHSIQKSLLAAWTIGISKTVTEKNLMLNYIVVCITHFFYILQFIKCPFPKLDLVLSKSSRHNAWILCIFQLFHQCLSIHYWDIRYKQDVGHLIKLTSNTVKLLLTQQQKGQLFSEKLLACFYLLKMVADNLNGVYILQPEVISASADGSKITAQDSLVVPIFQMFQDSGFQKNWSWNSFFKIHPQVVNPVQQPGHRLLILWRILYKKTLWYQAQLNRRVPEADSQLTEKMTHEASTVKSLLCHLQANLQSTGDCLNQTLELKSINGEECFLLGSYEKSVQLWKKALQEIEEKGGRRTYFLQIRYYLSLLYCHLYSYNLNDAQGLCDQLAREILRWSQLPVKENKDFSGAAKSHFECGMVGGVHPEAAVRVVQSMARFMAAYFTNQQLCILPPHHVNVLPPLHIKTEQSFRLIPLQHSKVASVVRDQNLSNVWTVEYALELLFIGGLVPEAVWLAYKLGDWKTSVSIGVAFQLFCKRDSNFMRSKKKSLNLPLRMTPAQIFQEKLQCVLGQPASLEAKNEMGSKYKQFTDPIEEEDANLLFGSVQEVLKASVMADADILSETFQLLIDSAKDFSKRLWGLVPFGLYLPAPPLYCPQPAILSEEDGDDLLLKAEKNNRQKVSGILQRVLLLFRAAQCSFPVAQWYILQLRWARKVMQKIRMKGSLPSLSPFPQSLLNYCKGGIAFFRPGAAGDHKLDEVSIRAIGCFRELCALCWMLHVRDKLSYSCRQYQKARENVKGEKDLEVEFDSCMIEHCLSAVEWAYRMLPFSRFFNMEELIQDIILSLIGELPPIRKVAEIFVKAFPYPEDVRVPLRDKYHSLHQRLRHCVVKGPQTEEMMSVVMHSIQKVRVKALKRVQRNIGSFEVNIWEPIEEEKPDEAPGVDRYSLGTSLSRSTLTELGDSVVHSDADTFSEALSVEEKSRINIYQRNAPNHMELTSIHKPTDKRKMCNQKENPTKKEDHEKLSQNTLPVIGVWEFERDDDEYIKFLDLFLSYILERDLPYSRDADIPFLTSFSGKLREHELNSLLFDVHTTLKRHQSKTKSQNVFRAGSCFVVAPESYESEKSSSLNDEYGMHLENQKLSSSVLVNQGIKPFLQYPSNEVNKNEGMSGLFGLKQRSIYKIQDDTREKCLIQRSSNHIFWTPKSIKTRRCIFKAIQCNDINPQEDLPLALNTFGSIGRLLEWMIRWSNRRLLCDSGITESSSEYSPVIRVKTSTAAILTSLWLLEQPYFATYKAKNAIIKMVENRDTGCQIGPNIERESKSDAGGSVAVATPGGTEERNGQNKSCQNILNRMPTEAKNPDIKEINDDIISITHNTKKEFIDIDENLLEVEAFTEEEMDMHISDYEEDIEESVGGFRSPSLAICMMTLPQQLEEEFTEEVQCQREEPLETIMEEKSTEQKGMIEAFSHPGHTTPQSMQVDTSSEISSAQISTYKEKSSSVPLLISNGVNVASQPPAPTPQKTQRNEFTAQLPDCSESVRQMLQDEMFKLVQLQQINFMSLMQIVGSSFANLPDTQQLVQQSQSVHLGESQESNLRGCGDVEDSNKNLKERFFIKPQSMGENAREPRKNSPHCHEGTIPSGQNSTGNVQNVPHGSIPLCQLNGQPRKKGPIPSSQNLPSTSFYPAPAGNTHLYLLSTPSVVQKAPRLIPHAKTFSPGDGFPLLQFKSKQEFQPLFLHTGSIPQVPFRPLPQPREAWGLSDSFQPALPQRAAQTTPASHLNVSQYNTEARKKEVEQKTWAETVITEIPNHVNLDQYVGQENLTPQQDSSVFIKPEKLFDVKPGTLEISPHHSFGLPLLYLPLKPPNMFPSTSRASITVPSTPIQPIAEERKYPRLSLLHSHLSPENRCKKTQLIPLENLIAFKQSQQKLTHNLFEQGDAGHLQLLKVKIEPPEVRQGKDSKKRQRRRAEKELQEKRCEKLRRKPNVTFRPENSIINNDDSEIIKKPKEQQEHCGSHPLDDFDVPFEMLQDDNTSAGLHFMASVKKKAIGSQDASTNTDPEHEPLTAPQLLVPDVYLNLKLSSEMSEKPWSPSIPHTVTNLELPVREEPSNDNVIKQQSDHLAVPSSAELHYMAASVTNAVPPHNFKSQGFLNIQSWPPNMTDFSVFSNLVTIGGRVLYSGLSLLILKQQGITSLQFQSLKEISAGNIYITDNSNLCYYHTINWTTLFSTINQRIVIRDNRKAENCTAEGMVCNHLCSSDGCWGPGPDQCLSCRRFSRGRICIESCNLYDGEFREFENGSICVECDPQCEKMEDGLLTCHGPGPDNCTKCSHFKDGPNCVEKCPDGLQGANSFIFKYADPDRECHPCHPNCTQGCNGPTSHDCIYYPWTGHSTLPQHARTPLIAAGVIGGLFILVIVGLTFAVYVRRKSIKKKRALRRFLETELVEPLTPSGTAPNQAQLRILKETELKRVKVLGSGAFGTVYKGIWVPEGETVKIPVAIKILNETTGPKANVEFMDEALIMASMDHPHLVRLLGVCLSPTIQLVTQLMPHGCLLEYVHEHKDNIGSQLLLNWCVQIAKGMMYLEERRLVHRDLAARNVLVKSPNHVKITDFGLARLLEGDEKEYNADGGKMPIKWMALECIHYRKFTHQSDVWSYGVTIWELMTFGGKPYDGIPTREIPDLLEKGERLPQPPICTIDVYMVMVKCWMIDADSRPKFKELAAEFSRMARDPQRYLVIQGDDRMKLPSPNDSKFFQNLLDEEDLEDMMDAEEYLVPQAFNIPPPIYTSRARIDSNRSEIGHSPPPAYTPMSGNQFVYRDGGFAAEQGVSVPYRAPTSTIPEAPVAQGATAEIFDDSCCNGTLRKPVAPHVQEDSSTQRYSADPTVFAPERSPRGELDEEGYMTPMRDKPKQEYLNPVEENPFVSRRKNGDLQALDNPEYHNASNGPPKAEDEYVNEPLYLNTFANTLGKAEYLKNNILSMPEKAKKAFDNPDYWNHSLPPRSTLQHPDYLQEYSTKYFYKQNGRIRPIVAENPEYLSEFSLKPGTVLPPPPYRHRNTVV

SEQ ID NO: 85 - DNA, 11217 bp, Homo sapiens
ggttctgagcaggcgccgtggcagcgcccgcgccccctgcccgccctccgccgtcgccaggacgcaggctcgcgtcagggctggcggtagggcccgcagctgtcggcctggcgtcttcaccccgcgcagtcggcctcgcctagccttctcgcgcctgactggccggaccctgcccctggcggagaatcttgggactgttttacttaattggtcattgatagcttaacaaacatggagataagattagaaatcttgacatcaacaggtattaagcagaaaaaaccatggccacgtgtctcctggttgggaaaggaaaaagaagccgtttttcttttggatgataaattcataaatgaaattaatttgctatcaggaaagataaagaagaaaattcctagtctgcagcctttcttgaaggatgttattgtcctaacaacatccagtaatgatgcctggctggctggggtactaactacaggagagcttttcctttggaacaaagatcaagattgtttgaaaactataccaataactgaaaagcctaaggaaatgatcaaagctacagtcgcaagctctttgagactgtacttgtatgtatctggaaatgggaaaagaattgtgctcataacaccttctggatgcatatttctttgggaatatttggaattaaagaatatcttatcttctaaaagcctttcattggcgggtcggtggtcccaggtcatacctgaagaagcagttctcttgccttccaccgaagataaagaagctgtagtgaatgctgtttttataaaaaatgagttatttggagactgctgcctgtgttcatttactttttattctggggaatgcctgaagttaacatttctagcaattcggtggcatgagaatgtatttacatctgtaagatcattgccataccatgttcattgggctcaacaagactgtcatctctgtagtttaattcctaaatgtgaatcagtaaagtcaagaggagctctaatttctgccttttcaagagatggccttaccctggcagtaactcttaatcagaaagaccccaaggcaactcaggtattatttataaacacactgaattttgttactctctgtggtagccttaaaggatgtagtaacaagagtcccgtggttccagctacacttattaggtcctactgggtaggtgatatcagctggacgcatgatagtctttttctggcttgtatgttaaaacgtggctctctggttttattgacctgccaaggtgaattgctaacattaattacatttggttgctctatagaatttggcccagcagaatttattcctcttcatccactaataacgtatagaccacagcagtttacgtttcaagattcaaataattctgttgattcatcagcttctgatagtgaccctatgagacagagattttctataaaagcacactcacggttaccctacctcgttatatctgatggatatatggtcacaacccttcgatttcttgatagcctatctccatcagtacacatgagatcacttctacttgattcaacccagaggcttgagaaaatatatcaaagtgtgatattgtctaagccaaaaggcaaaggactgaacttgcgatcactgaattccctaaggtctagcctgttagaacaccaaggaaatgaaagttcagccgatttcactgtccccaaattcttgcaggcagaagaaacaataaatgaaaatgcagcagattttcaggattttgaagcagaagaaactaacgaaggcagacactttccagacaacttatgtcctttttggaacaaaagagatgatgtgctgtgtagtagtatgaaggaaggaagattggaatttgcatctatgtttgatacgatacatgcaaaggatgatagtgaggagacagatagaaccattacagaactgcattctatccagaaaagtctacttgcagcgtggactataggaatttcaaaaactgtgacagaaaaaaatttaatgttaaattacatagtagtttgtatcactcattttttttacattcttcaatttataaaatgtccttttcctaaacttgatcttgttttaagcaaaagctcaagacataatgcatggatactttgtatctttcaactttttcatcagtgtttatcaatccattattgggatataagatacaaacaagatgtggggcatttgataaagctgacctcaaatactgtaaaacttttgctgactcagcaacaaaagggtcagttattctcagagaaacttttagcttgtttttatttactcaaaatggtagctgacaatttaaatggtgtatacattcttcaacctgaagttatttcagcatcagctgatggaagtaaaataacagctcaagactcattggtggtacctatttttcagatgtttcaagatagtggttttcagaaaaactggtcttggaactcatttttcaagattcatcctcaagtagtaaatcctgtgcaacagccaggacacagattgcttattctctggagaatactgtacaaaaaaactttatggtatcaagcacaattaaatcgaagagttcctgaagctgatagtcagttaactgaaaagatgacacatgaagcatctactgtcaagtccctgttatgtcatttgcaggctaacctacagagtactggagattgcttgaatcaaaccttagaacttaaatctatcaatggggaagaatgttttttattaggatcatatgaaaagtctgttcagctgtggaaaaaagctctacaagaaatcgaagagaaaggaggaagaaggacgtattttcttcagatacgctattatctttctctcttatactgccacctctatagctataatttaaatgatgctcaaggattgtgtgatcagctagcaagagaaatcctgagatggtcccaactacctgtaaaagaaaataaagatttttcaggtgctgcaaagtctcattttgagtgtggaatggtgggcggtgttcatcctgaggcagcagtgagagtcgtccagtccatggctcgtttcatggctgcctatttcaccaatcagcagctttgcattttgccccctcatcatgtgaatgttcttcccccacttcatattaaaacagagcagtcctttcgacttattcctctgcaacactctaaggtggccagtgttgttagagatcagaatctctctaatgtgtggacagttgaatatgcacttgaattactatttattggtggcctggttccagaggctgtgtggttggcatataaacttggagactggaagacgtctgtttcaattggtgtggctttccagctgttctgtaaacgtgatagcaatttcatgaggtccaagaaaaagagtctgaatctaccactccgtatgactccagcacagatttttcaggaaaaactgcagtgtgttttaggtcaaccagcctctttggaagcaaaaaatgaaatgggctcaaaatataaacagtttacagatcccattgaagaggaagatgcaaatctgctatttggttcagtacaagaagtactgaaagcatcagttatggccgatgcagatattctttcggagacatttcaacttctgatagactctgccaaggacttcagtaaaagactgtggggcttagtgccattcggcttgtatcttccagctcctccattgtactgtccccagccagctattcttagtgaagaagatggtgatgatcttcttttaaaagctgaaaaaaataatcgccagaaggtatctggaatccttcagcgtgttctcctgcttttccgggcggctcagtgttcttttcctgtagcacagtggtatatattgcagttgaggtgggcaagaaaagtcatgcagaagattcgaatgaaaggatcccttccttcactgagtccttttcctcagtcattacttaattactgtaaaggaggtatcgcattttttagacctggagcagctggagaccacaagcttgatgaagtttccattagagcaataggttgcttcagagaactttgtgctctgtgttggatgctgcatgtccgtgataagttatcctatagttgcaggcaatatcagaaagcaagagaaaatgtaaaaggagaaaaggaccttgaagtggagtttgattcttgtatgattgagcactgtcttagtgcagtggaatgggcttatagaatgctgcctttctctcggttttttaatatggaagaacttattcaggatataattttgagccttattggagaactgccaccaatcagaaaggtagcagaaattttcgtgaaagcatttccctatcctgaggacgtgagggttcctttaagagacaaatatcactctcttcaccagagactcagacactgtgttgtgaaaggaccccagactgaggaaatgatgtctgttgtcatgcattctatccagaaagtgagggtgaaagctctaaaacgtgtgcagagaaatataggctcttttgaagtgaatatatgggaaccaattgaagaagagaaaccagatgaggctccaggtgttgacagatattccctggggactagtttgagcagaagtacactcacagaactaggagattctgtggttcacagtgatgcagatacgttctctgaagctttgtcggttgaagaaaaaagtaggataaatatctatcaaagaaatgccccaaatcacatggaattaacatcaattcataagccaactgataaaaggaaaatgtgtaatcagaaagaaaatcctacaaagaaagaagatcatgaaaagttatcacaaaatacacttcctgtaataggtgtttgggaatttgaacgtgatgatgatgaatatattaaattccttgatctgtttttgagttacattcttgaaagagacctaccttattccagggatgctgacattccatttctaactagtttttctggaaagcttagagaacatgaacttaattctttactttttgatgtacatacaacattaaaacgacatcagagcaaaactaaaagccagaatgtgtttagagctggttcttgctttgttgttgctcctgagtcctatgaatcagaaaaatcatcctctttaaatgatgaatatggcatgcatttagaaaaccagaaactttcatcatcagtactggttaatcaagggatcaaaccttttttacaatatccttcgaatgaagtcaataagaatgaaggaatgagtggattatttggtttaaaacaaaggtcaatttacaaaatacaagatgacactagagagaaatgtctaatccagagatcatcaaaccacattttttggactcccaagtccattaaaactagaagatgtattttcaaagctattcagtgcaatgatattaaccctcaagaagatcttcctttagcactaaacacttttggcagtataggaagactgctggaatggatgataaggtggtctaatagaaggctactctgtgattctggtataactgagtcatcctctgagtacagtccagtaattcgtgtaaagacctctacagctgccattcttacatcattatggcttttggaacaaccctattttgctacatataaggcaaaaaatgccattattaagatggtagagaatcgtgacactgggtgtcagattggacccaatattgagagggagagcaaatcagatgctggcggttcagttgcagtagcaactccaggtggaactgaggaaagaaatggtcagaataaatcttgtcaaaatatcttgaatagaatgccaactgaagcaaaaaatcctgatataaaagaaatcaatgatgatattatttccatcactcataatactaaaaaagaatttatagatattgatgagaatcttttagaagtagaagcatttacagaagaggaaatggatatgcacatatcagactatgaagaagacattgaagaatctgttggaggtttcagaagtcccagtcttgccatttgcatgatgactttaccacagcagttagaagaagagttcacagaagaggttcagtgtcaaagggaagaaccactggagacaattatggaggaaaaatcgactgaacaaaaaggtatgatcgaagccttttcacatcctgggcataccactcctcaatcaatgcaagtagatacgagttcagaaatttctagtgcacagatttctacatataaagaaaaatcttcctcagttccacttctgatatcaaatggagtcaatgttgcttcacaaccacctgctccaacacctcagaagacccagagaaatgaattcacggctcagttaccagattgttcggagtccgttaggcagatgctgcaagatgaaatgtttaaattagttcagctgcaacagatcaacttcatgagcctaatgcaaatagtaggatcatcctttgctaatctcccagatacacaacaacttgtacagcagtctcagtctgtgcatttaggggaaagccaagaatcaaacctaagaggatgtggtgatgttgaagacagcaacaaaaatcttaaggagagattttttattaaaccacagtcaatgggagagaacgccagagagcctcgcaagaacagcccacactgccatgaaggaactatcccatctggtcaaaatagtactggaaacgtacagaatgttccacatgggagtattcctttatgtcaattaaatggccagccccggaaaaaaggaccaattccatcatctcaaaacttaccatccacttcgttttatccagctcctgctggaaatactcacctctaccttttgtccacaccttctgttgttcagaaggcacctagacttatcccacatgcaaaaacatttagtcctggtgatggctttcctttgcttcaatttaagtctaaacaagaattccagccccttttcttacatacaggaagtattccacaagttcccttcaggcctttgccacaaccaagagaggcttggggattatctgactccttccaacctgctctgccacagagagcagcacaaactactccagcatcccatttgaatgtaagccagtataacactgaagccagaaaaaaagaagttgagcagaagacgtgggcagaaactgtaattacagaaattcctaatcatgtgaacttggatcaatatgttggacaagaaaatttgacacctcaacaggactcttcagtgtttataaaaccagaaaaactatttgatgttaagccagggacccttgagatatctcctcaccattcctttggacttccgttactatacctgccacttaaacctcctaatatgtttccatcaacctcaagagcatctattacagttccctcaacacctatccaacctatagcagaagaaagaaaatacccaagattgtcattacttcattcacatttgtccccagaaaataggtgcaaaaaaacacaacttatcccacttgaaaacctcattgcgtttaaacaaagccaacagaaactaacacataatttatttgaacaaggtgatgctggacaccttcaacttctaaaggtcaaaatagaaccacctgaagtaagacaaggaaaggacagtaaaaaaaggcaaagaagaagagctgagaaagagctgcaagaaaaaagatgtgagaaactgaggagaaaaccaaatgtgacttttcgaccagagaattccataattaataatgatgattcagaaatcattaagaaacccaaggaacaacaagaacattgtggttcccatcctttggatgacttcgacgttccttttgaaatgctacaagatgataatacttcagctggattgcatttcatggcctctgtaaaaaagaaagctataggaagtcaagatgcaagtacaaatacagacccagaacatgagcctttgactgctcctcagctcttggtcccagatgtctatctaaatctgaagctttccagtgaaatgtcagagaaaccttggtcaccctcaatacctcatacagtaacaaacttggaattacctgtgagagaagagccttcaaatgataatgttatcaaacagcaaagcgatcatctagcagttccatcgtctgcagagttacattatatggcagcttcagttactaatgctgttcccccacataattttaagagtcaaggtctgccaaaaccagagttccgattcaaaggacagagcacaaagtcagactctgcagaagattatctattgtggaaacggctgcaaggtgtctctgcagcttgccctgcaccaagctctgcagctcaccaactagagcatctcagtgctaagcttcagaaaattgacgagcagttgctagcaatacagaacattgctgaaaacatagaacaggatttccccaagcctgaaatgctagatctacattgtgataagattggaccagtggatcacattgaattctcttctggccctgaattcaaaaaaacattagcttcaaaaaccattagcatttctgaagaagtgcgttttttgacccatatggatgaagaagatcaaagtgacaaaaaggagacttcagaacctgaattttcaataacagaaaattattctggtcagaaaacctgtgtgtttcctactgccgattcagctgtcagcctttccagttccagtgatcagaatactacttctcctggtatgaatagcagtgatgaattgtgtgagagtgtttcagtacatccgctccagatgactggattgactgatattgcagacattattgatgaccttataattaaagacggagtttccagtgaagaacttggcttaacagaacaagctatgggcacctccagaattcagcattattctggcagacattcacaaagaactgacaaggaaagaagagagattcaagcctggatgaaaagaaaacgaaaagaaagaatggcaaagtacttaaatgagctggcagaaaagagagggcaagaacatgatcctttctgtcccagaagcaatccactttacatgacttcaagggaaataaggctgagacaaaagatgaagcatgaaaaagacagattgctgctctctgaacactatagtcgtcgaatctcacaagcgtacggtctgatgaatgaactgttatctgagtcagtacagctaccaactctaccacagaaaccattgcctaacaaacccagccctactcagtcttccagttgtcaacactgcccttctccaagaggagagaatcaacatggtcacagttttctaataaatcgacctggaaaagtcaaatatatgtccaaaccgagttatatccataagaggaagtcttttgggcaacctcaaggctcaccttggccacatggaactgccactttcaccatacagaaaaaagctggtggagccaaagcagcagtaagaaaggctacgcagtctccagttaccttccaaaaaggctctaatgctccgtgtcatagtctgcagcatacaaaaaaacatggaagtgctgggcttgcacctcaaaccaagcaggtgtgtgtagagtatgaaagagaggagactgtggtgagtccctggacgataccttcagaaatccataagattcttcatgagagtcacaattcccttctacaagacttgtctccaactgaagaggaagagccagagcatccttttggggtgggcggtgtggacagcgtgtctgagagcactggcagcatcctcagcaagctggactggaatgccatcgaagacatggtggccagcgtggaggaccagggcctgtctgtccactgggccctggacctgtaagacctggatatcattgggtttccatgcacaggccagcacctcagtaatgtggttctgaaagattaacaggtttaagggacagaagcaatgaaagaagcaatgtgaattttccatttgctttcatattattacctggattagccattaccagaggaaaaataaacatttctcagtaactttgcctttatggggaaagggttgactattgatgtattatatgtttttgtatttgatgcatcattaggcataatttttaaaatgataagtacctttcaagccaagtttgcataacctactttcaataaaaaccctctatcttgcctcctcctttattaccctctgagttttgagaaacaaccatatacagatgaatctaataggaaaaaaaaaaatcttttcattgagaagaaaatcagtctcacctgagaactcaattatgaaccctattttaaaacacctatgcagggtttagcctaggagtgaaaagaaaaaccaactaccttttaccaaccctgaatctctaaataagcaaagtttcatggaggccaggagatcttctgtcttctgccctgtagcctgaagccttggaggaagaaacaggaatggatgctttgggcaggaaagtaagggaatatgactccggcctctagaaggctcatcttaaatttgtaagaaccatggtacagagacctgattagtttttggtattgtgctccaataatgtcatagttttaagagataatttttatgagaattgactaagaaccagtatccttcaactacttcatcaatgtttggtataatataaaagcacactatcatctgaaaaagctattaaatacccctctttttccaaatatctacctgtgtgaagccaggttttacaacatgtattgcagcaagttgaatgcagaagcaggtatggtaattcagctgccttctatcaagctaaacattaaagagatttgtagaactataaaacaatgctactctccttaccaaattgttttagaaaatagctttataggctaacattattgttaattgtcatttaattgttttgtcatttaaaatattttaaattgttttctgttagtttcttttttgtatattctatgggtattttattgatacatgatagttgtacatttttatggggtgcatgtgatattttgatatgtgcatacaatgtgtagcaatcaaatcagggtaattgggatattcatcacctcaaacatttatcatttatttgtgttggaaacattcaaaccttttcttctagctatttatccattgttggatacttatatcaattctatatcttagctgttgtgaatagagctgcaataaatgtaggagtgcagatatctctttaaaaaaaaaaaaaaaaaa

SEQ ID NO: 86 - protein, 3197 aa, Homo sapiens
MEIRLEILTSTGIKQKKPWPRVSWLGKEKEAVFLLDDKFINEINLLSGKIKKKIPSLQPFLKDVIVLTTSSNDAWLAGVLTTGELFLWNKDQDCLKTIPITEKPKEMIKATVASSLRLYLYVSGNGKRIVLITPSGCIFLWEYLELKNILSSKSLSLAGRWSQVIPEEAVLLPSTEDKEAVVNAVFIKNELFGDCCLCSFTFYSGECLKLTFLAIRWHENVFTSVRSLPYHVHWAQQDCHLCSLIPKCESVKSRGALISAFSRDGLTLAVTLNQKDPKATQVLFINTLNFVTLCGSLKGCSNKSPVVPATLIRSYWVGDISWTHDSLFLACMLKRGSLVLLTCQGELLTLITFGCSIEFGPAEFIPLHPLITYRPQQFTFQDSNNSVDSSASDSDPMRQRFSIKAHSRLPYLVISDGYMVTTLRFLDSLSPSVHMRSLLLDSTQRLEKIYQSVILSKPKGKGLNLRSLNSLRSSLLEHQGNESSADFTVPKFLQAEETINENAADFQDFEAEETNEGRHFPDNLCPFWNKRDDVLCSSMKEGRLEFASMFDTIHAKDDSEETDRTITELHSIQKSLLAAWTIGISKTVTEKNLMLNYIVVCITHFFYILQFIKCPFPKLDLVLSKSSRHNAWILCIFQLFHQCLSIHYWDIRYKQDVGHLIKLTSNTVKLLLTQQQKGQLFSEKLLACFYLLKMVADNLNGVYILQPEVISASADGSKITAQDSLVVPIFQMFQDSGFQKNWSWNSFFKIHPQVVNPVQQPGHRLLILWRILYKKTLWYQAQLNRRVPEADSQLTEKMTHEASTVKSLLCHLQANLQSTGDCLNQTLELKSINGEECFLLGSYEKSVQLWKKALQEIEEKGGRRTYFLQIRYYLSLLYCHLYSYNLNDAQGLCDQLAREILRWSQLPVKENKDFSGAAKSHFECGMVGGVHPEAAVRVVQSMARFMAAYFTNQQLCILPPHHVNVLPPLHIKTEQSFRLIPLQHSKVASVVRDQNLSNVWTVEYALELLFIGGLVPEAVWLAYKLGDWKTSVSIGVAFQLFCKRDSNFMRSKKKSLNLPLRMTPAQIFQEKLQCVLGQPASLEAKNEMGSKYKQFTDPIEEEDANLLFGSVQEVLKASVMADADILSETFQLLIDSAKDFSKRLWGLVPFGLYLPAPPLYCPQPAILSEEDGDDLLLKAEKNNRQKVSGILQRVLLLFRAAQCSFPVAQWYILQLRWARKVMQKIRMKGSLPSLSPFPQSLLNYCKGGIAFFRPGAAGDHKLDEVSIRAIGCFRELCALCWMLHVRDKLSYSCRQYQKARENVKGEKDLEVEFDSCMIEHCLSAVEWAYRMLPFSRFFNMEELIQDIILSLIGELPPIRKVAEIFVKAFPYPEDVRVPLRDKYHSLHQRLRHCVVKGPQTEEMMSVVMHSIQKVRVKALKRVQRNIGSFEVNIWEPIEEEKPDEAPGVDRYSLGTSLSRSTLTELGDSVVHSDADTFSEALSVEEKSRINIYQRNAPNHMELTSIHKPTDKRKMCNQKENPTKKEDHEKLSQNTLPVIGVWEFERDDDEYIKFLDLFLSYILERDLPYSRDADIPFLTSFSGKLREHELNSLLFDVHTTLKRHQSKTKSQNVFRAGSCFVVAPESYESEKSSSLNDEYGMHLENQKLSSSVLVNQGIKPFLQYPSNEVNKNEGMSGLFGLKQRSIYKIQDDTREKCLIQRSSNHIFWTPKSIKTRRCIFKAIQCNDINPQEDLPLALNTFGSIGRLLEWMIRWSNRRLLCDSGITESSSEYSPVIRVKTSTAAILTSLWLLEQPYFATYKAKNAIIKMVENRDTGCQIGPNIERESKSDAGGSVAVATPGGTEERNGQNKSCQNILNRMPTEAKNPDIKEINDDIISITHNTKKEFIDIDENLLEVEAFTEEEMDMHISDYEEDIEESVGGFRSPSLAICMMTLPQQLEEEFTEEVQCQREEPLETIMEEKSTEQKGMIEAFSHPGHTTPQSMQVDTSSEISSAQISTYKEKSSSVPLLISNGVNVASQPPAPTPQKTQRNEFTAQLPDCSESVRQMLQDEMFKLVQLQQINFMSLMQIVGSSFANLPDTQQLVQQSQSVHLGESQESNLRGCGDVEDSNKNLKERFFIKPQSMGENAREPRKNSPHCHEGTIPSGQNSTGNVQNVPHGSIPLCQLNGQPRKKGPIPSSQNLPSTSFYPAPAGNTHLYLLSTPSVVQKAPRLIPHAKTFSPGDGFPLLQFKSKQEFQPLFLHTGSIPQVPFRPLPQPREAWGLSDSFQPALPQRAAQTTPASHLNVSQYNTEARKKEVEQKTWAETVITEIPNHVNLDQYVGQENLTPQQDSSVFIKPEKLFDVKPGTLEISPHHSFGLPLLYLPLKPPNMFPSTSRASITVPSTPIQPIAEERKYPRLSLLHSHLSPENRCKKTQLIPLENLIAFKQSQQKLTHNLFEQGDAGHLQLLKVKIEPPEVRQGKDSKKRQRRRAEKELQEKRCEKLRRKPNVTFRPENSIINNDDSEIIKKPKEQQEHCGSHPLDDFDVPFEMLQDDNTSAGLHFMASVKKKAIGSQDASTNTDPEHEPLTAPQLLVPDVYLNLKLSSEMSEKPWSPSIPHTVTNLELPVREEPSNDNVIKQQSDHLAVPSSAELHYMAASVTNAVPPHNFKSQGLPKPEFRFKGQSTKSDSAEDYLLWKRLQGVSAACPAPSSAAHQLEHLSAKLQKIDEQLLAIQNIAENIEQDFPKPEMLDLHCDKIGPVDHIEFSSGPEFKKTLASKTISISEEVRFLTHMDEEDQSDKKETSEPEFSITENYSGQKTCVFPTADSAVSLSSSSDQNTTSPGMNSSDELCESVSVHPLQMTGLTDIADIIDDLIIKDGVSSEELGLTEQAMGTSRIQHYSGRHSQRTDKERREIQAWMKRKRKERMAKYLNELAEKRGQEHDPFCPRSNPLYMTSREIRLRQKMKHEKDRLLLSEHYSRRISQAYGLMNELLSESVQLPTLPQKPLPNKPSPTQSSSCQHCPSPRGENQHGHSFLINRPGKVKYMSKPSYIHKRKSFGQPQGSPWPHGTATFTIQKKAGGAKAAVRKATQSPVTFQKGSNAPCHSLQHTKKHGSAGLAPQTKQVCVEYEREETVVSPWTIPSEIHKILHESHNSLLQDLSPTEEEEPEHPFGVGGVDSVSESTGSILSKLDWNAIEDMVASVEDQGLSVHWALDL

SEQ ID NO: 87 - DNA, 2400 bp, Artificial Sequence
  source: /note="Description of Artificial Sequence: Synthetic polynucleotide"
  CDS (1)..(2397)
atgtcccagctctcctccaccctgaagcgctacacagaatcggcccgctacacagatgcccactatgccaagtcgggctatggtgcctacaccccgtcctcctatggggccaatctggctgcctccttactggagaaggagaaacttggtttcaagccggtccccaccagcagcttcctcacccgtccccgtacctatggcccctcctccctcctggactatgaccggggccgccccctgctgagacccgacatcactgggggtggtaagcgggcagagagccagacccggggtactgagcggcctttaggcagtggcctcagcgggggcagcggattcccttatggagtgaccaacaactgcctcagctacctgcccatcaatgcctatgaccagggggtgaccctaacccagaagctggacagccaatcagacctggcccgggatttctccagcctccggacctcagatagctaccggatagaccccaggaacctgggccgcagccccatgctggcccggacgcgcaaggagctctgcaccctgcaggggctctaccagacagccagctgccctgaatacctggtcgactacctggagaactatggtcgcaagggcagtgcatctcaggtgccctcccaggcccctccctcacgagtccctgaaatcatcagcccaacctaccgacccattggccgctacacgctgtgggagacgggaaagggtcaggcccctgggcccagccgctccagctccccgggaagagacggcatggaacaatatgaattatactgtgagatgggctccacattccaactatgtaaaatatgtgctgaaaatgataaggatgtaaagattgagccctgtggacacctcatgtgcacatcctgtcttacatcctggcaggaatcagaaggtcagggctgtcctttctgccgatgtgaaattaaaggtactgaacccatcgtggtagatccgtttgatcctagagggagtggcagcctgttgaggcaaggagcagagggagctccctccccaaattatgatgatgatgatgatgaacgagctgatgatactctcttcatgatgaaggaattggctggtgccaaggtggaacggccgccttctccattctccatggccccacaagcttcccttcccccggtgccaccacgacttgaccttctgccgcagcgagtatgtgttccctcaagtgcttctgctcttggaactgcttctaaggctgcttctggctcccttcataaagacaaaccattgccagtacctcccacacttcgagatcttccaccaccaccgcctccagaccggccatattctgttggagcagaatcccgacctcaaagacgccccttgccttgtacaccaggcgactgtccctccagagacaaactgccccctgtcccctctagccgccttggagactcatggctgccccggccaatccccaaagtaccagtatctgccccaagttccagtgatccctggacaggaagagaattaaccaaccggcactcacttccattttcattgccctcacaaatggagcccagaccagatgtgcctaggctcggaagcacgttcagtctggatacctccatgagtatgaatagcagcccattagtaggtccagagtgtgaccaccccaaaatcaaaccttcctcatctgccaatgccatttattctctggctgccagacctcttcctgtgccaaaactgccacctggggagcaatgtgagggtgaagaggacacagagtacatgactccctcttccaggcctctacggcctttggatacatcccagagttcacgagcatgtgattgcgaccagcagattgatagctgtacgtatgaagcaatgtataatattcagtcccaggcgccatctatcaccgagagcagcacctttggtgaagggaatttggccgcagcccatgccaacactggtcccgaggagtcagaaaatgaggatgatgggtatgatgtcccaaagccacctgtgccggccgtgctggcccgccgaactctctcagatatctctaatgccagctcctcctttggctggttgtctctggatggtgatcctacaacaaatgtcactgaaggttcccaagttcccgagaggcctccaaaaccattcccgcggagaatcaactctgaacggaaagctggcagctgtcagcaaggtagtggtcctgccgcctctgctgccaccgcctcacctcagctctccagtgagatcgagaacctcatgagtcaggggtactcctaccaggacatccagaaagctttggtcattgcccagaacaacatcgagatggccaaaaacatcctccgggaatttgtttccatttcttctcctgcccatgtagctacctag

SEQ ID NO: 88 - protein, 799 aa, Artificial Sequence
  source: /note="Description of Artificial Sequence: Synthetic polypeptide"
MSQLSSTLKRYTESARYTDAHYAKSGYGAYTPSSYGANLAASLLEKEKLGFKPVPTSSFLTRPRTYGPSSLLDYDRGRPLLRPDITGGGKRAESQTRGTERPLGSGLSGGSGFPYGVTNNCLSYLPINAYDQGVTLTQKLDSQSDLARDFSSLRTSDSYRIDPRNLGRSPMLARTRKELCTLQGLYQTASCPEYLVDYLENYGRKGSASQVPSQAPPSRVPEIISPTYRPIGRYTLWETGKGQAPGPSRSSSPGRDGMEQYELYCEMGSTFQLCKICAENDKDVKIEPCGHLMCTSCLTSWQESEGQGCPFCRCEIKGTEPIVVDPFDPRGSGSLLRQGAEGAPSPNYDDDDDERADDTLFMMKELAGAKVERPPSPFSMAPQASLPPVPPRLDLLPQRVCVPSSASALGTASKAASGSLHKDKPLPVPPTLRDLPPPPPPDRPYSVGAESRPQRRPLPCTPGDCPSRDKLPPVPSSRLGDSWLPRPIPKVPVSAPSSSDPWTGRELTNRHSLPFSLPSQMEPRPDVPRLGSTFSLDTSMSMNSSPLVGPECDHPKIKPSSSANAIYSLAARPLPVPKLPPGEQCEGEEDTEYMTPSSRPLRPLDTSQSSRACDCDQQIDSCTYEAMYNIQSQAPSITESSTFGEGNLAAAHANTGPEESENEDDGYDVPKPPVPAVLARRTLSDISNASSSFGWLSLDGDPTTNVTEGSQVPERPPKPFPRRINSERKAGSCQQGSGPAASAATASPQLSSEIENLMSQGYSYQDIQKALVIAQNNIEMAKNILREFVSISSPAHVAT

SEQ ID NO: 89 - DNA, 3748 bp, Homo sapiens
agtgacgcgagacgcggggtgtggctctgccggcccaggcgcgatgaggcggctgcccgctgggtggcgccgatttcccggggaggtcccttctgggcccccggcggaggtgggagagagtcaggcaggagccgaggccggggagccctcttcgtcagctggtgctcactgcgccgcgccagcgccagccgggactcacccgcagctccatgcttgtgcccggttcgactcgtccatactccaagaagaggcagcccatgaggctcccagtccccactgagtgccaccctgaaggatgtcccagctctcctccaccctgaagcgctacacagaatcggcccgctacacagatgcccactatgccaagtcgggctatggtgcctacaccccgtcctcctatggggccaatctggctgcctccttactggagaaggagaaacttggtttcaagccggtccccaccagcagcttcctcacccgtccccgtacctatggcccctcctccctcctggactatgaccggggccgccccctgctgagacccgacatcactgggggtggtaagcgggcagagagccagacccggggtactgagcggcctttaggcagtggcctcagcgggggcagcggattcccttatggagtgaccaacaactgcctcagctacctgcccatcaatgcctatgaccagggggtgaccctaacccagaagctggacagccaatcagacctggcccgggatttctccagcctccggacctcagatagctaccggatagaccccaggaacctgggccgcagccccatgctggcccggacgcgcaaggagctctgcaccctgcaggggctctaccagacagccagctgccctgaatacctggtcgactacctggagaactatggtcgcaagggcagtgcatctcaggtgccctcccaggcccctccctcacgagtccctgaaatcatcagcccaacctaccgacccattggccgctacacgctgtgggagacgggaaagggtcaggcccctgggcccagccgctccagctccccgggaagagacggcatgaattctaagagtgcccagggtctggctggtcttcgaaaccttgggaacacgtgcttcatgaactcaattctgcagtgcctgagcaacactcgggagttgagagattactgcctccagaggctctacatgcgggacctgcaccacggcagcaatgcacacacagccctcgtggaagagtttgcaaaactaattcagaccatatggacttcatcccccaatgatgtggtgagcccatctgagttcaagacccagatccagagatacgcaccgcgctttgttggctataatcagcaggatgctcaggagttccttcgctttcttctggatgggctccataacgaggtgaaccgagtgacactgagacctaagtccaaccctgagaacctcgatcatcttcctgatgacgagaaaggccgacagatgtggagaaaatatctagaacgggaagacagtaggatcggggatctctttgttgggcagctaaagagctcgctgacgtgtacagattgtggttactgttctacggtcttcgaccccttctgggacctctcactgcccattgctaagcgaggttatcctgaggtgacattaatggactgcatgaggctcttcaccaaagaggatgtgcttgatggagatgaaaagccaacatgctgtcgctgccgaggcagaaaacggtgtataaagaagttctccatccagaggttcccaaagatcttggtgctccatctgaagcggttctcagaatccaggatccgaaccagcaagctcacaacatttgtgaacttccccctaagagacctggacttaagagaatttgcctcagaaaacaccaaccatgctgtttacaacctgtacgctgtgtccaatcactccggaaccaccatgggtggccactatacagcctactgtcgcagtccagggacaggagaatggcacactttcaacgactccagcgtcactcccatgtcctccagccaagtgcgcaccagcgacgcctacctgctcttctacgaactggccagcccgccctcccgaatgtagcgccaggagccacgtcccttctcccttccccgtggtggccccgctccctaaattttttaaaaagacaaaaacaaaacaacaacaacaacacacaaacctgacaagagaaaaacaaacctgaagctgccgagcaggagtggatgcagcctgatcagggtctggagcaaggagccgggctttcctgagctgtggcccggcagggaagatcgcctggacgtggagccagcatcgccccgtgccctcggcgtttgcatttgtaaacttgtggtcttcctatgtgtcagaaacaactgtgtcttgggggggaagaccctcgctgcgccgcttcccgccgcagcgcccgcgcctccgaggggacagcgccctctggagctcgctgggagcatcaccgcctggacgcccgcgccgcggaggagccggcgcccatctccacccgcacggctcgccggtccagagccatgagccaagagccctcttcacgctgctaactccaggggacagacgaagggacatctttggaaaacgctggttttggtttttaaaaagcccaactttttttttttaatttccataactaaagtgttcagactggagtgctctccttcaggcctcttcatagctgggacgttgcactggtccttttattgcttttccaagtacaactttctaatgctagccctccgtggtgctaggtgggcgttggccaggccccaagcacagccacagtagacctgggatctaaaacaagtttctgttttgggggtttgggttttttttttttttttttaatgttttgaatggaatttagttgcctccaagaattgtgccttatagcatttggggaccagggggtaactgcccctcctgaaatatccctcagcctcttcccttttccccagtgctctgttcaaacccgcctgggaaagggatcctgcccttagccctggctcgttgtgcattgcagtgaggcaaagaagaaagcaggtagattccttccgacagggcatcaagttcttcccgcccacgtcctctagcccacccctggtctgctccccagctgtttgaaggatagcacaagcccctcgtccctagagcttctctcccttttatttattctcttaacatccctttccccctggccttcctgcccccgcccccttctcagagcctcctagacaataggccctttggaccgagtttctcagggatgcccaggccacccctcagctcttcttagcgctggtctccagtcctgccctgggagctggagcctgggtatttggggacatcttgcctcagttgtatggttctttcctgtgggctcaattttgccctacatagttggataaaactctgtgctgtcctggagagtaaagctgttcacccacacagctgggcccggcttgtgccccgtggagcctggcacattccaggctcctaggaggaggcatcagagaaagacaccctgagttttactggcctgacacccttctccagagaagacctgtgaacctgagcccaagggcaagtgtacacttgtttactgtgtaagcaagagtagaagaatgtctaatgtacagtggaaccttgtacagaataaataatagctttgagaaatcaaaaaaaaaaaaaaaa

SEQ ID NO: 90 - protein, 605 aa, Homo sapiens
MSQLSSTLKRYTESARYTDAHYAKSGYGAYTPSSYGANLAASLLEKEKLGFKPVPTSSFLTRPRTYGPSSLLDYDRGRPLLRPDITGGGKRAESQTRGTERPLGSGLSGGSGFPYGVTNNCLSYLPINAYDQGVTLTQKLDSQSDLARDFSSLRTSDSYRIDPRNLGRSPMLARTRKELCTLQGLYQTASCPEYLVDYLENYGRKGSASQVPSQAPPSRVPEIISPTYRPIGRYTLWETGKGQAPGPSRSSSPGRDGMNSKSAQGLAGLRNLGNTCFMNSILQCLSNTRELRDYCLQRLYMRDLHHGSNAHTALVEEFAKLIQTIWTSSPNDVVSPSEFKTQIQRYAPRFVGYNQQDAQEFLRFLLDGLHNEVNRVTLRPKSNPENLDHLPDDEKGRQMWRKYLEREDSRIGDLFVGQLKSSLTCTDCGYCSTVFDPFWDLSLPIAKRGYPEVTLMDCMRLFTKEDVLDGDEKPTCCRCRGRKRCIKKFSIQRFPKILVLHLKRFSESRIRTSKLTTFVNFPLRDLDLREFASENTNHAVYNLYAVSNHSGTTMGGHYTAYCRSPGTGEWHTFNDSSVTPMSSSQVRTSDAYLLFYELASPPSRM

SEQ ID NO: 91 - DNA, 11241 bp, Homo sapiens
tccgcccggatagccggcggcggcggcggcggcggcggcggcggcggccgggagaggcccctccttcacgccctgcttctctccctcgctcgcagtcgagccgagccggcggacccgcctgggctccgaccctgcccaggccatggccggcaacgtgaagaagagctctggggccgggggcggcagcggctccgggggctcgggttcgggtggcctgattgggctcatgaaggacgccttccagccgcaccaccaccaccaccaccacctcagcccccacccgccggggacggtggacaagaagatggtggagaagtgctggaagctcatggacaaggtggtgcggttgtgtcagaacccaaagctggcgctaaagaatagcccaccttatatcttagacctgctaccagatacctaccagcatctccgtactatcttgtcaagatatgaggggaagatggagacacttggagaaaatgagtattttagggtgtttatggagaatttgatgaagaaaactaagcaaaccataagcctcttcaaggagggaaaagaaagaatgtatgaggagaattctcagcctaggcgaaacctaaccaaactgtccctcatcttcagccacatgctggcagaactaaaaggaatctttccaagtggactctttcagggagacacatttcggattactaaagcagatgctgcggaattttggagaaaagcttttggggaaaagacaatagtcccttggaagagctttcgacaggctctacatgaagtgcatcccatcagttctgggctggaggccatggctctgaaatccactattgatctgacctgcaatgattatatttcggtttttgaatttgacatctttacccgactctttcagccctggtcctctttgctcaggaattggaacagccttgctgtaactcatcctggctacatggcttttttgacgtatgacgaagtgaaagctcggctccagaaattcattcacaaacctggcagttatatcttccggctgagctgtactcgtctgggtcagtgggctattgggtatgttactgctgatgggaacattctccagacaatccctcacaataaacctctcttccaagcactgattgatggcttcagggaaggcttctatttgtttcctgatggacgaaatcagaatcctgatctgactggcttatgtgaaccaactccccaagaccatatcaaagtgacccaggaacaatatgaattatactgtgagatgggctccacattccaactatgtaaaatatgtgctgaaaatgataaggatgtaaagattgagccctgtggacacctcatgtgcacatcctgtcttacatcctggcaggaatcagaaggtcagggctgtcctttctgccgatgtgaaattaaaggtactgaacccatcgtggtagatccgtttgatcctagagggagtggcagcctgttgaggcaaggagcagagggagctccctccccaaattatgatgatgatgatgatgaacgagctgatgatactctcttcatgatgaaggaattggctggtgccaaggtggaacggccgccttctccattctccatggccccacaagcttcccttcccccggtgccaccacgacttgaccttctgccgcagcgagtatgtgttccctcaagtgcttctgctcttggaactgcttctaaggctgcttctggctcccttcataaagacaaaccattgccagtacctcccacacttcgagatcttccaccaccaccgcctccagaccggccatattctgttggagcagaatcccgacctcaaagacgccccttgccttgtacaccaggcgactgtccctccagagacaaactgccccctgtcccctctagccgccttggagactcatggctgccccggccaatccccaaagtaccagtatctgccccaagttccagtgatccctggacaggaagagaattaaccaaccggcactcacttccattttcattgccctcacaaatggagcccagaccagatgtgcctaggctcggaagcacgttcagtctggatacctccatgagtatgaatagcagcccattagtaggtccagagtgtgaccaccccaaaatcaaaccttcctcatctgccaatgccatttattctctggctgccagacctcttcctgtgccaaaactgccacctggggagcaatgtgagggtgaagaggacacagagtacatgactccctcttccaggcctctacggcctttggatacatcccagagttcacgagcatgtgattgcgaccagcagattgatagctgtacgtatgaagcaatgtataatattcagtcccaggcgccatctatcaccgagagcagcacctttggtgaagggaatttggccgcagcccatgccaacactggtcccgaggagtcagaaaatgaggatgatgggtatgatgtcccaaagccacctgtgccggccgtgctggcccgccgaactctctcagatatctctaatgccagctcctcctttggctggttgtctctggatggtgatcctacaacaaatgtcactgaaggttcccaagttcccgagaggcctccaaaaccattcccgcggagaatcaactctgaacggaaagctggcagctgtcagcaaggtagtggtcctgccgcctctgctgccaccgcctcacctcagctctccagtgagatcgagaacctcatgagtcaggggtactcctaccaggacatccagaaagctttggtcattgcccagaacaacatcgagatggccaaaaacatcctccgggaatttgtttccatttcttctcctgcccatgtagctacctagcacaccatctccctgctgcaggtttagaggaccagtgagttgggagttattactcaagtggcacctagaagggcaggagttcctttggtgacttcacagtgaagtcttgccctctctgtgggatatcacatcagtggttccaagatttcaaagtggtgaaatgaaaatggagcagctagtatgttttattattttatgggtcttgagtgcatttgaaggtgtccttcagttcccacgtagagagagtgtggattatattacatgataacctacctggggaacagtccagaaagctatagaacaagtattttgctggaaatcctaattgaggacttaagacttcctgggttaaggatgtggccgtgtgtgtgtgtgtctgcctgtggttgtatgtgtccttgtgattataagattaacctgctgtgtgtgttaattccaggcagggaattagcacaaaaggtttaggaaggaatctttttttaaagacttccatctactgtggtattatacccaagcctagtgtgtattacaacttcaacactcccctttggcttatattaccatgtgcatagctaaagtcttctatttttagaacaccttctgtctgttctttccccatcaactccttcctcatccttcttggtgttctgtcatgggccatgggcttgctatggccagccttactgaggccaagcagcttatgggatgttctttattgtgtgtgatggtattggtttgtttggtagataagtgggaggaaaagtactgttgctacactattataggcatgtttgatactagcagctaacactggtcactccaaagcactgtttctataggaacattgaagctattaagatgttttgattatcctaattacataatgaccgatttgagatagaggcctttaaatacattccatgccctccccagaaaatagtctgtgggagtcagttgccttggtgccaggtatgtgttctgatgtaggtcatgagtctttctacttaatgggaagggaagaacatttgtttccaggatgactttctggccagaataccggaaagcttttaggaagcttcgttcacatgctatttaaatgcacaaaatagacagtaaggatttatctgttcagtttttcttcccagtgaattaatttcagcttatatgggtgtcttcatttgaacatgaggaatattaggttatattttcagcagtggttttttcctttgccctttaaggagtggggataatgtccacggtggcccagcctcttgctgatggcaccttccctgcattgctgcctcccgatgatgtggttcttttcttgtgcctgtggctttgggaatgtaacatctctttcctcctttccttcccttttcctcttcacctgaggtcctaaatactctctgtaattactgtgttcttcacggtaattagacatcattcagtgaataaattactgtagtcaaagacagtatgggctggcagtttgtgtaattgcaagttcataaagagaattgagggtccagttgggagaactattagtcagttcttttatatgctgataaatgatccctcgagttcagttagtattctgtccagagtgtttagctcactttcttagcagtgtgtaagctttctccatgtcagaagcaagcctgctctttgataaatctgtcttcctgaaaatctaaatcatgcttttgtctttagatctacacagaaatgaccctccttggatcagttttctttccagtctaatcatctttggaactaaaacttgttctaactcgtctcttggcattcagctactcctagatcttttggttttatcccctggcctcagagccatttatattcccagagtaggcagtacaggatctcgtgttgatttgctgtggttacccagtgtcttctctacatggcataaagcggcaaagcccaccattaggtgaggcggtcccgagttgaggtagagtggggcagaggaagatggcagtgaatatcaaacagtagaccgccatcaacttctaacagccagtacacacactgtttcattttgaggtaacgttcagttttgcattttgtttaaatattgaaggcctagacaaagaactagaaaaaaaaaagcagtttccaggcccatccatattgtaatttttctttatctgcagatattgcctgtagtctaaagatctctttggaagacaaagcattggctatatatcttttgccttttccatgcatctaaatcttctctggagattatctccctactgtgtaggttaagggcagtctcgacttttccttttttgagtcctgtgtggctctttgaatcagcgtgaaactgaggctccagctccctgtgttgtgtgtgtgtgccatccatgggcttgggtgtcagtttgtcacaggtatctgccagcattcaaggttttggatcatttcatgaggatctttcctttgactgggtgctgtgaggacacacctgggtctgtgcctgagattgccaggcaagattaaggaaagttttcatgtggcttttgttttgaggttattctcaaaaccttaatttcttatattttctgttgactaaggcaccagtaacccattcttcaccctccatttgtatggcaatttaaaagtctttggctttgctctgaatttaattaaaactgccttttatgaacagacttcgagttttgccattttgggcaagcccttccgcttgtcccttcctagtggctaataaagtaaaaaaacccacactactttgttctctttttctcatattcattgggctgttgtattcagccagtctcatgctttccctgggtcttcacggattgctttccaagctgccttgttgcggggttgctgcagagcagcaactggacctttccagctgtcgccatgttccttccactaaagtagagggttcttaaaatggaaaaacctgtgggctcttcatatacctccctttagttaagtaatagaccaggcagcttctcatctcagcatttacctgttaatatttttgtgaatagtgctctctacctgtgggtggccgttctcttccacttgctcgtctccccccagccccattctgcataatctaccattcttctcctctctttctcttcttatacagaccctcattactggggcccaagatgtgggatactactgttagtattatttaactattttgtagatttaaaagatttctggttaagggaggtgggggtcactgttcatcactcttaaaatatgtgttttctctatagaaaagtaaaatgtgtttatggtcccaaacagtcaactcacaaatttttataacaaaatttccttgtaaaaactagggaccatctatatattccctttaagatctagttctttttgtaggtgttcagcaatggtgataaagcagaatattctcctacctcacgtcattaaagtcagaagattatagaccttctcaaactataagtccctcttcttgccgttggcctttctgactctggaatgaccactgttcattgaaaaatagttttctgactattggtctggctctaacagtttgtttgttcatccagcaaatgtttatgagtgatgaccatgtgccagaaatgtcaggtatgtgtccttcccttggcgccacatagtagtttactaatgtttgggggattgtacttggactgtcatagcctctgcgtttgaccttaaaatagctcttcccagtaagattgtgcaatttttattcacagctcttccatgtagacttacctttcctcatagagctatcctggttaataacaggccaagattctcccattatcccctgttgtctcctgtagctttgataatgcctgggagattccttggtgtaagtgtcatggataccgactgtttttatgttggaatttgttccaacataattagaatctgtttggtgagttgaaaggtaagttggctcagagttgcacagtagggcattaaatgtttaagcaaagcatctgcccacactcccctttccaatctagtgccttccttgaactttttcctgagctgctacgtccctaatcccccttgttgggaggattttcgtatcacccttatgggacctgtcaccatgtcctgtactatttggaattggttttccagtctttcaacaaccgttgtggctaactatgttttagaagggctggaggtgtgggccctgtcttcgggtctcaggacccaaagatcctttagtcagttgttgggtcttccaagagccagacattaatacagattgaactccatcagtcccctaattgtcagcctttacctccctcccagagcaaggagtttagggattctaaagcttagtgtccacacatcattctaccagaccttagagctttagaagctcaatctaaaatactgtaactcagcataaactattactatcactcctttgaactcagtctccatgagcagtgttttgttggaaatacatagaacggcttaatgcctagagggtggtggatagtgaaggacggtcaaggttatatttttgactgcttagggattctttggatccaagaaacagaaatgttcaagcggaataaaggagggagtggagttgtggtaaggatgcagggtatttcgcagaacccaggacgggaagtgcctttggttcttgggtggagctggaactgcagagctttgcacctagtcctttctcccgcttcacagtctgcttatggtatatgtggcccccaaataggcactctagtcctcaagtctacaccaccttccaactctggggatcaccatgaacaaattctcaatttcccatacttaattttttttttttttgagatggagtctcgctgtgtcgcccaggctggagtgcagtggtgcagtctcaactcaccacaacctctgcctcccaggttcaagcagttctctgcctcaacctcccgagtagctgggattacaggcgcctgccaccatgcccagctaatgttcatatttttagtagagacagggtttcaccgtcttggctaggctggtcttgaactcctgaccctcatgatccacccacctcggcctcccaaagtgctaagattacaggcgtgagccaccgcgcccggcccatacttcgtattcttaaaaaaaactacactcagcccagcacattgatcaagtatctatctctgagcagttggccttgccagggagagcagagatgtggcaggctccttcagctggagacagggagcttctcagagaagtgagcagagactccacagacaccctaaaaaggcttctactcaagaagtaaagccactactcctgcctttttgcttagtggacaggaaggcacaggagtttgtctgggacatcatagaaattcttaggtttaacttaattctggtcattgtcttctttatttcctgtttttcttccctttgtcagtcttcgcatccaagatttcttccctccctcttgtgggccagcctgtcctgttccagagctagcctgttcctgggtagccttccttagcctccattcagcctcaggtcttttgccttcttccgtgtttatttagagagcagaatctaataacgggttccactgtagccactatccatggacttctgggtcctcttcaggtttgagtgcttgaaaatgttcattctctgggcttgtggcctgtctcctccactctcctcctcaccctctcgctccttcctgtgtgagggccgctctgcagtaatgttctcaggcaagccttcctaggcacctcagaaactactttgccagagccagtaagaatatataatattggagcagttgccaggatagaaattaaatatagattccagtttaggatagagtttttaccgagagctctttagacagtatacctgtgtcttctctggcaattgctttcattttagtcctatataaaagctttccttttctgtttttttttaaaactatgcttttgcttgcctaaatcttttgatcttatatttctctcatctcagagcctgtcctgagttgtaaggtatttcatactgccttacttaaaagttttttaaactactagagtcatttgatacacacagaagttacctaataatccaaagatgtccatcaagggaggaagggtgggtcatcagactttgcctttgatgttgtagactaggctcctgagttaagcagcagagggacagcagtgccatgtgccttcactgtgtcccaggaaatctgggttggttccagtgggaaataccagtatttcttggttctggaaagtagcaaaagagtaggagatggggaaatagggatggggagagcaagccccgcatgtccatggcgagtcaggtggggagcacgggtggaagggccggctgttgacagacagactaagctgtgtggtgctcttgccgccccttcctgggtacagagcttgagaaaaatgcagccgaccactccctgtgtttgtacagagcaaagcccaaaagccaacctcagatctcctgatttggcagctgaagaaatcagcagagtcctgattgcctgattcagtcccaaaaatgaatgtcaggccccgccccctccccaccaacattgcctctcctacattctccttctgcccctaaatcagacaggaggccagagaggagtattgctcaatgcgtgctatgtgcaactcctcaggccttgtgccacctccatgctgagccctgaagcagggtgtcctgggtgcctgtgtgtcagctccctcctctctacctacctctgaccttcttgtgggtgagggtggccatgcttatggccatcttaaaactggagaggcagagaactacttatgagtctgtagaccacgtgttgtcttccatggcctgtttctcctgctgtctgggtgagtgagcctgcaacgcaatgcccatgagagtaaatgcctcctgacctaccctgctcagcactgttctagtgtcttggccttgaaagaaaagcctgacttcctgctgacacatgtggtaggggcatggcagctatgaggcacctcctacgtctgttttctggctgtggtgacttgggatttttaaccttatatatctttttcctttactcaaaacaaaacaatttttagcacactgaaaaaaaaaaaaagccaaatgttttgtgcctttctaaggcagcactgtatcccaggctgcattttaggacttaatatggaaataccagagtctgagctcctctaccttgagtttcattagtccttagtgtctaggagacaggaaagaatgctctctgtgactggagaggtgacatgcaggtgcagtgtgtctggagtccctttcccctgctgtgagacttcagtggaggagagaagcattgtaccctgggatcatttggttggttccaatcacaagcttagttatcaggttgcatgccttgtctcctgcaaaagacagaatgtttcacaattcccaggtaaactctggaccattccaagtgtcctagccttctgatgacattaattacctagttgtgtcgaggagtataggatggactctcctgagaaggggaggttggtggctttgtcttttctttttgctggatcctgaactggtctagacctcctgcccccaccccccagcccccatcagatgtggctggcctttcatttgaaggcttcagacttaaagcattaagcagctagtgccctctgcagggcctggtttccccagggaagggcagcaaggaacatgggaccagaagcctgtcctcagtaatgtgactatagtgagctttagcaaaagtttttctatataatgacatcttacttatcttttaccctttcctcagttttcccctgcctttaactaataaagaattgggagacagaaattttaaagtcctccttattcaagattttgaaattcttagcctgggagtgctggagagaacctgatgctttctccagaatgaagagtcccaatttgtatatcagtgttaagaagaaaacaaaacaaacacataggtgagattttcgtggactattttaaaaatgtgtcattaatataaaaaatttatattagcagtatttaatcattctcacctgtaaagaataagaaaaacagaaggtaaatattcttacagagaatagcagagctttaagattcattttcattttaagtccattttattttgccagtgtattaatgtttagaagtctgttttactaatgttatttattaattttttttcatttccatacacagttagttaactaaagagctttttcaagcacccatgtctgtaaaaaaatatttttaaataaagtttcttttgttgtagcagaaaaaaaaaaa

SEQ ID NO: 92 - protein, 906 aa, Homo sapiens
MAGNVKKSSGAGGGSGSGGSGSGGLIGLMKDAFQPHHHHHHHLSPHPPGTVDKKMVEKCWKLMDKVVRLCQNPKLALKNSPPYILDLLPDTYQHLRTILSRYEGKMETLGENEYFRVFMENLMKKTKQTISLFKEGKERMYEENSQPRRNLTKLSLIFSHMLAELKGIFPSGLFQGDTFRITKADAAEFWRKAFGEKTIVPWKSFRQALHEVHPISSGLEAMALKSTIDLTCNDYISVFEFDIFTRLFQPWSSLLRNWNSLAVTHPGYMAFLTYDEVKARLQKFIHKPGSYIFRLSCTRLGQWAIGYVTADGNILQTIPHNKPLFQALIDGFREGFYLFPDGRNQNPDLTGLCEPTPQDHIKVTQEQYELYCEMGSTFQLCKICAENDKDVKIEPCGHLMCTSCLTSWQESEGQGCPFCRCEIKGTEPIVVDPFDPRGSGSLLRQGAEGAPSPNYDDDDDERADDTLFMMKELAGAKVERPPSPFSMAPQASLPPVPPRLDLLPQRVCVPSSASALGTASKAASGSLHKDKPLPVPPTLRDLPPPPPPDRPYSVGAESRPQRRPLPCTPGDCPSRDKLPPVPSSRLGDSWLPRPIPKVPVSAPSSSDPWTGRELTNRHSLPFSLPSQMEPRPDVPRLGSTFSLDTSMSMNSSPLVGPECDHPKIKPSSSANAIYSLAARPLPVPKLPPGEQCEGEEDTEYMTPSSRPLRPLDTSQSSRACDCDQQIDSCTYEAMYNIQSQAPSITESSTFGEGNLAAAHANTGPEESENEDDGYDVPKPPVPAVLARRTLSDISNASSSFGWLSLDGDPTTNVTEGSQVPERPPKPFPRRINSERKAGSCQQGSGPAASAATASPQLSSEIENLMSQGYSYQDIQKALVIAQNNIEMAKNILREFVSISSPAHVAT

SEQ ID NO: 93 - DNA, 2797 bp, Artificial Sequence
  source: /note="Description of Artificial Sequence: Synthetic polynucleotide"
  CDS (1)..(1161)
  CDS (1165)..(1251)
  CDS (1255)..(1326)
  CDS (1330)..(1392)
  CDS (1408)..(1782)
  CDS (1786)..(1812)
  CDS (1816)..(1857)
  CDS (1861)..(2043)
  CDS (2047)..(2082)
  CDS (2086)..(2187)
  CDS (2191)..(2331)
  CDS (2335)..(2490)
  CDS (2494)..(2526)
  CDS (2530)..(2562)
  CDS (2566)..(2772)
  CDS (2776)..(2796)
atgggcgggaaccactcccacaagccccccgtgtttgacgagaatgaggaagtcaactttgaccattttcagattctgcgggccattggtaaagggagttttggaaaggtatgcatcgtgcagaagcgagacactaagaaaatgtatgcaatgaagtacatgaacaagcagaagtgcatcgagagggatgaggttcggaatgttttccgggagctgcagatcatgcaagggctggagcaccccttcctggtcaatctgtggtactccttccaggatgaggaggacatgttcatggtggtggacctgctcctgggaggcgacctgcgctaccatctgcagcagaatgtgcatttcacagaggggactgtgaaactctacatctgtgagctggcactggccctggagtatcttcagaggtaccacatcatccacagagacatcaagccagacaatatcctgctggatgaacacggacatgttcacattacagacttcaacatagcgacggtagtgaaaggagcagaaagggcttcctccatggctggcaccaagccctacatggctccagaagtattccaggtgtacatggacagaggccccggatactcgtaccctgtcgactggtggtccctgggcatcacagcctatgagctgctgcggggctggaggccgtacgaaatccactcggtcacgcccatcgatgaaatcctcaacatgttcaaggtggagcgtgtccactactcctccacgtggtgcaaggggatggtggccctgctgaggaagctcctgaccaaggatcctgagagccgcgtgtccagccttcatgacatacagagcgtgccctacttggccgacatgaactgggacgcggtgttcaagaaggcactgatgcccggctttgtgcccaataaagggaggttgaactgcgatcccacatttgagcttgaagagatgattctagaatccaagccacttcacaaaaagaagaagcgattggcaaagaacagatccagggatggcacaaaggacagctgcccgctgaatggacacctgcagcactgtttggagactgtccgggaggaattcatcatattcaacagagagaatgtaccgccggaagcaccaggagctgcaagccatgcagatggagctgcagagccctgagtacaagctgagcaagctccgcacctcgaccatcatgaccgactacaaccccaactactgctttgctggcaagacctcctccatcagtgacctgaaggaggtgccgcggaaaaacatcaccctcattcggggtctgggccatggcgcctttggggaggtgtatgaaggccaggtgtccggaatgcccaacgacccaagccccctgcaagtggctgtgaagacgctgcctgaagtgtgctctgaacaggacgaactggatttcctcatggaagccctgatcatcagcaaattcaaccaccagaacattgttcgctgcattggggtgagcctgcaatccctgccccggttcatcctgctggagctcatggcggggggagacctcaagtccttcctccgagagacccgccctcgcccgagccagccctcctccctggccatgctggaccttctgcacgtggctcgggacattgcctgtggctgtcagtatttggaggaaaaccacttcatccaccgagacattgctgccagaaactgcctcttgacctgtccaggccctggaagagtggccaagattggagacttcgggatggcccgagacatctacagggcgagctactatagaaagggaggctgtgccatgctgccagttaagtggatgcccccagaggccttcatggaaggaatattcacttctaaaacagacacatggtcctttggagtgctgctatgggaaatcttttctcttggatatatgccataccccagcaaaagcaaccaggaagttctggagtttgtcaccagtggaggccggatggacccacccaagaactgccctgggcctgtataccggataatgactcagtgctggcaacatcagcctgaagacaggcccaactttgccatcattttggagaggattgaatactgcacccaggacccggatgtaatcaacaccgctttgccgatagaatatggtccacttgtggaagaggaagagaaagtgcctgtgaggcccaaggaccctgagggggttcctcctctcctggtctctcaacaggcaaaacgggaggaggagcgcagcccagctgccccaccacctctgcctaccacctcctctggcaaggctgcaaagaaacccacagctgcagagatctctgttcgagtccctagagggccggccgtggaagggggacacgtgaatatggcattctctcagtccaaccctccttcggagttgcacaaggtccacggatccagaaacaagcccaccagcttgtggaacccaacgtacggctcctggtttacagagaaacccaccaaaaagaataatcctatagcaaagaaggagccacacgacaggggtaacctggggctggagggaagctgtactgtcccacctaacgttgcaactgggagacttccgggggcctcactgctcctagagccctcttcgctgactgccaatatgaaggaggtacctctgttcaggctacgtcacttcccttgtgggaatgtcaattacggctaccagcaacagggcttgcccttagaagccgctactgcccctggagctggtcattacgaggataccattctgaaaagcaagaatagcatgaaccagcctgggccctga

SEQ ID NO: 94 - protein, 387 aa, Artificial Sequence
  source: /note="Description of Artificial Sequence: Synthetic polypeptide"
MGGNHSHKPPVFDENEEVNFDHFQILRAIGKGSFGKVCIVQKRDTKKMYAMKYMNKQKCIERDEVRNVFRELQIMQGLEHPFLVNLWYSFQDEEDMFMVVDLLLGGDLRYHLQQNVHFTEGTVKLYICELALALEYLQRYHIIHRDIKPDNILLDEHGHVHITDFNIATVVKGAERASSMAGTKPYMAPEVFQVYMDRGPGYSYPVDWWSLGITAYELLRGWRPYEIHSVTPIDEILNMFKVERVHYSSTWCKGMVALLRKLLTKDPESRVSSLHDIQSVPYLADMNWDAVFKKALMPGFVPNKGRLNCDPTFELEEMILESKPLHKKKKRLAKNRSRDGTKDSCPLNGHLQHCLETVREEFIIFNRENVPPEAPGAASHADGAAEP

SEQ ID NO: 95 - DNA, 3224 bp, Homo sapiens
gtcccacatcccgcatccggcatcccagcggccgggcatgtagcagcggcagcaacggcggaatatgggcgggaaccactcccacaagccccccgtgtttgacgagaatgaggaagtcaactttgaccattttcagattctgcgggccattggtaaagggagttttggaaaggtatgcatcgtgcagaagcgagacactaagaaaatgtatgcaatgaagtacatgaacaagcagaagtgcatcgagagggatgaggttcggaatgttttccgggagctgcagatcatgcaagggctggagcaccccttcctggtcaatctgtggtactccttccaggatgaggaggacatgttcatggtggtggacctgctcctgggaggcgacctgcgctaccatctgcagcagaatgtgcatttcacagaggggactgtgaaactctacatctgtgagctggcactggccctggagtatcttcagaggtaccacatcatccacagagacatcaagccagacaatatcctgctggatgaacacggacatgttcacattacagacttcaacatagcgacggtagtgaaaggagcagaaagggcttcctccatggctggcaccaagccctacatggctccagaagtattccaggtgtacatggacagaggccccggatactcgtaccctgtcgactggtggtccctgggcatcacagcctatgagctgctgcggggctggaggccgtacgaaatccactcggtcacgcccatcgatgaaatcctcaacatgttcaaggtggagcgtgtccactactcctccacgtggtgcaaggggatggtggccctgctgaggaagctcctgaccaaggatcctgagagccgcgtgtccagccttcatgacatacagagcgtgccctacttggccgacatgaactgggacgcggtgttcaagaaggcactgatgcccggctttgtgcccaataaagggaggttgaactgcgatcccacatttgagcttgaagagatgattctagaatccaagccacttcacaaaaagaagaagcgattggcaaagaacagatccagggatggcacaaaggacagctgcccgctgaatggacacctgcagcactgtttggagactgtccgggaggaattcatcatattcaacagagagaagctcaggaggcagcagggacagggcagccagctcttggacaccgacagccgagggggaggccaggcccaaagcaagctccaggacgggtgcaacaacaacctcctcacccacacctgcacccgtggctgcagcagctgagcccacacttgttgctgctcaacaggactgcactcgtctctgccctgcccacccagagcccctctttgtgccctgatggtccctgtctcacccctgaaaacatcagatgcagaaaaagccctggacttggagctgggaagcctgggttctggtcccatctccatgactgattcacgtgtgacctcagacaagtcacgccctctctgtgcctccgttttctgcatctgccaaaggggttaaacacttctgccccacttcaaattacaagattatggggagaacccaattaggtaggaaacatgaaaaacctttgatatttataaaatcatttttacgtgcaaaatataaccttaatatttgaagtgacccccattccccaaagcaatcaaaccgtcatgactttgcaatttggcacatcctagcttgttagagggcacttccgaaaaacacagccctgacagcaaaataaaggtctgatatgttggccccttctatggaaacaacgctgccaaatcctggagcaaaacctgaagtgtcttcatgtgcattctctggcaggccacagtcctgagcttgtaagatggtgcagcatgcagaccagacttgtccccaaggtctcagcgctgcggtctcactcctcccctcatttaagaagactatccttaccttttagtttcagcagtcctcaccaccaccatatccccagtgctgggatggcacacaggtgtccattcagatgagagttgggtcgctgagcattggttactcctgcagagtgtaatcagcaccccatccaactggcccgaaagcccagacctgcagcagaactctccaactctctatcagctttcagggttttctctcctgggaagggtgtaaaatcagcttgtcagattcttcttacagagagtatccaatcggtattggtggagcggctccctatttatacaataggaagcatgggtgcttagaaagtttatttcaggaggaaaatgggttcacacaaaaagcaaactacattctgatctgctcagggagaagcttgcctttgaactggaagatgttgggatgagcagggaaagcttagactttggagtcaggtttgtgttcagaatccagccctgctggctactaactaactgggagaccttaggcaaagcatgcaatcgctctgaatggcagtttcctcatttttaaacagggataataaaactaatattgcaggggagttacagggttaaataagatcctgtgtgtaaccccaagcattggatgactcatagaatggccttttttgtcagcataatcgtcatcattatttagatactttcttccttcactcacccagcaggtcagttttctgtgcaaacaaacctgtttaggattcttccaaatgttcttcctggggtctttgatatttgtttgttacatcctgctgaagttcgactgtgtttttattttttcatccaacttccatttttcactttttacatgattactcaatccttggggctgtccatgtcatctcttagatttcttaaaagacattttaatgtatggttaggttttatatttttattttttaaaaaagaaatagtcagtgttttcctcctttcaaccgagactatttctggattgtgtgctcctcgtcagttgacttgttttgcacacttttctttacttcatgtccccatcaacaaccgtcctgctccccacctcccccaggaaataaggggcctgctcctctccctactgtgaccctggaggctcttaagatgatgatggttttttttattgggctgagttcacgaattaggggcaggagctggaagtcgccctaggaacaccagatttcctggttctgttcaagttggcatttcttgtttggaataaactatttcttggacattccttc

SEQ ID NO: 96 - protein, 414 aa, Homo sapiens
MGGNHSHKPPVFDENEEVNFDHFQILRAIGKGSFGKVCIVQKRDTKKMYAMKYMNKQKCIERDEVRNVFRELQIMQGLEHPFLVNLWYSFQDEEDMFMVVDLLLGGDLRYHLQQNVHFTEGTVKLYICELALALEYLQRYHIIHRDIKPDNILLDEHGHVHITDFNIATVVKGAERASSMAGTKPYMAPEVFQVYMDRGPGYSYPVDWWSLGITAYELLRGWRPYEIHSVTPIDEILNMFKVERVHYSSTWCKGMVALLRKLLTKDPESRVSSLHDIQSVPYLADMNWDAVFKKALMPGFVPNKGRLNCDPTFELEEMILESKPLHKKKKRLAKNRSRDGTKDSCPLNGHLQHCLETVREEFIIFNREKLRRQQGQGSQLLDTDSRGGGQAQSKLQDGCNNNLLTHTCTRGCSS

SEQ ID NO: 97 - DNA, 2610 bp, Artificial Sequence
  source: /note="Description of Artificial Sequence: Synthetic polynucleotide"
  CDS (1)..(2607)
atggtcagctggggtcgtttcatctgcctggtcgtggtcaccatggcaaccttgtccctggcccggccctccttcagtttagttgaggataccacattagagccagaagatgccatctcatccggagatgatgaggatgacaccgatggtgcggaagattttgtcagtgagaacagtaacaacaagagagcaccatactggaccaacacagaaaagatggaaaagcggctccatgctgtgcctgcggccaacactgtcaagtttcgctgcccagccggggggaacccaatgccaaccatgcggtggctgaaaaacgggaaggagtttaagcaggagcatcgcattggaggctacaaggtacgaaaccagcactggagcctcattatggaaagtgtggtcccatctgacaagggaaattatacctgtgtagtggagaatgaatacgggtccatcaatcacacgtaccacctggatgttgtggagcgatcgcctcaccggcccatcctccaagccggactgccggcaaatgcctccacagtggtcggaggagacgtagagtttgtctgcaaggtttacagtgatgcccagccccacatccagtggatcaagcacgtggaaaagaacggcagtaaatacgggcccgacgggctgccctacctcaaggttctcaaggccgccggtgttaacaccacggacaaagagattgaggttctctatattcggaatgtaacttttgaggacgctggggaatatacgtgcttggcgggtaattctattgggatatcctttcactctgcatggttgacagttctgccagcgcctggaagagaaaaggagattacagcttccccagactacctggagatagccatttactgcataggggtcttcttaatcgcctgtatggtggtaacagtcatcctgtgccgaatgaagaacacgaccaagaagccagacttcagcagccagccggctgtgcacaagctgaccaaacgtatccccctgcggagacaggtaacagtttcggctgagtccagctcctccatgaactccaacaccccgctggtgaggataacaacacgcctctcttcaacggcagacacccccatgctggcaggggtctccgagtatgaacttccagaggacccaaaatgggagtttccaagagataagctgacactgggcaagcccctgggagaaggttgctttgggcaagtggtcatggcggaagcagtgggaattgacaaagacaagcccaaggaggcggtcaccgtggccgtgaagatgttgaaagatgatgccacagagaaagacctttctgatctggtgtcagagatggagatgatgaagatgattgggaaacacaagaatatcataaatcttcttggagcctgcacacaggatgggcctctctatgtcatagttgagtatgcctctaaaggcaacctccgagaatacctccgagcccggaggccacccgggatggagtactcctatgacattaaccgtgttcctgaggagcagatgaccttcaaggacttggtgtcatgcacctaccagctggccagaggcatggagtacttggcttcccaaaaatgtattcatcgagatttagcagccagaaatgttttggtaacagaaaacaatgtgatgaaaatagcagactttggactcgccagagatatcaacaatatagactattacaaaaagaccaccaatgggcggcttccagtcaagtggatggctccagaagccctgtttgatagagtatacactcatcagagtgatgtctggtccttcggggtgttaatgtgggagatcttcactttagggggctcgccctacccagggattcccgtggaggaactttttaagctgctgaaggaaggacacagaatggataagccagccaactgcaccaacgaactgtacatgatgatgagggactgttggcatgcagtgccctcccagagaccaacgttcaagcagttggtagaagacttggatcgaattctcactctcacaaccaatgaggtaaaggcgacacaggaggagaaccgggagctgaggagcaggtgtgaggagctccacgggaagaacctggaactggggaagatcatggacaggttcgaagaggttgtgtaccaggccatggaggaagttcagaagcagaaggaactttccaaagctgaaatccagaaagttctaaaagaaaaagaccaacttaccacagatctgaactccatggagaagtccttctccgacctcttcaagcgttttgagaaacagaaagaggtgatcgagggctaccgcaagaacgaagagtcactgaagaagtgcgtggaggattacctggcaaggatcacccaggagggccagaggtaccaagccctgaaggcccacgcggaggagaagctgcagctggcaaacgaggagatcgcccaggtccggagcaaggcccaggcggaagcgttggccctccaggccagcctgaggaaggagcagatgcgcatccagtcgctggagaagacagtggagcagaagactaaagagaacgaggagctgaccaggatctgcgacgacctcatctccaagatggagaagatctga

SEQ ID NO: 98 - protein, 869 aa, Artificial Sequence
  source: /note="Description of Artificial Sequence: Synthetic polypeptide"
MVSWGRFICLVVVTMATLSLARPSFSLVEDTTLEPEDAISSGDDEDDTDGAEDFVSENSNNKRAPYWTNTEKMEKRLHAVPAANTVKFRCPAGGNPMPTMRWLKNGKEFKQEHRIGGYKVRNQHWSLIMESVVPSDKGNYTCVVENEYGSINHTYHLDVVERSPHRPILQAGLPANASTVVGGDVEFVCKVYSDAQPHIQWIKHVEKNGSKYGPDGLPYLKVLKAAGVNTTDKEIEVLYIRNVTFEDAGEYTCLAGNSIGISFHSAWLTVLPAPGREKEITASPDYLEIAIYCIGVFLIACMVVTVILCRMKNTTKKPDFSSQPAVHKLTKRIPLRRQVTVSAESSSSMNSNTPLVRITTRLSSTADTPMLAGVSEYELPEDPKWEFPRDKLTLGKPLGEGCFGQVVMAEAVGIDKDKPKEAVTVAVKMLKDDATEKDLSDLVSEMEMMKMIGKHKNIINLLGACTQDGPLYVIVEYASKGNLREYLRARRPPGMEYSYDINRVPEEQMTFKDLVSCTYQLARGMEYLASQKCIHRDLAARNVLVTENNVMKIADFGLARDINNIDYYKKTTNGRLPVKWMAPEALFDRVYTHQSDVWSFGVLMWEIFTLGGSPYPGIPVEELFKLLKEGHRMDKPANCTNELYMMMRDCWHAVPSQRPTFKQLVEDLDRILTLTTNEVKATQEENRELRSRCEELHGKNLELGKIMDRFEEVVYQAMEEVQKQKELSKAEIQKVLKEKDQLTTDLNSMEKSFSDLFKRFEKQKEVIEGYRKNEESLKKCVEDYLARITQEGQRYQALKAHAEEKLQLANEEIAQVRSKAQAEALALQASLRKEQMRIQSLEKTVEQKTKENEELTRICDDLISKMEKI

SEQ ID NO: 99 - DNA, 3708 bp, Homo sapiens
aatttgttgaggaatttccccctagccttgaccccttgacagctcccgctcctactcagtgctggggagaagtagggaggccttaagcgaagagatgggtctgcactttggaggagccggacactgttgactttcctgatgtgaaatctacccaggaacaaaacaccagtgactgcagcagcagcggcagcgcctcggttcctgagcccaccgcaggctgaaggcattgcgcgtagtccatgcccgtagaggaagtgtgcagatgggattaacgtccacatggagatatggaagaggaccggggattggtaccgtaaccatggtcagctggggtcgtttcatctgcctggtcgtggtcaccatggcaaccttgtccctggcccggccctccttcagtttagttgaggataccacattagagccagaagatgccatctcatccggagatgatgaggatgacaccgatggtgcggaagattttgtcagtgagaacagtaacaacaagagagcaccatactggaccaacacagaaaagatggaaaagcggctccatgctgtgcctgcggccaacactgtcaagtttcgctgcccagccggggggaacccaatgccaaccatgcggtggctgaaaaacgggaaggagtttaagcaggagcatcgcattggaggctacaaggtacgaaaccagcactggagcctcattatggaaagtgtggtcccatctgacaagggaaattatacctgtgtagtggagaatgaatacgggtccatcaatcacacgtaccacctggatgttgtggagcgatcgcctcaccggcccatcctccaagccggactgccggcaaatgcctccacagtggtcggaggagacgtagagtttgtctgcaaggtttacagtgatgcccagccccacatccagtggatcaagcacgtggaaaagaacggcagtaaatacgggcccgacgggctgccctacctcaaggttctcaaggccgccggtgttaacaccacggacaaagagattgaggttctctatattcggaatgtaacttttgaggacgctggggaatatacgtgcttggcgggtaattctattgggatatcctttcactctgcatggttgacagttctgccagcgcctggaagagaaaaggagattacagcttccccagactacctggagatagccatttactgcataggggtcttcttaatcgcctgtatggtggtaacagtcatcctgtgccgaatgaagaacacgaccaagaagccagacttcagcagccagccggctgtgcacaagctgaccaaacgtatccccctgcggagacaggtaacagtttcggctgagtccagctcctccatgaactccaacaccccgctggtgaggataacaacacgcctctcttcaacggcagacacccccatgctggcaggggtctccgagtatgaacttccagaggacccaaaatgggagtttccaagagataagctgacactgggcaagcccctgggagaaggttgctttgggcaagtggtcatggcggaagcagtgggaattgacaaagacaagcccaaggaggcggtcaccgtggccgtgaagatgttgaaagatgatgccacagagaaagacctttctgatctggtgtcagagatggagatgatgaagatgattgggaaacacaagaatatcataaatcttcttggagcctgcacacaggatgggcctctctatgtcatagttgagtatgcctctaaaggcaacctccgagaatacctccgagcccggaggccacccgggatggagtactcctatgacattaaccgtgttcctgaggagcagatgaccttcaaggacttggtgtcatgcacctaccagctggccagaggcatggagtacttggcttcccaaaaatgtattcatcgagatttagcagccagaaatgttttggtaacagaaaacaatgtgatgaaaatagcagactttggactcgccagagatatcaacaatatagactattacaaaaagaccaccaatgggcggcttccagtcaagtggatggctccagaagccctgtttgatagagtatacactcatcagagtgatgtctggtccttcggggtgttaatgtgggagatcttcactttagggggctcgccctacccagggattcccgtggaggaactttttaagctgctgaaggaaggacacagaatggataagccagccaactgcaccaacgaactgtacatgatgatgagggactgttggcatgcagtgccctcccagagaccaacgttcaagcagttggtagaagacttggatcgaattctcactctcacaaccaatgaggaggagaagaaggtttctggagcagtggactgccacaagccaccatgtaacccctctcacctgccgtgcgtactggctgtggaccagtaggactcaaggtggacgtgcgttctgccttccttgttaattttgtaataattggagaagatttatgtcagcacacacttacagagcacaaatgcagtatataggtgctggatgtatgtaaatatattcaaattatgtataaatatatattatatatttacaaggagttattttttgtattgattttaaatggatgtcccaatgcacctagaaaattggtctctctttttttaatagctatttgctaaatgctgttcttacacataatttcttaattttcaccgagcagaggtggaaaaatacttttgctttcagggaaaatggtataacgttaatttattaataaattggtaatatacaaaacaattaatcatttatagttttttttgtaatttaagtggcatttctatgcaggcagcacagcagactagttaatctattgcttggacttaactagttatcagatcctttgaaaagagaatatttacaatatatgactaatttggggaaaatgaagttttgatttatttgtgtttaaatgctgctgtcagacgattgttcttagacctcctaaatgccccatattaaaagaactcattcataggaaggtgtttcattttggtgtgcaaccctgtcattacgtcaacgcaacgtctaactggacttcccaagataaatggtaccagcgtcctcttaaaagatgccttaatccattccttgaggacagaccttagttgaaatgatagcagaatgtgcttctctctggcagctggccttctgcttctgagttgcacattaatcagattagcctgtattctcttcagtgaattttgataatggcttccagactctttggcgttggagacgcctgttaggatcttcaagtcccatcatagaaaattgaaacacagagttgttctgctgatagttttggggatacgtccatctttttaagggattgctttcatctaattctggcaggacctcaccaaaagatccagcctcatacctacatcagacaaaatatcgccgttgttccttctgtactaaagtattgtgttttgctttggaaacacccactcactttgcaatagccgtgcaagatgaatgcagattacactgatcttatgtgttacaaaattggagaaagtatttaataaaacctgttaatttttatactgacaataaaaatgtttctacagatattaatgttaacaagacaaaataaatgtcacgcaacttatttttttaataaaaaaaaaaaaaaa

SEQ ID NO: 100 - protein, 707 aa, Homo sapiens
MVSWGRFICLVVVTMATLSLARPSFSLVEDTTLEPEDAISSGDDEDDTDGAEDFVSENSNNKRAPYWTNTEKMEKRLHAVPAANTVKFRCPAGGNPMPTMRWLKNGKEFKQEHRIGGYKVRNQHWSLIMESVVPSDKGNYTCVVENEYGSINHTYHLDVVERSPHRPILQAGLPANASTVVGGDVEFVCKVYSDAQPHIQWIKHVEKNGSKYGPDGLPYLKVLKAAGVNTTDKEIEVLYIRNVTFEDAGEYTCLAGNSIGISFHSAWLTVLPAPGREKEITASPDYLEIAIYCIGVFLIACMVVTVILCRMKNTTKKPDFSSQPAVHKLTKRIPLRRQVTVSAESSSSMNSNTPLVRITTRLSSTADTPMLAGVSEYELPEDPKWEFPRDKLTLGKPLGEGCFGQVVMAEAVGIDKDKPKEAVTVAVKMLKDDATEKDLSDLVSEMEMMKMIGKHKNIINLLGACTQDGPLYVIVEYASKGNLREYLRARRPPGMEYSYDINRVPEEQMTFKDLVSCTYQLARGMEYLASQKCIHRDLAARNVLVTENNVMKIADFGLARDINNIDYYKKTTNGRLPVKWMAPEALFDRVYTHQSDVWSFGVLMWEIFTLGGSPYPGIPVEELFKLLKEGHRMDKPANCTNELYMMMRDCWHAVPSQRPTFKQLVEDLDRILTLTTNEEEKKVSGAVDCHKPPCNPSHLPCVLAVDQ

SEQ ID NO: 101 - DNA, 3396 bp, Artificial Sequence
  source: /note="Description of Artificial Sequence: Synthetic polynucleotide"
  CDS (1)..(3393)
atggtcagctggggtcgtttcatctgcctggtcgtggtcaccatggcaaccttgtccctggcccggccctccttcagtttagttgaggataccacattagagccagaagatgccatctcatccggagatgatgaggatgacaccgatggtgcggaagattttgtcagtgagaacagtaacaacaagagagcaccatactggaccaacacagaaaagatggaaaagcggctccatgctgtgcctgcggccaacactgtcaagtttcgctgcccagccggggggaacccaatgccaaccatgcggtggctgaaaaacgggaaggagtttaagcaggagcatcgcattggaggctacaaggtacgaaaccagcactggagcctcattatggaaagtgtggtcccatctgacaagggaaattatacctgtgtagtggagaatgaatacgggtccatcaatcacacgtaccacctggatgttgtggagcgatcgcctcaccggcccatcctccaagccggactgccggcaaatgcctccacagtggtcggaggagacgtagagtttgtctgcaaggtttacagtgatgcccagccccacatccagtggatcaagcacgtggaaaagaacggcagtaaatacgggcccgacgggctgccctacctcaaggttctcaaggccgccggtgttaacaccacggacaaagagattgaggttctctatattcggaatgtaacttttgaggacgctggggaatatacgtgcttggcgggtaattctattgggatatcctttcactctgcatggttgacagttctgccagcgcctggaagagaaaaggagattacagcttccccagactacctggagatagccatttactgcataggggtcttcttaatcgcctgtatggtggtaacagtcatcctgtgccgaatgaagaacacgaccaagaagccagacttcagcagccagccggctgtgcacaagctgaccaaacgtatccccctgcggagacaggtaacagtttcggctgagtccagctcctccatgaactccaacaccccgctggtgaggataacaacacgcctctcttcaacggcagacacccccatgctggcaggggtctccgagtatgaacttccagaggacccaaaatgggagtttccaagagataagctgacactgggcaagcccctgggagaaggttgctttgggcaagtggtcatggcggaagcagtgggaattgacaaagacaagcccaaggaggcggtcaccgtggccgtgaagatgttgaaagatgatgccacagagaaagacctttctgatctggtgtcagagatggagatgatgaagatgattgggaaacacaagaatatcataaatcttcttggagcctgcacacaggatgggcctctctatgtcatagttgagtatgcctctaaaggcaacctccgagaatacctccgagcccggaggccacccgggatggagtactcctatgacattaaccgtgttcctgaggagcagatgaccttcaaggacttggtgtcatgcacctaccagctggccagaggcatggagtacttggcttcccaaaaatgtattcatcgagatttagcagccagaaatgttttggtaacagaaaacaatgtgatgaaaatagcagactttggactcgccagagatatcaacaatatagactattacaaaaagaccaccaatgggcggcttccagtcaagtggatggctccagaagccctgtttgatagagtatacactcatcagagtgatgtctggtccttcggggtgttaatgtgggagatcttcactttagggggctcgccctacccagggattcccgtggaggaactttttaagctgctgaaggaaggacacagaatggataagccagccaactgcaccaacgaactgtacatgatgatgagggactgttggcatgcagtgccctcccagagaccaacgttcaagcagttggtagaagacttggatcgaattctcactctcacaaccaatgaggtaaataaagttaaacaagaaaagactgttttaaattcagaagttcttgaacagagaaaagtcttagaaaaatgcaatagagtgtccatgttagctgtagaagagtatgaggagatgcaagtaaacctggagctggagaaggaccttcgaaagaaagcagagtcatttgcacaagagatgttcattgagcaaaacaagctaaagagacaaagccaccttctgctgcagagctccatccctgatcagcagcttttgaaagctttagacgaaaatgcaaaactcacccagcaacttgaagaagagagaattcagcatcaacaaaaggtcaaagaattagaagagcaactagaaaatgaaacactccacaaagaaatacacaacctcaaacagcaactggagcttctagaggaagataaaaaggaattggaattgaaatatcagaattctgaagagaaagccagaaatttaaagcactctgttgatgaactccagaaacgagtgaaccagtctgagaattcagtacctccaccacctcctcctccaccaccacttccccctccacctcccaatcctatccgatccctcatgtccatgatccggaaacgatcccaccccagtggcagtggtgctaagaaagaaaaggcaactcaaccagaaacaactgaagaagtcacagatctaaagaggcaagcagttgaagagatgatggatagaattaaaaagggagttcatcttagacccgttaatcagacagccagaccgaagacaaagccagaatcttcgaaaggctgcgaaagtgcagtggatgaactaaaaggaatactggggacacttaacaaatccactagttcaagaagcttaaaatcccttgaccctgaaaacagtgaaactgagttagaaaggattttgcgtcgcagaaaggtgacagcagaagcagatagcagtagtccaactgggatattagccacctcagagtccaaatccatgccagtgttgggttctgtatccagtgtaacaaaaacagccttgaacaagaaaactctggaggcagaattcaacagcccgtcccccccaacacctgagccaggtgaagggccccgtaaattggaaggatgcacaagttccaaggttacgtttcagcctcccagtagcattggatgcaggaaaaaatacattgacggtgaaaaacaagccgaaccagttgtagttttagatcctgtttctacacatgaaccccaaaccaaagaccaggttgctgaaaaagatccaactcaacacaaggaggatgaaggcgaaattcaaccagaaaacaaagaagacagcattgaaaacgtgagagagacagacagctccaactgctga

SEQ ID NO: 102 - protein, 1131 aa, Artificial Sequence
  source: /note="Description of Artificial Sequence: Synthetic polypeptide"
MVSWGRFICLVVVTMATLSLARPSFSLVEDTTLEPEDAISSGDDEDDTDGAEDFVSENSNNKRAPYWTNTEKMEKRLHAVPAANTVKFRCPAGGNPMPTMRWLKNGKEFKQEHRIGGYKVRNQHWSLIMESVVPSDKGNYTCVVENEYGSINHTYHLDVVERSPHRPILQAGLPANASTVVGGDVEFVCKVYSDAQPHIQWIKHVEKNGSKYGPDGLPYLKVLKAAGVNTTDKEIEVLYIRNVTFEDAGEYTCLAGNSIGISFHSAWLTVLPAPGREKEITASPDYLEIAIYCIGVFLIACMVVTVILCRMKNTTKKPDFSSQPAVHKLTKRIPLRRQVTVSAESSSSMNSNTPLVRITTRLSSTADTPMLAGVSEYELPEDPKWEFPRDKLTLGKPLGEGCFGQVVMAEAVGIDKDKPKEAVTVAVKMLKDDATEKDLSDLVSEMEMMKMIGKHKNIINLLGACTQDGPLYVIVEYASKGNLREYLRARRPPGMEYSYDINRVPEEQMTFKDLVSCTYQLARGMEYLASQKCIHRDLAARNVLVTENNVMKIADFGLARDINNIDYYKKTTNGRLPVKWMAPEALFDRVYTHQSDVWSFGVLMWEIFTLGGSPYPGIPVEELFKLLKEGHRMDKPANCTNELYMMMRDCWHAVPSQRPTFKQLVEDLDRILTLTTNEVNKVKQEKTVLNSEVLEQRKVLEKCNRVSMLAVEEYEEMQVNLELEKDLRKKAESFAQEMFIEQNKLKRQSHLLLQSSIPDQQLLKALDENAKLTQQLEEERIQHQQKVKELEEQLENETLHKEIHNLKQQLELLEEDKKELELKYQNSEEKARNLKHSVDELQKRVNQSENSVPPPPPPPPPLPPPPPNPIRSLMSMIRKRSHPSGSGAKKEKATQPETTEEVTDLKRQAVEEMMDRIKKGVHLRPVNQTARPKTKPESSKGCESAVDELKGILGTLNKSTSSRSLKSLDPENSETELERILRRRKVTAEADSSSPTGILATSESKSMPVLGSVSSVTKTALNKKTLEAEFNSPSPPTPEPGEGPRKLEGCTSSKVTFQPPSSIGCRKKYIDGEKQAEPVVVLDPVSTHEPQTKDQVAEKDPTQHKEDEGEIQPENKEDSIENVRETDSSNC

SEQ ID NO: 103 - DNA, 5361 bp, Homo sapiens
attgcgtcccgctctacctctgtggttctttgggagcgacccccgggaagcgtccaaagtggagttcccacacacgctgcgaacccacagccggttttctctgaactcgcgtccctgagtccgggaggtggaggcggagaaaagggtgcggagcgaccccacgcagggccgccccccctcccaccagcgcgtcctgccgcgccggcagccacaggctggcatagcggctgccgacccgccctcgttcctccaccccctgaacgggactgctgggcccgccccgccccgcctgcaggtgaagcggccgcagccgccgagtaggtgcgtggggatgatctcactcgcgcgctccgcgccaggaggaggaggagcgggagcggatccaacttccgggtagtggagccgcaagccaccggcatcttgctttttcttccccctcctcctgtgtgccccgcgccgctccctctttcccttttattcccggccccacccgccaaaatgaacagctcggacgaagagaagcagctgcagctcattaccagtctgaaggagcaagcaataggcgaatatgaagaccttagagcagagaaccagaaaacaaaggagaagtgtgacaaaattaggcaagaacgagatgaagccgttaaaaaactggaagaatttcagaaaatttctcacatggtcatagaggaagttaatttcatgcagaaccatcttgaaatagagaagacttgtcgagaaagtgctgaagctttggcaacaaagctaaataaagaaaataaaacgttgaaaagaatcagcatgttgtacatggccaagctgggaccagatgtaataactgaagagataaacattgatgatgaagattcgactacagacacagacggtgccgccgagacttgtgtctcagtacagtgtcagaagcaaattaaagaacttcgagatcaaattgtatctgttcaggaggaaaagaagattttagccattgagctggaaaatctcaagagcaaactcgtagaagtaattgaagaagtaaataaagttaaacaagaaaagactgttttaaattcagaagttcttgaacagagaaaagtcttagaaaaatgcaatagagtgtccatgttagctgtagaagagtatgaggagatgcaagtaaacctggagctggagaaggaccttcgaaagaaagcagagtcatttgcacaagagatgttcattgagcaaaacaagctaaagagacaaagccaccttctgctgcagagctccatccctgatcagcagcttttgaaagctttagacgaaaatgcaaaactcacccagcaacttgaagaagagagaattcagcatcaacaaaaggtcaaagaattagaagagcaactagaaaatgaaacactccacaaagaaatacacaacctcaaacagcaactggagcttctagaggaagataaaaaggaattggaattgaaatatcagaattctgaagagaaagccagaaatttaaagcactctgttgatgaactccagaaacgagtgaaccagtctgagaattcagtacctccaccacctcctcctccaccaccacttccccctccacctcccaatcctatccgatccctcatgtccatgatccggaaacgatcccaccccagtggcagtggtgctaagaaagaaaaggcaactcaaccagaaacaactgaagaagtcacagatctaaagaggcaagcagttgaagagatgatggatagaattaaaaagggagttcatcttagacccgttaatcagacagccagaccgaagacaaagccagaatcttcgaaaggctgcgaaagtgcagtggatgaactaaaaggaatactggggacacttaacaaatccactagttcaagaagcttaaaatcccttgaccctgaaaacagtgaaactgagttagaaaggattttgcgtcgcagaaaggtgacagcagaagcagatagcagtagtccaactgggatattagccacctcagagtccaaatccatgccagtgttgggttctgtatccagtgtaacaaaaacagccttgaacaagaaaactctggaggcagaattcaacagcccgtcccccccaacacctgagccaggtgaagggccccgtaaattggaaggatgcacaagttccaaggttacgtttcagcctcccagtagcattggatgcaggaaaaaatacattgacggtgaaaaacaagccgaaccagttgtagttttagatcctgtttctacacatgaaccccaaaccaaagaccaggttgctgaaaaagatccaactcaacacaaggaggatgaaggcgaaattcaaccagaaaacaaagaagacagcattgaaaacgtgagagagacagacagctccaactgctgatccataaaccagaagcctgacatgtttggaagtccttttcaataagcacatgattagtgttgttatattggcaagggctgtagacattctgctctggtcactgtattcagaatacaggttcttttctggtgtcacttttgtaagtagcaactataaacataagtaagctgtttagcaaaacacacattcctagtaggttttggttttttgatctttataaagatgaggtttttttcctagttactgtattaagtatgacttcttttagaaggttacaaaaaaattcagatgttgatacctttttaggaaatgtgcataccactcatcaaatggaatgctgaaagtttgaggtgcttgtatataatcggataaacaaaactgatcaacccaatgtgattttaaaagcccccaaagaagcttctgttttgggtctgatcctcttgatggagaaactgcagcagcatggaaattgttgggtactgtggcatacaagttattttctacagtagactgagataaactgaaaactcaggagctggcatcaaactcgtagtcccatagtcagtgttaattacacacattgttaactattggatgaaaaatacatgctattgattgtgtccaaagcctcccgaggacctccgtggggatgctctggtagcctgaatacagaactgaggtgaaagtccaaaccttgaattttacagtagtaagttggtaaaccatgtgctctgtgctatgagttaattatgttttcccaaatactaatgtggcacaagtaccatattttatcagagttcttatgtacagtatggtgaagataagtgacaagcacacatttttcttgcttcactgctgttctatattacacaggtttgttgttgttttttttaaaaaagaaattaagcagtagttagtctctaaaaatacaatgtttcaggctaccacagtgaataaatagaaatgtaatcagggattaaaaaaaaaacttatgcagcttttcaaagttgattgtttcaaaattggtgtttatttaaaataagtggtaatgtacttgaatgcactttttatgacaatgattcagtaatggtaattttactattaaagaaagtgaaaggtttagttttgttagcatggctcagcatgtagctgtcaggtgtttttcacctaagggcaaaagaaaatgatagtaataattgcagtagttgtattgtattgtatttttgcacgtgtggtaagcataggcttgaagaggtgggtaggcaggtacatgtacttcctaaatttggagataattatctttctgtaagttcgttatgcttgactgtttccatgttctcccaataatgattttatagttacttatcactttactcatggagaattaaaacgtaatgtttttcaactgtatctttctttaactggataatactgctatatgatatgcttactacagactgcattaattcacgaaacgaattctgttatgctgtaatttgaactctcctcaccacaacttattaaaaaggcaccaatagtttcccattaagggtcagttgtggttattattaacgtttctggtttagttccccaagcttgacattctttaatagaaaattgtatatgatttgacaactttagtaatttttaatagtccctaagatggtttattgagttttctttcatgtttctttgtgctgtcttccttcttgcatctgtgatctgtctgccagcatgcaactcacacacatttaggaatataaaaatatgtacactgtctttccatatttcatcacaccatcacagaataatatggttatcaaaataccctcctttctagagtaagaagttgccctttgggtgaaatgtgttagctggactagggaacaattagtaacaggtattttgaaagtattcctgccttttttaagctgcttactttctctcactgtgattacaaagcattttaaattaatttgacatgaaggtatttgatggaagatattcactcacctttttctgcctacagtttttcccttttcactttggttttgagggggttttgcccctggctggggtgacactgtcaaccaaagcaagggatcccaaataggaagacataggagaaccgtgcttatatctgcaaggtatgttcatagctattgcacacacaaaacttacatacgtcctgcttacacaattttaagttggaaaagactgcatctttatgtttttgatttctctaaaaggttatttatgcttccttctgtttgggaaagataaattaagtcttgtgcgctatagaggattttttttctttaagaaaaacgaatgttgatgcattttatagcccgagtgaggaacagagatagaggtactttgtgccattgctattaaagaaaaagaaaatgtctctttttttttctggaagaataagattttaattaaagcacttgcacccttttgtatgtgagctggtctcaaacaaagtcctcacccacagcagtttcagcagctgaacagtcccatggaagttctgactggcaggcatcaacagggctattagcacccagcatagtttgccctgagtacggaggatggatgctttggctctaactactcaccaataattgctccttccttaccttctttgttaatggtaaactgctggaaatggagtagtacaggtaacaattatttttaattgtctttccagaccagtttttggttgtgtgttcagtaaatgatagtctgtatcacagccttcaagtctggattatttttctaaatgcatactctacctgttcagttacactcgttgtggaacaacattagcttatataccagtaagttgtcgagaatggataaccatctgtcattatcactgaccttcaaagactcatcaagcagtccctgcataaggattggagtggtttgaagtttctcttccaagcactaacatgtccc

SEQ ID NO: 104 - protein, 631 aa, Homo sapiens
MNSSDEEKQLQLITSLKEQAIGEYEDLRAENQKTKEKCDKIRQERDEAVKKLEEFQKISHMVIEEVNFMQNHLEIEKTCRESAEALATKLNKENKTLKRISMLYMAKLGPDVITEEINIDDEDSTTDTDGAAETCVSVQCQKQIKELRDQIVSVQEEKKILAIELENLKSKLVEVIEEVNKVKQEKTVLNSEVLEQRKVLEKCNRVSMLAVEEYEEMQVNLELEKDLRKKAESFAQEMFIEQNKLKRQSHLLLQSSIPDQQLLKALDENAKLTQQLEEERIQHQQKVKELEEQLENETLHKEIHNLKQQLELLEEDKKELELKYQNSEEKARNLKHSVDELQKRVNQSENSVPPPPPPPPPLPPPPPNPIRSLMSMIRKRSHPSGSGAKKEKATQPETTEEVTDLKRQAVEEMMDRIKKGVHLRPVNQTARPKTKPESSKGCESAVDELKGILGTLNKSTSSRSLKSLDPENSETELERILRRRKVTAEADSSSPTGILATSESKSMPVLGSVSSVTKTALNKKTLEAEFNSPSPPTPEPGEGPRKLEGCTSSKVTFQPPSSIGCRKKYIDGEKQAEPVVVLDPVSTHEPQTKDQVAEKDPTQHKEDEGEIQPENKEDSIENVRETDSSNC

SEQ ID NO: 105 - DNA, 327 bp, Artificial Sequence
  source: /note="Description of Artificial Sequence: Synthetic polynucleotide"
  CDS (1)..(324)
atggccgcccagggagagcccggctacctggcggcgcagtcggaccccggctccaacagcgagcgcagcaccgactccccagtgcccggctccgaggacgacttggtcgccggggcgaccctgcacagcccggagtggagcgaggagcgcttccgcgtggacaggaagaaacttgaggccatgttacaagctgctgctgaagggaaaggcagaagtggggaagacttttttcaaaaggaggagaagaaggtttctggagcagtggactgccacaagccaccatgtaacccctctcacctgccgtgcgtactggctgtggaccagtag

SEQ ID NO: 106 - protein, 108 aa, Artificial Sequence
  source: /note="Description of Artificial Sequence: Synthetic polypeptide"
MAAQGEPGYLAAQSDPGSNSERSTDSPVPGSEDDLVAGATLHSPEWSEERFRVDRKKLEAMLQAAAEGKGRSGEDFFQKEEKKVSGAVDCHKPPCNPSHLPCVLAVDQ

SEQ ID NO: 107 - DNA, 3119 bp, Homo sapiens
atggccgcccagggagagcccggctacctggcggcgcagtcggaccccggctccaacagcgagcgcagcaccgactccccagtgcccggctccgaggacgacttggtcgccggggcgaccctgcacagcccggagtggagcgaggagcgcttccgcgtggacaggaagaaacttgaggccatgttacaagctgctgctgaagggaaaggcagaagtggggaagacttttttcaaaagatcatggaggaaacaaatacgcagattgcttggccatcaaaactgaagatcggagccaaatccaagaaagatccccatattaaggtttctggaaagaaagaagatgttaaagaagccaaggaaatgatcatgtctgtcttagacacaaaaagcaatcgagtcacactgaagatggatgtttcacatacagaacattcacatgtaatcggcaaaggtggcaacaatattaaaaaagtgatggaagaaaccggatgccatatccactttccagattccaacaggaataaccaagcagaaaaaagcaaccaggtatctatagcgggacaaccagcaggagtagaatctgcccgagttagaattcgggagctgcttcctttggtgctgatgtttgagctaccaattgctggaattcttcaaccggttcctgatcctaattccccctctattcagcatatatcacaaacgtacaatatttcagtatcatttaaacagcgttcccgaatgtatggtgctactgtcatagtacgagggtctcagaataacactagtgctgtgaaggaaggaactgccatgctgttagaacatcttgctgggagcttagcatcagctattcctgtgagcacacaactagatattgcagctcaacatcatctctttatgatgggtcgaaatgggagcaacatcaaacatatcatgcagagaacaggtgctcagatccactttcctgatcccagtaatccacaaaagaaatctaccgtctacctccagggcaccattgagtctgtctgtcttgcaaggcaatatctcatgggttgtcttcctcttgtgttgatgtttgatatgaaggaagaaattgaagtagatccacaattcattgcgcagttgatggaacagcttgatgtcttcatcagtattaaaccaaagcccaaacagccaagcaagtctgtgattgtgaaaagtgttgagcgaaatgccttaaatatgtatgaagcaaggaaatgtctcctcggacttgaaagcagtggggttaccatagcaaccagtccatccccagcatcctgccctgccggcctggcatgtcccagcctggatatcttagcttcagcaggccttggactcactggactaggtcttttgggacccaccaccttatctctgaacacttcaacaaccccaaactcactcttgaatgctcttaatagctcagtcagtcctttgcaaagtccaagttctggtacacccagccccacattatgggcacccccacttgctaatacttcaagtgccacaggtttttctgctataccacaccttatgattccatctactgcccaagccacattaactaatattttgttgtctggagtgcccacctatgggcacacagctccatctccccctcctggcttgactcctgttgatgtccatatcaacagtatgcagaccgaaggcaaaaaaatctctgctgctttaaatggacatgcacagtctccagatataaaatatggtgcaatatccacttcatcacttggagaaaaagtgctgagtgcaaatcacggggatccgtccatccagacaagtgggtctgagcagacatctcccaaatcaagccccactgaaggttgtaatgatgcttttgttgaagtaggcatgcctcgaagtccttcccattctgggaatgctggtgacttgaaacagatgatgtgtccctccaaggtttcctgtgccaaaaggcagacagtggaactattgcaaggcacgaaaaactcacacttacacagcactgacaggttgctctcagaccctgaactgagtgctaccgaaagccctttggctgacaagaaggctccagggagtgagcgcgctgcagagagggcagcagctgcccagcaaaactccgaaagggcccaccttgctccacggtcatcatatgtcaacatgcaggcatttgactatgaacagaagaagctattagccaccaaagctatgttaaagaaaccagtggtgacggaggtcagaacgcccacaaatacctggagtggcctgggtttttctaaatccatgccagctgaaactatcaaggagttgagaagggccaatcatgtgtcctataagcccacaatgacaaccacttatgagggctcatccatgtccctttcacggtccaacagtcgtgagcacttgggaggtggaagcgaatctgataactggagagaccgaaatggaattggacctggaagtcatagtgaatttgcagcttctattggcagccctaagcgtaaacaaaacaaatcaacggaacactatctcagcagtagcaattacatggactgcatttcctcgctgacaggaagcaatggctgtaacttaaatagctctttcaaaggttctgacctccctgagctcttcagcaaactgggcctgggcaaatacacagatgttttccagcaacaagagatcgatcttcagacattcctcactctcacagatcaggatctgaaggagctgggaataactacttttggtgccaggaggaaaatgctgcttgcaatttcagaactaaataaaaaccgaagaaagctttttgaatcgccaaatgcacgcacctctttcctggaaggtggagcgagtggaaggctaccccgtcagtatcactcagacattgctagtgtcagtggccgctggtagcagcaccctcttggcacatgcccgctgactaactgtaaagtggacacaggagatgtatgaacagccttcacagcacaccatccttagcactctgggtgtctggtatcaggaccaaagcattttattcgcacctgtactttatggcaaaaaggaagaagagagagaagatgttcttatgatgtcatacagaacac

SEQ ID NO: 108 - protein, 974 aa, Homo sapiens
MAAQGEPGYLAAQSDPGSNSERSTDSPVPGSEDDLVAGATLHSPEWSEERFRVDRKKLEAMLQAAAEGKGRSGEDFFQKIMEETNTQIAWPSKLKIGAKSKKDPHIKVSGKKEDVKEAKEMIMSVLDTKSNRVTLKMDVSHTEHSHVIGKGGNNIKKVMEETGCHIHFPDSNRNNQAEKSNQVSIAGQPAGVESARVRIRELLPLVLMFELPIAGILQPVPDPNSPSIQHISQTYNISVSFKQRSRMYGATVIVRGSQNNTSAVKEGTAMLLEHLAGSLASAIPVSTQLDIAAQHHLFMMGRNGSNIKHIMQRTGAQIHFPDPSNPQKKSTVYLQGTIESVCLARQYLMGCLPLVLMFDMKEEIEVDPQFIAQLMEQLDVFISIKPKPKQPSKSVIVKSVERNALNMYEARKCLLGLESSGVTIATSPSPASCPAGLACPSLDILASAGLGLTGLGLLGPTTLSLNTSTTPNSLLNALNSSVSPLQSPSSGTPSPTLWAPPLANTSSATGFSAIPHLMIPSTAQATLTNILLSGVPTYGHTAPSPPPGLTPVDVHINSMQTEGKKISAALNGHAQSPDIKYGAISTSSLGEKVLSANHGDPSIQTSGSEQTSPKSSPTEGCNDAFVEVGMPRSPSHSGNAGDLKQMMCPSKVSCAKRQTVELLQGTKNSHLHSTDRLLSDPELSATESPLADKKAPGSERAAERAAAAQQNSERAHLAPRSSYVNMQAFDYEQKKLLATKAMLKKPVVTEVRTPTNTWSGLGFSKSMPAETIKELRRANHVSYKPTMTTTYEGSSMSLSRSNSREHLGGGSESDNWRDRNGIGPGSHSEFAASIGSPKRKQNKSTEHYLSSSNYMDCISSLTGSNGCNLNSSFKGSDLPELFSKLGLGKYTDVFQQQEIDLQTFLTLTDQDLKELGITTFGARRKMLLAISELNKNRRKLFESPNARTSFLEGGASGRLPRQYHSDIASVSGRW

SEQ ID NO: 109 - DNA, 4146 bp, Artificial Sequence
  source: /note="Description of Artificial Sequence: Synthetic polynucleotide"
  CDS (1)..(4143)
atgggcgcccctgcctgcgccctcgcgctctgcgtggccgtggccatcgtggccggcgcctcctcggagtccttggggacggagcagcgcgtcgtggggcgagcggcagaagtcccgggcccagagcccggccagcaggagcagttggtcttcggcagcggggatgctgtggagctgagctgtcccccgcccgggggtggtcccatggggcccactgtctgggtcaaggatggcacagggctggtgccctcggagcgtgtcctggtggggccccagcggctgcaggtgctgaatgcctcccacgaggactccggggcctacagctgccggcagcggctcacgcagcgcgtactgtgccacttcagtgtgcgggtgacagacgctccatcctcgggagatgacgaagacggggaggacgaggctgaggacacaggtgtggacacaggggccccttactggacacggcccgagcggatggacaagaagctgctggccgtgccggccgccaacaccgtccgcttccgctgcccagccgctggcaaccccactccctccatctcctggctgaagaacggcagggagttccgcggcgagcaccgcattggaggcatcaagctgcggcatcagcagtggagcctggtcatggaaagcgtggtgccctcggaccgcggcaactacacctgcgtcgtggagaacaagtttggcagcatccggcagacgtacacgctggacgtgctggagcgctccccgcaccggcccatcctgcaggcggggctgccggccaaccagacggcggtgctgggcagcgacgtggagttccactgcaaggtgtacagtgacgcacagccccacatccagtggctcaagcacgtggaggtgaatggcagcaaggtgggcccggacggcacaccctacgttaccgtgctcaagacggcgggcgctaacaccaccgacaaggagctagaggttctctccttgcacaacgtcacctttgaggacgccggggagtacacctgcctggcgggcaattctattgggttttctcatcactctgcgtggctggtggtgctgccagccgaggaggagctggtggaggctgacgaggcgggcagtgtgtatgcaggcatcctcagctacggggtgggcttcttcctgttcatcctggtggtggcggctgtgacgctctgccgcctgcgcagcccccccaagaaaggcctgggctcccccaccgtgcacaagatctcccgcttcccgctcaagcgacaggtgtccctggagtccaacgcgtccatgagctccaacacaccactggtgcgcatcgcaaggctgtcctcaggggagggccccacgctggccaatgtctccgagctcgagctgcctgccgaccccaaatgggagctgtctcgggcccggctgaccctgggcaagccccttggggagggctgcttcggccaggtggtcatggcggaggccatcggcattgacaaggaccgggccgccaagcctgtcaccgtagccgtgaagatgctgaaagacgatgccactgacaaggacctgtcggacctggtgtctgagatggagatgatgaagatgatcgggaaacacaaaaacatcatcaacctgctgggcgcctgcacgcagggcgggcccctgtacgtgctggtggagtacgcggccaagggtaacctgcgggagtttctgcgggcgcggcggcccccgggcctggactactccttcgacacctgcaagccgcccgaggagcagctcaccttcaaggacctggtgtcctgtgcctaccaggtggcccggggcatggagtacttggcctcccagaagtgcatccacagggacctggctgcccgcaatgtgctggtgaccgaggacaacgtgatgaagatcgcagacttcgggctggcccgggacgtgcacaacctcgactactacaagaagacaaccaacggccggctgcccgtgaagtggatggcgcctgaggccttgtttgaccgagtctacactcaccagagtgacgtctggtcctttggggtcctgctctgggagatcttcacgctggggggctccccgtaccccggcatccctgtggaggagctcttcaagctgctgaaggagggccaccgcatggacaagcccgccaactgcacacacgacctgtacatgatcatgcgggagtgctggcatgccgcgccctcccagaggcccaccttcaagcagctggtggaggacctggaccgtgtccttaccgtgacgtccaccgacatggatgagatcaaagggaaagaccgtgtgattctggccttggagaaggaacttggcgtgcaggctgggcagacccagaagctgcttctgcagaaagaggctttggatgagcagctggttcaggtcaaggaggccgagcggcaccacagtagtccaaagagagagctcccgcccgggatcggggacatggtggagctcatgggcgtccaggatcaacatatggacgagcgagatgtgaggcgatttcaactaaaaattgctgaactgaattcagtgatacggaagctggaagacagaaatacgctgttggcagatgagaggaatgaactgctgaaacgctcacgagagaccgaggttcagctgaagcccctggtggagaagaacaagcggatgaacaagaagaatgaggatctgttgcagagtatccagaggatggaggagaaaatcaagaacctcacgcgggaaaacgtggaaatgaaagaaaagctgtcagcgcaggcgtctctgaagcggcatacctccttgaatgacctcagcctgacgagggatgagcaggagatcgagttcctgaggctgcaggtgctggagcagcagcacgtcattgacgacctctcactggagagagaacggctgttgcgctccaaaaggcatcgagggaaaagtctgaaaccgcccaagaagcatgttgtggagacattttttggatttgatgaggagtctgtggactcagaaacgttgtccgaaacatcctacaacacagacaggacagacaggaccccagccacgcccgaagaagacttggacgatgccacagcccgagaggaggctgacctgcgcttctgccagctgacccgggagtaccaggccctgcaacgcgcctacgccctgctccaggagcaggtgggaggcacgctggacgctgagagggaggcccggactcgggagcagctacaagctgatctgctgaggtgtcaggccaaaatcgaagatttggagaagttactggttgagaagggacaggattccaagtgggttgaagagaagcagctgctcatcagaacaaaccaagacttgctggaaaagatttacagactggaaatggaagagaaccagctgaagaatgaaatgcaagacgccaaggatcagaacgagctgttagaattcagagtgctagaactcgaagagagagagaggaggtcgccagcatttaacctccaaatcaccaccttccccgagaaccacagcagcgctctccagctgttctgtcaccaggaaggagttaaggatgtgaatgtttctgaacttatgaagaaattagatatccttggcgataacgggaatttgagaaatgaagaacaggttgcaataatccaagctggaactgtgcttgccctgtgtgaaaagtggctgaagcaaatagaggggaccgaggccgccctgacccagaagatgctggacctggagaaggagaaggacctgttcagcaggcagaagggctacctggaagaggagctcgactaccggaagcaagcccttgaccaggcttacctgaaaatccaagacctggaggccacactgtacacagcgctgcagcaggagccggggcggagggccggtgaggcgctgagcgagggccagcgggaggacctgcaggctgctgtggaaaaggtgcgcaggcagatcctcaggcagagccgcgagttcgacagccagatcctgcgggagcgcatggagctgctgcagcaggcccagcagagaatccgagaactggaggacaaactggagtttcagaagcggcacctgaaagaactggaggaaaagtttttgttcctttttttgtttttctcactagcattcattctgtggccttga

SEQ ID NO: 110 - protein, 1381 aa, Artificial Sequence
  source: /note="Description of Artificial Sequence: Synthetic polypeptide"
MGAPACALALCVAVAIVAGASSESLGTEQRVVGRAAEVPGPEPGQQEQLVFGSGDAVELSCPPPGGGPMGPTVWVKDGTGLVPSERVLVGPQRLQVLNASHEDSGAYSCRQRLTQRVLCHFSVRVTDAPSSGDDEDGEDEAEDTGVDTGAPYWTRPERMDKKLLAVPAANTVRFRCPAAGNPTPSISWLKNGREFRGEHRIGGIKLRHQQWSLVMESVVPSDRGNYTCVVENKFGSIRQTYTLDVLERSPHRPILQAGLPANQTAVLGSDVEFHCKVYSDAQPHIQWLKHVEVNGSKVGPDGTPYVTVLKTAGANTTDKELEVLSLHNVTFEDAGEYTCLAGNSIGFSHHSAWLVVLPAEEELVEADEAGSVYAGILSYGVGFFLFILVVAAVTLCRLRSPPKKGLGSPTVHKISRFPLKRQVSLESNASMSSNTPLVRIARLSSGEGPTLANVSELELPADPKWELSRARLTLGKPLGEGCFGQVVMAEAIGIDKDRAAKPVTVAVKMLKDDATDKDLSDLVSEMEMMKMIGKHKNIINLLGACTQGGPLYVLVEYAAKGNLREFLRARRPPGLDYSFDTCKPPEEQLTFKDLVSCAYQVARGMEYLASQKCIHRDLAARNVLVTEDNVMKIADFGLARDVHNLDYYKKTTNGRLPVKWMAPEALFDRVYTHQSDVWSFGVLLWEIFTLGGSPYPGIPVEELFKLLKEGHRMDKPANCTHDLYMIMRECWHAAPSQRPTFKQLVEDLDRVLTVTSTDMDEIKGKDRVILALEKELGVQAGQTQKLLLQKEALDEQLVQVKEAERHHSSPKRELPPGIGDMVELMGVQDQHMDERDVRRFQLKIAELNSVIRKLEDRNTLLADERNELLKRSRETEVQLKPLVEKNKRMNKKNEDLLQSIQRMEEKIKNLTRENVEMKEKLSAQASLKRHTSLNDLSLTRDEQEIEFLRLQVLEQQHVIDDLSLERERLLRSKRHRGKSLKPPKKHVVETFFGFDEESVDSETLSETSYNTDRTDRTPATPEEDLDDATAREEADLRFCQLTREYQALQRAYALLQEQVGGTLDAEREARTREQLQADLLRCQAKIEDLEKLLVEKGQDSKWVEEKQLLIRTNQDLLEKIYRLEMEENQLKNEMQDAKDQNELLEFRVLELEERERRSPAFNLQITTFPENHSSALQLFCHQEGVKDVNVSELMKKLDILGDNGNLRNEEQVAIIQAGTVLALCEKWLKQIEGTEAALTQKMLDLEKEKDLFSRQKGYLEEELDYRKQALDQAYLKIQDLEATLYTALQQEPGRRAGEALSEGQREDLQAAVEKVRRQILRQSREFDSQILRERMELLQQAQQRIRELEDKLEFQKRHLKELEEKFLFLFLFFSLAFILWP

SEQ ID NO: 111 - DNA, 3011 bp, Homo sapiens
ggtgccgtgcctgagccgggcgcgggcgaccgagggagctgcagccacccgcgtgcggcacgcgccggccgcctgcccggatcgcggccaccagtgccgcggcctctcgactcccgccccgccgagccgcgcgcgcgactgccatcctcctcaattgctttttacgattttttttgtgcatgcattcattttctgttccgttttgtcctttttaaggcggtggcggcggcgacagcggcgtaagctcgcagcggggagggggcggccggaggatgcggcgcggggctgcgctcgctacgtccgctgctgctgcccggctcgggcctgagcgccgagcaggatcccaagtgatggtggtttcctcggagggcgagctgagtcctgcgcgactggttagcacggtggagctggtagccacgcctgctggctggcgtgcgtgaacaggtgtggaccgcaggatctcagcactctgacccaaggggaagcatgtcgaagaaaggccggagcaagggcgagaagcccgagatggagacggacgcggtgcagatggccaacgaggagctgcgggccaagctgaccagcattcagatcgagttccagcaggaaaaaagcaaggtgggcaaactgcgcgagcggctgcaggaggcgaagctggagcgcgagcaggagcagcgacggcacacggcctacatttcggagctcaaggccaagctgcatgaggagaagaccaaggagctgcaggcgctgcgcgaggggctcatccggcagcacgagcaggaggcggcgcgcaccgccaagatcaaggagggcgagctgcagcggctgcaggccacgctgaacgtgctgcgcgacggcgcggccgacaaggtcaagacggcgctgctgaccgaggcgcgcgaggaggcgcgcagggccttcgatggagagcgcctgcggctgcagcaggagatcctggagctcaaggcagcgcgcaagcaggcagaggaggcgctcagtaactgcatgcaggctgacaagaccaaggcagccgacctgcgtgccgcctaccaggcgcaccaagacgaggtgcaccgcatcaagcgcgagtgcgagcgcgacatccgcaggctgatggatgagatcaaagggaaagaccgtgtgattctggccttggagaaggaacttggcgtgcaggctgggcagacccagaagctgcttctgcagaaagaggctttggatgagcagctggttcaggtcaaggaggccgagcggcaccacagtagtccaaagagagagctcccgcccgggatcggggacatggtggagctcatgggcgtccaggatcaacatatggacgagcgagatgtgaggcgatttcaactaaaaattgctgaactgaattcagtgatacggaagctggaagacagaaatacgctgttggcagatgagaggaatgaactgctgaaacgctcacgagagaccgaggttcagctgaagcccctggtggagaagaacaagcggatgaacaagaagaatgaggatctgttgcagagtatccagaggatggaggagaaaatcaagaacctcacgcgggaaaacgtggaaatgaaagaaaagctgtcagcgcaggcgtctctgaagcggcatacctccttgaatgacctcagcctgacgagggatgagcaggagatcgagttcctgaggctgcaggtgctggagcagcagcacgtcattgacgacctctcactggagagagaacggctgttgcgctccaaaaggcatcgagggaaaagtctgaaaccgcccaagaagcatgttgtggagacattttttggatttgatgaggagtctgtggactcagaaacgttgtccgaaacatcctacaacacagacaggacagacaggaccccagccacgcccgaagaagacttggacgatgccacagcccgagaggaggctgacctgcgcttctgccagctgacccgggagtaccaggccctgcaacgcgcctacgccctgctccaggagcaggtgggaggcacgctggacgctgagagggaggcccggactcgggagcagctacaagctgatctgctgaggtgtcaggccaaaatcgaagatttggagaagttactggttgagaagggacaggattccaagtgggttgaagagaagcagctgctcatcagaacaaaccaagacttgctggaaaagatttacagactggaaatggaagagaaccagctgaagaatgaaatgcaagacgccaaggatcagaacgagctgttagaattcagagtgctagaactcgaagagagagagaggaggtcgccagcatttaacctccaaatcaccaccttccccgagaaccacagcagcgctctccagctgttctgtcaccaggaaggagttaaggatgtgaatgtttctgaacttatgaagaaattagatatccttggcgataacgggaatttgagaaatgaagaacaggttgcaataatccaagctggaactgtgcttgccctgtgtgaaaagtggctgaagcaaatagaggggaccgaggccgccctgacccagaagatgctggacctggagaaggagaaggacctgttcagcaggcagaagggctacctggaagaggagctcgactaccggaagcaagcccttgaccaggcttacctgaaaatccaagacctggaggccacactgtacacagcgctgcagcaggagccggggcggagggccggtgaggcgctgagcgagggccagcgggaggacctgcaggctgctgtggaaaaggtgcgcaggcagatcctcaggcagagccgcgagttcgacagccagatcctgcgggagcgcatggagctgctgcagcaggcccagcagagaatccgagaactggaggacaaactggagtttcagaagcggcacctgaaagaactggaggaaaagtttttgttcctttttttgtttttctcactagcattcattctgtggccttgatgacttcagtgagccaagaactcgggttg

SEQ ID NO: 112 - protein, 831 aa, Homo sapiens
MSKKGRSKGEKPEMETDAVQMANEELRAKLTSIQIEFQQEKSKVGKLRERLQEAKLEREQEQRRHTAYISELKAKLHEEKTKELQALREGLIRQHEQEAARTAKIKEGELQRLQATLNVLRDGAADKVKTALLTEAREEARRAFDGERLRLQQEILELKAARKQAEEALSNCMQADKTKAADLRAAYQAHQDEVHRIKRECERDIRRLMDEIKGKDRVILALEKELGVQAGQTQKLLLQKEALDEQLVQVKEAERHHSSPKRELPPGIGDMVELMGVQDQHMDERDVRRFQLKIAELNSVIRKLEDRNTLLADERNELLKRSRETEVQLKPLVEKNKRMNKKNEDLLQSIQRMEEKIKNLTRENVEMKEKLSAQASLKRHTSLNDLSLTRDEQEIEFLRLQVLEQQHVIDDLSLERERLLRSKRHRGKSLKPPKKHVVETFFGFDEESVDSETLSETSYNTDRTDRTPATPEEDLDDATAREEADLRFCQLTREYQALQRAYALLQEQVGGTLDAEREARTREQLQADLLRCQAKIEDLEKLLVEKGQDSKWVEEKQLLIRTNQDLLEKIYRLEMEENQLKNEMQDAKDQNELLEFRVLELEERERRSPAFNLQITTFPENHSSALQLFCHQEGVKDVNVSELMKKLDILGDNGNLRNEEQVAIIQAGTVLALCEKWLKQIEGTEAALTQKMLDLEKEKDLFSRQKGYLEEELDYRKQALDQAYLKIQDLEATLYTALQQEPGRRAGEALSEGQREDLQAAVEKVRRQILRQSREFDSQILRERMELLQQAQQRIRELEDKLEFQKRHLKELEEKFLFLFLFFSLAFILWP

SEQ ID NO: 113 - DNA, 6837 bp, Artificial Sequence
  source: /note="Description of Artificial Sequence: Synthetic polynucleotide"
  CDS (1)..(6834)
atgaggctgctgaccctcctgggccttctgtgtggctcggtggccacccccttgggcccgaagtggcctgaacctgtgttcgggcgcctggcatcccccggctttccaggggagtatgccaatgaccaggagcggcgctggaccctgactgcaccccccggctaccgcctgcgcctctacttcacccacttcgacctggagctctcccacctctgcgagtacgacttcgtcaagctgagctcgggggccaaggtgctggccacgctgtgcgggcaggagagcacagacacggagcgggcccctggcaaggacactttctactcgctgggctccagcctggacattaccttccgctccgactactccaacgagaagccgttcacggggttcgaggccttctatgcagccgaggatacccagtatctccaagataccatgaaccatgtcctaagctgtgtcaagaaggagaaggaacgtacagcggccttccaagccctggggctactttctgtggctgtgaggtctgagtttaaggtctatttgcctcgcgtgctggacatcatccgagcggccctgcccccaaaggacttcgcccataagaggcagaaggcaatgcaggtggatgccacagtcttcacttgcatcagcatgctggctcgagcaatggggccaggcatccagcaggatatcaaggagctgctggagcccatgctggcagtgggactaagccctgccctcactgcagtgctctacgacctgagccgtcagattccacagctaaagaaggacattcaagatgggctactgaaaatgctgtccctggtccttatgcacaaaccccttcgccacccaggcatgcccaagggcctggcccatcagctggcctctcctggcctcacgaccctccctgaggccagcgatgtgggcagcatcactcttgccctccgaacgcttggcagctttgaatttgaaggccactctctgacccaatttgttcgccactgtgcggatcatttcctgaacagtgagcacaaggagatccgcatggaggctgcccgcacctgctcccgcctgctcacaccctccatccacctcatcagtggccatgctcatgtggttagccagaccgcagtgcaagtggtggcagatgtgcttagcaaactgctcgtagttgggataacagatcctgaccctgacattcgctactgtgtcttggcgtccctggacgagcgctttgatgcacacctggcccaggcggagaacttgcaggccttgtttgtggctctgaatgaccaggtgtttgagatccgggagctggccatctgcactgtgggccgactcagtagcatgaaccctgcctttgtcatgcctttcctgcgcaagatgctcatccagattttgacagagttggagcacagtgggattggaagaatcaaagagcagagtgcccgcatgctggggcacctggtctccaatgccccccgactcatccgcccctacatggagcctattctgaaggcattaattttgaaactgaaagatccagaccctgatccaaacccaggtgtgatcaataatgtcctggcaacaataggagaattggcacaggttagtggcctggaaatgaggaaatgggttgatgaactttttattatcatcatggacatgctccaggattcctctttgttggccaaaaggcaggtggctctgtggaccctgggacagttggtggccagcactggctatgtagtagagccctacaggaagtaccctactttgcttgaggtgctactgaattttctgaagactgagcagaaccagggtacacgcagagaggccatccgtgtgttagggcttttaggggctttggatccttacaagcacaaagtgaacattggcatgatagaccagtcccgggatgcctctgctgtcagcctgtcagaatccaagtcaagtcaggattcctctgactatagcactagtgaaatgctggtcaacatgggaaacttgcctctggatgagttctacccagctgtgtccatggtggccctgatgcggatcttccgagaccagtcactctctcatcatcacaccatggttgtccaggccatcaccttcatcttcaagtccctgggactcaaatgtgtgcagttcctgccccaggtcatgcccacgttccttaacgtcattcgagtctgtgatggggccatccgggaatttttgttccagcagctgggaatgttggtgtcctttgtgaagagccacatcagaccttatatggatgaaatagtcaccctcatgagagaattctgggtcatgaacacctcaattcagagcacgatcattcttctcattgagcaaattgtggtagctcttgggggtgaatttaagctctacctgccccagctgatcccacacatgctgcgtgtcttcatgcatgacaacagcccaggccgcattgtctctatcaagttactggctgcaatccagctgtttggcgccaacctggatgactacctgcatttactgctgcctcctattgttaagttgtttgatgcccctgaagctccactgccatctcgaaaggcagcgctagagactgtggaccgcctgacggagtccctggatttcactgactatgcctcccggatcattcaccctattgttcgaacactggaccagagcccagaactgcgctccacagccatggacacgctgtcttcacttgtttttcagctggggaagaagtaccaaattttcattccaatggtgaataaagttctggtgcgacaccgaatcaatcatcagcgctatgatgtgctcatctgcagaattgtcaagggatacacacttgctgatgaagaggaggatcctttgatttaccagcatcggatgcttaggagtggccaaggggatgcattggctagtggaccagtggaaacaggacccatgaagaaactgcacgtcagcaccatcaacctccaaaaggcctggggcgctgccaggagggtctccaaagatgactggctggaatggctgagacggctgagcctggagctgctgaaggactcatcatcgccctccctgcgctcctgctgggccctggcacaggcctacaacccgatggccagggatctcttcaatgctgcatttgtgtcctgctggtctgaactgaatgaagatcaacaggatgagctcatcagaagcatcgagttggccctcacctcacaagacatcgctgaagtcacacagaccctcttaaacttggctgaattcatggaacacagtgacaagggccccctgccactgagagatgacaatggcattgttctgctgggtgagagagctgccaagtgccgagcatatgccaaagcactacactacaaagaactggagttccagaaaggccccacccctgccattctagaatctctcatcagcattaataataagctacagcagccggaggcagcggccggagtgttagaatatgccatgaaacactttggagagctggagatccaggctacctggtatgagaaactgcacgagtgggaggatgcccttgtggcctatgacaagaaaatggacaccaacaaggacgacccagagctgatgctgggccgcatgcgctgcctcgaggccttgggggaatggggtcaactccaccagcagtgctgtgaaaagtggaccctggttaatgatgagacccaagccaagatggcccggatggctgctgcagctgcatggggtttaggtcagtgggacagcatggaagaatacacctgtatgatccctcgggacacccatgatggggcattttatagagctgtgctggcactgcatcaggacctcttctccttggcacaacagtgcattgacaaggccagggacctgctggatgctgaattaactgcgatggcaggagagagttacagtcgggcatatggggccatggtttcttgccacatgctgtccgagctggaggaggttatccagtacaaacttgtccccgagcgacgagagatcatccgccagatctggtgggagagactgcagggctgccagcgtatcgtagaggactggcagaaaatccttatggtgcggtcccttgtggtcagccctcatgaagacatgagaacctggctcaagtatgcaagcctgtgcggcaagagtggcaggctggctcttgctcataaaactttagtgttgctcctgggagttgatccgtctcggcaacttgaccatcctctgccaacagttcaccctcaggtgacctatgcctacatgaaaaacatgtggaagagtgcccgcaagatcgatgccttccagcacatgcagcattttgtccagaccatgcagcaacaggcccagcatgccatcgctactgaggaccagcagcataagcaggaactgcacaagctcatggcccgatgcttcctgaaacttggagagtggcagctgaatctacagggcatcaatgagagcacaatccccaaagtgctgcagtactacagcgccgccacagagcacgaccgcagctggtacaaggcctggcatgcgtgggcagtgatgaacttcgaagctgtgctacactacaaacatcagaaccaagcccgcgatgagaagaagaaactgcgtcatgccagcggggccaacatcaccaacgccaccactgccgccaccacggccgccactgccaccaccactgccagcaccgagggcagcaacagtgagagcgaggccgagagcaccgagaacagccccaccccatcgccgctgcagaagaaggtcactgaggatctgtccaaaaccctcctgatgtacacggtgcctgccgtccagggcttcttccgttccatctccttgtcacgaggcaacaacctccaggatacactcagagttctcaccttatggtttgattatggtcactggccagatgtcaatgaggccttagtggagggggtgaaagccatccagattgatacctggctacaggttatacctcagctcattgcaagaattgatacgcccagacccttggtgggacgtctcattcaccagcttctcacagacattggtcggtaccacccccaggccctcatctacccactgacagtggcttctaagtctaccacgacagcccggcacaatgcagccaacaagattctgaagaacatgtgtgagcacagcaacaccctggtccagcaggccatgatggtgagcgaggagctgatccgagtggccatcctctggcatgagatgtggcatgaaggcctggaagaggcatctcgtttgtactttggggaaaggaacgtgaaaggcatgtttgaggtgctggagcccttgcatgctatgatggaacggggcccccagactctgaaggaaacatcctttaatcaggcctatggtcgagatttaatggaggcccaagagtggtgcaggaagtacatgaaatcagggaatgtcaaggacctcacccaagcctgggacctctattatcatgtgttccgacgaatctcaaagcagctgcctcagctcacatccttagagctgcaatatgtttccccaaaacttctgatgtgccgggaccttgaattggctgtgccaggaacatatgaccccaaccagccaatcattcgcattcagtccatagcaccgtctttgcaagtcatcacatccaagcagaggccccggaaattgacacttatgggcagcaacggacatgagtttgttttccttctaaaaggccatgaagatctgcgccaggatgagcgtgtgatgcagctcttcggcctggttaacacccttctggccaatgacccaacatctcttcggaaaaacctcagcatccagagatacgctgtcatccctttatcgaccaactcgggcctcattggctgggttccccactgtgacacactgcacgccctcatccgggactacagggagaagaagaagatccttctcaacatcgagcatcgcatcatgttgcggatggctccggactatgaccacttgactctgatgcagaaggtggaggtgtttgagcatgccgtcaataatacagctggggacgacctggccaagctgctgtggctgaaaagccccagctccgaggtgtggtttgaccgaagaaccaattatacccgttctttagcggtcatgtcaatggttgggtatattttaggcctgggagatagacacccatccaacctgatgctggaccgtctgagtgggaagatcctgcacattgactttggggactgctttgaggttgctatgacccgagagaagtttccagagaagattccatttagactaacaagaatgttgaccaatgctatggaggttacaggcctggatggcaactacagaatcacatgccacacagtgatggaggtgctgcgagagcacaaggacagtgtcatggccgtgctggaagcctttgtctatgaccccttgctgaactggaggctgatggacacaaataccaaaggcaacaagcgatcccgaacgaggacggattcctactctgctggccagtcagtcgaaattttggacggtgtggaacttggagagccagcccataagaaaacggggaccacagtgccagaatctattcattctttcattggagacggtttggtgaaaccagaggccctaaataagaaagctatccagattattaacagggttcgagataagctcactggtcgggacttctctcatgatgacactttggatgttccaacgcaagttgagctgctcatcaaacaagcgacatcccatgaaaacctctgccagtgctatattggctggtgccctttctggtaa

SEQ ID NO: 114 - protein, 2278 aa, Artificial Sequence
  source: /note="Description of Artificial Sequence: Synthetic polypeptide"
MRLLTLLGLLCGSVATPLGPKWPEPVFGRLASPGFPGEYANDQERRWTLTAPPGYRLRLYFTHFDLELSHLCEYDFVKLSSGAKVLATLCGQESTDTERAPGKDTFYSLGSSLDITFRSDYSNEKPFTGFEAFYAAEDTQYLQDTMNHVLSCVKKEKERTAAFQALGLLSVAVRSEFKVYLPRVLDIIRAALPPKDFAHKRQKAMQVDATVFTCISMLARAMGPGIQQDIKELLEPMLAVGLSPALTAVLYDLSRQIPQLKKDIQDGLLKMLSLVLMHKPLRHPGMPKGLAHQLASPGLTTLPEASDVGSITLALRTLGSFEFEGHSLTQFVRHCADHFLNSEHKEIRMEAARTCSRLLTPSIHLISGHAHVVSQTAVQVVADVLSKLLVVGITDPDPDIRYCVLASLDERFDAHLAQAENLQALFVALNDQVFEIRELAICTVGRLSSMNPAFVMPFLRKMLIQILTELEHSGIGRIKEQSARMLGHLVSNAPRLIRPYMEPILKALILKLKDPDPDPNPGVINNVLATIGELAQVSGLEMRKWVDELFIIIMDMLQDSSLLAKRQVALWTLGQLVASTGYVVEPYRKYPTLLEVLLNFLKTEQNQGTRREAIRVLGLLGALDPYKHKVNIGMIDQSRDASAVSLSESKSSQDSSDYSTSEMLVNMGNLPLDEFYPAVSMVALMRIFRDQSLSHHHTMVVQAITFIFKSLGLKCVQFLPQVMPTFLNVIRVCDGAIREFLFQQLGMLVSFVKSHIRPYMDEIVTLMREFWVMNTSIQSTIILLIEQIVVALGGEFKLYLPQLIPHMLRVFMHDNSPGRIVSIKLLAAIQLFGANLDDYLHLLLPPIVKLFDAPEAPLPSRKAALETVDRLTESLDFTDYASRIIHPIVRTLDQSPELRSTAMDTLSSLVFQLGKKYQIFIPMVNKVLVRHRINHQRYDVLICRIVKGYTLADEEEDPLIYQHRMLRSGQGDALASGPVETGPMKKLHVSTINLQKAWGAARRVSKDDWLEWLRRLSLELLKDSSSPSLRSCWALAQAYNPMARDLFNAAFVSCWSELNEDQQDELIRSIELALTSQDIAEVTQTLLNLAEFMEHSDKGPLPLRDDNGIVLLGERAAKCRAYAKALHYKELEFQKGPTPAILESLISINNKLQQPEAAAGVLEYAMKHFGELEIQATWYEKLHEWEDALVAYDKKMDTNKDDPELMLGRMRCLEALGEWGQLHQQCCEKWTLVNDETQAKMARMAAAAAWGLGQWDSMEEYTCMIPRDTHDGAFYRAVLALHQDLFSLAQQCIDKARDLLDAELTAMAGESYSRAYGAMVSCHMLSELEEVIQYKLVPERREIIRQIWWERLQGCQRIVEDWQKILMVRSLVVSPHEDMRTWLKYASLCGKSGRLALAHKTLVLLLGVDPSRQLDHPLPTVHPQVTYAYMKNMWKSARKIDAFQHMQHFVQTMQQQAQHAIATEDQQHKQELHKLMARCFLKLGEWQLNLQGINESTIPKVLQYYSAATEHDRSWYKAWHAWAVMNFEAVLHYKHQNQARDEKKKLRHASGANITNATTAATTAATATTTASTEGSNSESEAESTENSPTPSPLQKKVTEDLSKTLLMYTVPAVQGFFRSISLSRGNNLQDTLRVLTLWFDYGHWPDVNEALVEGVKAIQIDTWLQVIPQLIARIDTPRPLVGRLIHQLLTDIGRYHPQALIYPLTVASKSTTTARHNAANKILKNMCEHSNTLVQQAMMVSEELIRVAILWHEMWHEGLEEASRLYFGERNVKGMFEVLEPLHAMMERGPQTLKETSFNQAYGRDLMEAQEWCRKYMKSGNVKDLTQAWDLYYHVFRRISKQLPQLTSLELQYVSPKLLMCRDLELAVPGTYDPNQPIIRIQSIAPSLQVITSKQRPRKLTLMGSNGHEFVFLLKGHEDLRQDERVMQLFGLVNTLLANDPTSLRKNLSIQRYAVIPLSTNSGLIGWVPHCDTLHALIRDYREKKKILLNIEHRIMLRMAPDYDHLTLMQKVEVFEHAVNNTAGDDLAKLLWLKSPSSEVWFDRRTNYTRSLAVMSMVGYILGLGDRHPSNLMLDRLSGKILHIDFGDCFEVAMTREKFPEKIPFRLTRMLTNAMEVTGLDGNYRITCHTVMEVLREHKDSVMAVLEAFVYDPLLNWRLMDTNTKGNKRSRTRTDSYSAGQSVEILDGVELGEPAHKKTGTTVPESIHSFIGDGLVKPEALNKKAIQIINRVRDKLTGRDFSHDDTLDVPTQVELLIKQATSHENLCQCYIGWCPFW

SEQ ID NO: 115 - DNA, 2471 bp, Homo sapiens
agaccaggccaggccagctggacgggcacaccatgaggctgctgaccctcctgggccttctgtgtggctcggtggccacccccttgggcccgaagtggcctgaacctgtgttcgggcgcctggcatcccccggctttccaggggagtatgccaatgaccaggagcggcgctggaccctgactgcaccccccggctaccgcctgcgcctctacttcacccacttcgacctggagctctcccacctctgcgagtacgacttcgtcaagctgagctcgggggccaaggtgctggccacgctgtgcgggcaggagagcacagacacggagcgggcccctggcaaggacactttctactcgctgggctccagcctggacattaccttccgctccgactactccaacgagaagccgttcacggggttcgaggccttctatgcagccgaggacattgacgagtgccaggtggccccgggagaggcgcccacctgcgaccaccactgccacaaccacctgggcggtttctactgctcctgccgcgcaggctacgtcctgcaccgtaacaagcgcacctgctcagccctgtgctccggccaggtcttcacccagaggtctggggagctcagcagccctgaatacccacggccgtatcccaaactctccagttgcacttacagcatcagcctggaggaggggttcagtgtcattctggactttgtggagtccttcgatgtggagacacaccctgaaaccctgtgtccctacgactttctcaagattcaaacagacagagaagaacatggcccattctgtgggaagacattgccccacaggattgaaacaaaaagcaacacggtgaccatcacctttgtcacagatgaatcaggagaccacacaggctggaagatccactacacgagcacagcgcagccttgcccttatccgatggcgccacctaatggccacgtttcacctgtgcaagccaaatacatcctgaaagacagcttctccatcttttgcgagactggctatgagcttctgcaaggtcacttgcccctgaaatcctttactgcagtttgtcagaaagatggatcttgggaccggccaatgcccgcgtgcagcattgttgactgtggccctcctgatgatctacccagtggccgagtggagtacatcacaggtcctggagtgaccacctacaaagctgtgattcagtacagctgtgaagagaccttctacacaatgaaagtgaatgatggtaaatatgtgtgtgaggctgatggattctggacgagctccaaaggagaaaaatcactcccagtctgtgagcctgtttgtggactatcagcccgcacaacaggagggcgtatatatggagggcaaaaggcaaaacctggtgattttccttggcaagtcctgatattaggtggaaccacagcagcaggtgcacttttatatgacaactgggtcctaacagctgctcatgccgtctatgagcaaaaacatgatgcatccgccctggacattcgaatgggcaccctgaaaagactatcacctcattatacacaagcctggtctgaagctgtttttatacatgaaggttatactcatgatgctggctttgacaatgacatagcactgattaaattgaataacaaagttgtaatcaatagcaacatcacgcctatttgtctgccaagaaaagaagctgaatcctttatgaggacagatgacattggaactgcatctggatggggattaacccaaaggggttttcttgctagaaatctaatgtatgtcgacataccgattgttgaccatcaaaaatgtactgctgcatatgaaaagccaccctatccaaggggaagtgtaactgctaacatgctttgtgctggcttagaaagtgggggcaaggacagctgcagaggtgacagcggaggggcactggtgtttctagatagtgaaacagagaggtggtttgtgggaggaatagtgtcctggggttccatgaattgtggggaagcaggtcagtatggagtctacacaaaagttattaactatattccctggatcgagaacataattagtgatttttaacttgcgtgtctgcagtcaaggattcttcatttttagaaatgcctgtgaagaccttggcagcgacgtggctcgagaagcattcatcattactgtggacatggcagttgttgctccacccaaaaaaacagactccaggtgaggctgctgtcatttctccacttgccagtttaattccagccttacccattgactcaaggggacataaaccacgagagtgacagtcatctttgcccacccagtgtaatgtcactgctcaaattacatttcattaccttaaaaagccagtctcttttcatactggctgttggcatttctgtaaactgcctgtccatgctctttgtttttaaacttgttcttattgaaaaaaaaaaaaaaaaa

SEQ ID NO: 116 - protein, 686 aa, Homo sapiens
MRLLTLLGLLCGSVATPLGPKWPEPVFGRLASPGFPGEYANDQERRWTLTAPPGYRLRLYFTHFDLELSHLCEYDFVKLSSGAKVLATLCGQESTDTERAPGKDTFYSLGSSLDITFRSDYSNEKPFTGFEAFYAAEDIDECQVAPGEAPTCDHHCHNHLGGFYCSCRAGYVLHRNKRTCSALCSGQVFTQRSGELSSPEYPRPYPKLSSCTYSISLEEGFSVILDFVESFDVETHPETLCPYDFLKIQTDREEHGPFCGKTLPHRIETKSNTVTITFVTDESGDHTGWKIHYTSTAQPCPYPMAPPNGHVSPVQAKYILKDSFSIFCETGYELLQGHLPLKSFTAVCQKDGSWDRPMPACSIVDCGPPDDLPSGRVEYITGPGVTTYKAVIQYSCEETFYTMKVNDGKYVCEADGFWTSSKGEKSLPVCEPVCGLSARTTGGRIYGGQKAKPGDFPWQVLILGGTTAAGALLYDNWVLTAAHAVYEQKHDASALDIRMGTLKRLSPHYTQAWSEAVFIHEGYTHDAGFDNDIALIKLNNKVVINSNITPICLPRKEAESFMRTDDIGTASGWGLTQRGFLARNLMYVDIPIVDHQKCTAAYEKPPYPRGSVTANMLCAGLESGGKDSCRGDSGGALVFLDSETERWFVGGIVSWGSMNCGEAGQYGVYTKVINYIPWIENIISDF

SEQ ID NO: 117 - DNA, 8733 bp, Homo sapiens
gctcccggcttagaggacagcggggaaggcgggcggtggggcagggggcctgaagcggcggtaccggtgctggcggcggcagctgaggccttggccgaagccgcgcgaacctcagggcaagatgcttggaaccggacctgccgccgccaccaccgctgccaccacatctagcaatgtgagcgtcctgcagcagtttgccagtggcctaaagagccggaatgaggaaaccagggccaaagccgccaaggagctccagcactatgtcaccatggaactccgagagatgagtcaagaggagtctactcgcttctatgaccaactgaaccatcacatttttgaattggtttccagctcagatgccaatgagaggaaaggtggcatcttggccatagctagcctcataggagtggaaggtgggaatgccacccgaattggcagatttgccaactatcttcggaacctcctcccctccaatgacccagttgtcatggaaatggcatccaaggccattggccgtcttgccatggcaggggacacttttaccgctgagtacgtggaatttgaggtgaagcgagccctggaatggctgggtgctgaccgcaatgagggccggagacatgcagctgtcctggttctccgtgagctggccatcagcgtccctaccttcttcttccagcaagtgcaacccttctttgacaacatttttgtggccgtgtgggaccccaaacaggccatccgtgagggagctgtagccgcccttcgtgcctgtctgattctcacaacccagcgtgagccgaaggagatgcagaagcctcagtggtacaggcacacatttgaagaagcagagaagggatttgatgagaccttggccaaagagaagggcatgaatcgggatgatcggatccatggagccttgttgatccttaacgagctggtccgaatcagcagcatggagggagagcgtctgagagaagaaatggaagaaatcacacagcagcagctggtacacgacaagtactgcaaagatctcatgggcttcggaacaaaacctcgtcacattacccccttcaccagtttccaggctgtacagccccagcagtcaaatgccttggtggggctgctggggtacagctctcaccaaggcctcatgggatttgggacctcccccagtccagctaagtccaccctggtggagagccggtgttgcagagacttgatggaggagaaatttgatcaggtgtgccagtgggtgctgaaatgcaggaatagcaagaactcgctgatccaaatgacaatccttaatttgttgccccgcttggctgcattccgaccttctgccttcacagatacccagtatctccaagataccatgaaccatgtcctaagctgtgtcaagaaggagaaggaacgtacagcggccttccaagccctggggctactttctgtggctgtgaggtctgagtttaaggtctatttgcctcgcgtgctggacatcatccgagcggccctgcccccaaaggacttcgcccataagaggcagaaggcaatgcaggtggatgccacagtcttcacttgcatcagcatgctggctcgagcaatggggccaggcatccagcaggatatcaaggagctgctggagcccatgctggcagtgggactaagccctgccctcactgcagtgctctacgacctgagccgtcagattccacagctaaagaaggacattcaagatgggctactgaaaatgctgtccctggtccttatgcacaaaccccttcgccacccaggcatgcccaagggcctggcccatcagctggcctctcctggcctcacgaccctccctgaggccagcgatgtgggcagcatcactcttgccctccgaacgcttggcagctttgaatttgaaggccactctctgacccaatttgttcgccactgtgcggatcatttcctgaacagtgagcacaaggagatccgcatggaggctgcccgcacctgctcccgcctgctcacaccctccatccacctcatcagtggccatgctcatgtggttagccagaccgcagtgcaagtggtggcagatgtgcttagcaaactgctcgtagttgggataacagatcctgaccctgacattcgctactgtgtcttggcgtccctggacgagcgctttgatgcacacctggcccaggcggagaacttgcaggccttgtttgtggctctgaatgaccaggtgtttgagatccgggagctggccatctgcactgtgggccgactcagtagcatgaaccctgcctttgtcatgcctttcctgcgcaagatgctcatccagattttgacagagttggagcacagtgggattggaagaatcaaagagcagagtgcccgcatgctggggcacctggtctccaatgccccccgactcatccgcccctacatggagcctattctgaaggcattaattttgaaactgaaagatccagaccctgatccaaacccaggtgtgatcaataatgtcctggcaacaataggagaattggcacaggttagtggcctggaaatgaggaaatgggttgatgaactttttattatcatcatggacatgctccaggattcctctttgttggccaaaaggcaggtggctctgtggaccctgggacagttggtggccagcactggctatgtagtagagccctacaggaagtaccctactttgcttgaggtgctactgaattttctgaagactgagcagaaccagggtacacgcagagaggccatccgtgtgttagggcttttaggggctttggatccttacaagcacaaagtgaacattggcatgatagaccagtcccgggatgcctctgctgtcagcctgtcagaatccaagtcaagtcaggattcctctgactatagcactagtgaaatgctggtcaacatgggaaacttgcctctggatgagttctacccagctgtgtccatggtggccctgatgcggatcttccgagaccagtcactctctcatcatcacaccatggttgtccaggccatcaccttcatcttcaagtccctgggactcaaatgtgtgcagttcctgccccaggtcatgcccacgttccttaacgtcattcgagtctgtgatggggccatccgggaatttttgttccagcagctgggaatgttggtgtcctttgtgaagagccacatcagaccttatatggatgaaatagtcaccctcatgagagaattctgggtcatgaacacctcaattcagagcacgatcattcttctcattgagcaaattgtggtagctcttgggggtgaatttaagctctacctgccccagctgatcccacacatgctgcgtgtcttcatgcatgacaacagcccaggccgcattgtctctatcaagttactggctgcaatccagctgtttggcgccaacctggatgactacctgcatttactgctgcctcctattgttaagttgtttgatgcccctgaagctccactgccatctcgaaaggcagcgctagagactgtggaccgcctgacggagtccctggatttcactgactatgcctcccggatcattcaccctattgttcgaacactggaccagagcccagaactgcgctccacagccatggacacgctgtcttcacttgtttttcagctggggaagaagtaccaaattttcattccaatggtgaataaagttctggtgcgacaccgaatcaatcatcagcgctatgatgtgctcatctgcagaattgtcaagggatacacacttgctgatgaagaggaggatcctttgatttaccagcatcggatgcttaggagtggccaaggggatgcattggctagtggaccagtggaaacaggacccatgaagaaactgcacgtcagcaccatcaacctccaaaaggcctggggcgctgccaggagggtctccaaagatgactggctggaatggctgagacggctgagcctggagctgctgaaggactcatcatcgccctccctgcgctcctgctgggccctggcacaggcctacaacccgatggccagggatctcttcaatgctgcatttgtgtcctgctggtctgaactgaatgaagatcaacaggatgagctcatcagaagcatcgagttggccctcacctcacaagacatcgctgaagtcacacagaccctcttaaacttggctgaattcatggaacacagtgacaagggccccctgccactgagagatgacaatggcattgttctgctgggtgagagagctgccaagtgccgagcatatgccaaagcactacactacaaagaactggagttccagaaaggccccacccctgccattctagaatctctcatcagcattaataataagctacagcagccggaggcagcggccggagtgttagaatatgccatgaaacactttggagagctggagatccaggctacctggtatgagaaactgcacgagtgggaggatgcccttgtggcctatgacaagaaaatggacaccaacaaggacgacccagagctgatgctgggccgcatgcgctgcctcgaggccttgggggaatggggtcaactccaccagcagtgctgtgaaaagtggaccctggttaatgatgagacccaagccaagatggcccggatggctgctgcagctgcatggggtttaggtcagtgggacagcatggaagaatacacctgtatgatccctcgggacacccatgatggggcattttatagagctgtgctggcactgcatcaggacctcttctccttggcacaacagtgcattgacaaggccagggacctgctggatgctgaattaactgcgatggcaggagagagttacagtcgggcatatggggccatggtttcttgccacatgctgtccgagctggaggaggttatccagtacaaacttgtccccgagcgacgagagatcatccgccagatctggtgggagagactgcagggctgccagcgtatcgtagaggactggcagaaaatccttatggtgcggtcccttgtggtcagccctcatgaagacatgagaacctggctcaagtatgcaagcctgtgcggcaagagtggcaggctggctcttgctcataaaactttagtgttgctcctgggagttgatccgtctcggcaacttgaccatcctctgccaacagttcaccctcaggtgacctatgcctacatgaaaaacatgtggaagagtgcccgcaagatcgatgccttccagcacatgcagcattttgtccagaccatgcagcaacaggcccagcatgccatcgctactgaggaccagcagcataagcaggaactgcacaagctcatggcccgatgcttcctgaaacttggagagtggcagctgaatctacagggcatcaatgagagcacaatccccaaagtgctgcagtactacagcgccgccacagagcacgaccgcagctggtacaaggcctggcatgcgtgggcagtgatgaacttcgaagctgtgctacactacaaacatcagaaccaagcccgcgatgagaagaagaaactgcgtcatgccagcggggccaacatcaccaacgccaccactgccgccaccacggccgccactgccaccaccactgccagcaccgagggcagcaacagtgagagcgaggccgagagcaccgagaacagccccaccccatcgccgctgcagaagaaggtcactgaggatctgtccaaaaccctcctgatgtacacggtgcctgccgtccagggcttcttccgttccatctccttgtcacgaggcaacaacctccaggatacactcagagttctcaccttatggtttgattatggtcactggccagatgtcaatgaggccttagtggagggggtgaaagccatccagattgatacctggctacaggttatacctcagctcattgcaagaattgatacgcccagacccttggtgggacgtctcattcaccagcttctcacagacattggtcggtaccacccccaggccctcatctacccactgacagtggcttctaagtctaccacgacagcccggcacaatgcagccaacaagattctgaagaacatgtgtgagcacagcaacaccctggtccagcaggccatgatggtgagcgaggagctgatccgagtggccatcctctggcatgagatgtggcatgaaggcctggaagaggcatctcgtttgtactttggggaaaggaacgtgaaaggcatgtttgaggtgctggagcccttgcatgctatgatggaacggggcccccagactctgaaggaaacatcctttaatcaggcctatggtcgagatttaatggaggcccaagagtggtgcaggaagtacatgaaatcagggaatgtcaaggacctcacccaagcctgggacctctattatcatgtgttccgacgaatctcaaagcagctgcctcagctcacatccttagagctgcaatatgtttccccaaaacttctgatgtgccgggaccttgaattggctgtgccaggaacatatgaccccaaccagccaatcattcgcattcagtccatagcaccgtctttgcaagtcatcacatccaagcagaggccccggaaattgacacttatgggcagcaacggacatgagtttgttttccttctaaaaggccatgaagatctgcgccaggatgagcgtgtgatgcagctcttcggcctggttaacacccttctggccaatgacccaacatctcttcggaaaaacctcagcatccagagatacgctgtcatccctttatcgaccaactcgggcctcattggctgggttccccactgtgacacactgcacgccctcatccgggactacagggagaagaagaagatccttctcaacatcgagcatcgcatcatgttgcggatggctccggactatgaccacttgactctgatgcagaaggtggaggtgtttgagcatgccgtcaataatacagctggggacgacctggccaagctgctgtggctgaaaagccccagctccgaggtgtggtttgaccgaagaaccaattatacccgttctttagcggtcatgtcaatggttgggtatattttaggcctgggagatagacacccatccaacctgatgctggaccgtctgagtgggaagatcctgcacattgactttggggactgctttgaggttgctatgacccgagagaagtttccagagaagattccatttagactaacaagaatgttgaccaatgctatggaggttacaggcctggatggcaactacagaatcacatgccacacagtgatggaggtgctgcgagagcacaaggacagtgtcatggccgtgctggaagcctttgtctatgaccccttgctgaactggaggctgatggacacaaataccaaaggcaacaagcgatcccgaacgaggacggattcctactctgctggccagtcagtcgaaattttggacggtgtggaacttggagagccagcccataagaaaacggggaccacagtgccagaatctattcattctttcattggagacggtttggtgaaaccagaggccctaaataagaaagctatccagattattaacagggttcgagataagctcactggtcgggacttctctcatgatgacactttggatgttccaacgcaagttgagctgctcatcaaacaagcgacatcccatgaaaacctctgccagtgctatattggctggtgccctttctggtaactggaggcccagatgtgcccatcacgttttttctgaggcttttgtactttagtaaatgcttccactaaactgaaaccatggtgagaaagtttgactttgttaaatattttgaaatgtaaatgaaaagaactactgtatattaaaagttggtttgaaccaactttctagctgctgttgaagaatatattgtcagaaacacaaggcttgatttggttcccaggacagtgaaacatagtaataccacgtaaatcaagccattcattttggggaacagaagatccataactttagaaatacgggttttgacttaactcacaagagaactcatcataagtacttgctgatggaagaatgacctagttgctcctctcaacatgggtacagcaaactcagcacagccaagaagcctcaggtcgtggagaacatggattaggatcctagactgtaaagacacagaagatgctgacctcacccctgccacctatcccaagacctcactggtctgtggacagcagcagaaatgtttgcaagataggccaaaatgagtacaaaaggtctgtcttccatcagacccagtgatgctgcgactcacacgcttcaattcaagacctgaccgctagtagggaggtttattcagatcgctggcagcctcggctgagcagatgcacagaggggatcactgtgcagtgggaccaccctcactggccttctgcagcagggttctgggatgttttcagtggtcaaaatactctgtttagagcaagggctcagaaaacagaaatactgtcatggaggtgctgaacacagggaaggtctggtacatattggaaattatgagcagaacaaatactcaactaaatgcacaaagtataaagtgtagccatgtctagacaccatgttgtatcagaataatttttgtgccaataaatgacatcagaattttaaacatatgtaaaaaaaaa

SEQ ID NO: 118 - protein, 2549 aa, Homo sapiens
MLGTGPAAATTAATTSSNVSVLQQFASGLKSRNEETRAKAAKELQHYVTMELREMSQEESTRFYDQLNHHIFELVSSSDANERKGGILAIASLIGVEGGNATRIGRFANYLRNLLPSNDPVVMEMASKAIGRLAMAGDTFTAEYVEFEVKRALEWLGADRNEGRRHAAVLVLRELAISVPTFFFQQVQPFFDNIFVAVWDPKQAIREGAVAALRACLILTTQREPKEMQKPQWYRHTFEEAEKGFDETLAKEKGMNRDDRIHGALLILNELVRISSMEGERLREEMEEITQQQLVHDKYCKDLMGFGTKPRHITPFTSFQAVQPQQSNALVGLLGYSSHQGLMGFGTSPSPAKSTLVESRCCRDLMEEKFDQVCQWVLKCRNSKNSLIQMTILNLLPRLAAFRPSAFTDTQYLQDTMNHVLSCVKKEKERTAAFQALGLLSVAVRSEFKVYLPRVLDIIRAALPPKDFAHKRQKAMQVDATVFTCISMLARAMGPGIQQDIKELLEPMLAVGLSPALTAVLYDLSRQIPQLKKDIQDGLLKMLSLVLMHKPLRHPGMPKGLAHQLASPGLTTLPEASDVGSITLALRTLGSFEFEGHSLTQFVRHCADHFLNSEHKEIRMEAARTCSRLLTPSIHLISGHAHVVSQTAVQVVADVLSKLLVVGITDPDPDIRYCVLASLDERFDAHLAQAENLQALFVALNDQVFEIRELAICTVGRLSSMNPAFVMPFLRKMLIQILTELEHSGIGRIKEQSARMLGHLVSNAPRLIRPYMEPILKALILKLKDPDPDPNPGVINNVLATIGELAQVSGLEMRKWVDELFIIIMDMLQDSSLLAKRQVALWTLGQLVASTGYVVEPYRKYPTLLEVLLNFLKTEQNQGTRREAIRVLGLLGALDPYKHKVNIGMIDQSRDASAVSLSESKSSQDSSDYSTSEMLVNMGNLPLDEFYPAVSMVALMRIFRDQSLSHHHTMVVQAITFIFKSLGLKCVQFLPQVMPTFLNVIRVCDGAIREFLFQQLGMLVSFVKSHIRPYMDEIVTLMREFWVMNTSIQSTIILLIEQIVVALGGEFKLYLPQLIPHMLRVFMHDNSPGRIVSIKLLAAIQLFGANLDDYLHLLLPPIVKLFDAPEAPLPSRKAALETVDRLTESLDFTDYASRIIHPIVRTLDQSPELRSTAMDTLSSLVFQLGKKYQIFIPMVNKVLVRHRINHQRYDVLICRIVKGYTLADEEEDPLIYQHRMLRSGQGDALASGPVETGPMKKLHVSTINLQKAWGAARRVSKDDWLEWLRRLSLELLKDSSSPSLRSCWALAQAYNPMARDLFNAAFVSCWSELNEDQQDELIRSIELALTSQDIAEVTQTLLNLAEFMEHSDKGPLPLRDDNGIVLLGERAAKCRAYAKALHYKELEFQKGPTPAILESLISINNKLQQPEAAAGVLEYAMKHFGELEIQATWYEKLHEWEDALVAYDKKMDTNKDDPELMLGRMRCLEALGEWGQLHQQCCEKWTLVNDETQAKMARMAAAAAWGLGQWDSMEEYTCMIPRDTHDGAFYRAVLALHQDLFSLAQQCIDKARDLLDAELTAMAGESYSRAYGAMVSCHMLSELEEVIQYKLVPERREIIRQIWWERLQGCQRIVEDWQKILMVRSLVVSPHEDMRTWLKYASLCGKSGRLALAHKTLVLLLGVDPSRQLDHPLPTVHPQVTYAYMKNMWKSARKIDAFQHMQHFVQTMQQQAQHAIATEDQQHKQELHKLMARCFLKLGEWQLNLQGINESTIPKVLQYYSAATEHDRSWYKAWHAWAVMNFEAVLHYKHQNQARDEKKKLRHASGANITNATTAATTAATATTTASTEGSNSESEAESTENSPTPSPLQKKVTEDLSKTLLMYTVPAVQGFFRSISLSRGNNLQDTLRVLTLWFDYGHWPDVNEALVEGVKAIQIDTWLQVIPQLIARIDTPRPLVGRLIHQLLTDIGRYHPQALIYPLTVASKSTTTARHNAANKILKNMCEHSNTLVQQAMMVSEELIRVAILWHEMWHEGLEEASRLYFGERNVKGMFEVLEPLHAMMERGPQTLKETSFNQAYGRDLMEAQEWCRKYMKSGNVKDLTQAWDLYYHVFRRISKQLPQLTSLELQYVSPKLLMCRDLELAVPGTYDPNQPIIRIQSIAPSLQVITSKQRPRKLTLMGSNGHEFVFLLKGHEDLRQDERVMQLFGLVNTLLANDPTSLRKNLSIQRYAVIPLSTNSGLIGWVPHCDTLHALIRDYREKKKILLNIEHRIMLRMAPDYDHLTLMQKVEVFEHAVNNTAGDDLAKLLWLKSPSSEVWFDRRTNYTRSLAVMSMVGYILGLGDRHPSNLMLDRLSGKILHIDFGDCFEVAMTREKFPEKIPFRLTRMLTNAMEVTGLDGNYRITCHTVMEVLREHKDSVMAVLEAFVYDPLLNWRLMDTNTKGNKRSRTRTDSYSAGQSVEILDGVELGEPAHKKTGTTVPESIHSFIGDGLVKPEALNKKAIQIINRVRDKLTGRDFSHDDTLDVPTQVELLIKQATSHENLCQCYIGWCPFW

SEQ ID NO: 119 - DNA, 2583 bp, Artificial Sequence
  source: /note="Description of Artificial Sequence: Synthetic polynucleotide"
  CDS (1)..(2580)
atggtcagctggggtcgtttcatctgcctggtcgtggtcaccatggcaaccttgtccctggcccggccctccttcagtttagttgaggataccacattagagccagaagatgccatctcatccggagatgatgaggatgacaccgatggtgcggaagattttgtcagtgagaacagtaacaacaagagagcaccatactggaccaacacagaaaagatggaaaagcggctccatgctgtgcctgcggccaacactgtcaagtttcgctgcccagccggggggaacccaatgccaaccatgcggtggctgaaaaacgggaaggagtttaagcaggagcatcgcattggaggctacaaggtacgaaaccagcactggagcctcattatggaaagtgtggtcccatctgacaagggaaattatacctgtgtagtggagaatgaatacgggtccatcaatcacacgtaccacctggatgttgtggagcgatcgcctcaccggcccatcctccaagccggactgccggcaaatgcctccacagtggtcggaggagacgtagagtttgtctgcaaggtttacagtgatgcccagccccacatccagtggatcaagcacgtggaaaagaacggcagtaaatacgggcccgacgggctgccctacctcaaggttctcaaggccgccggtgttaacaccacggacaaagagattgaggttctctatattcggaatgtaacttttgaggacgctggggaatatacgtgcttggcgggtaattctattgggatatcctttcactctgcatggttgacagttctgccagcgcctggaagagaaaaggagattacagcttccccagactacctggagatagccatttactgcataggggtcttcttaatcgcctgtatggtggtaacagtcatcctgtgccgaatgaagaacacgaccaagaagccagacttcagcagccagccggctgtgcacaagctgaccaaacgtatccccctgcggagacaggtaacagtttcggctgagtccagctcctccatgaactccaacaccccgctggtgaggataacaacacgcctctcttcaacggcagacacccccatgctggcaggggtctccgagtatgaacttccagaggacccaaaatgggagtttccaagagataagctgacactgggcaagcccctgggagaaggttgctttgggcaagtggtcatggcggaagcagtgggaattgacaaagacaagcccaaggaggcggtcaccgtggccgtgaagatgttgaaagatgatgccacagagaaagacctttctgatctggtgtcagagatggagatgatgaagatgattgggaaacacaagaatatcataaatcttcttggagcctgcacacaggatgggcctctctatgtcatagttgagtatgcctctaaaggcaacctccgagaatacctccgagcccggaggccacccgggatggagtactcctatgacattaaccgtgttcctgaggagcagatgaccttcaaggacttggtgtcatgcacctaccagctggccagaggcatggagtacttggcttcccaaaaatgtattcatcgagatttagcagccagaaatgttttggtaacagaaaacaatgtgatgaaaatagcagactttggactcgccagagatatcaacaatatagactattacaaaaagaccaccaatgggcggcttccagtcaagtggatggctccagaagccctgtttgatagagtatacactcatcagagtgatgtctggtccttcggggtgttaatgtgggagatcttcactttagggggctcgccctacccagggattcccgtggaggaactttttaagctgctgaaggaaggacacagaatggataagccagccaactgcaccaacgaactgtacatgatgatgagggactgttggcatgcagtgccctcccagagaccaacgttcaagcagttggtagaagacttggatcgaattctcactctcacaaccaatgagggctcatccatgtccctttcacggtccaacagtcgtgagcacttgggaggtggaagcgaatctgataactggagagaccgaaatggaattggacctggaagtcatagtgaatttgcagcttctattggcagccctaagcgtaaacaaaacaaatcaacggaacactatctcagcagtagcaattacatggactgcatttcctcgctgacaggaagcaatggctgtaacttaaatagctctttcaaaggttctgacctccctgagctcttcagcaaactgggcctgggcaaatacacagatgttttccagcaacaagagatcgatcttcagacattcctcactctcacagatcaggatctgaaggagctgggaataactacttttggtgccaggaggaaaatgctgcttgcaatttcagaactaaataaaaaccgaagaaagctttttgaatcgccaaatgcacgcacctctttcctggaaggtggagcgagtggaaggctaccccgtcagtatcactcagacattgctagtgtcagtggccgctggtag

SEQ ID NO: 120 - protein, 860 aa, Artificial Sequence
  source: /note="Description of Artificial Sequence: Synthetic polypeptide"
MVSWGRFICLVVVTMATLSLARPSFSLVEDTTLEPEDAISSGDDEDDTDGAEDFVSENSNNKRAPYWTNTEKMEKRLHAVPAANTVKFRCPAGGNPMPTMRWLKNGKEFKQEHRIGGYKVRNQHWSLIMESVVPSDKGNYTCVVENEYGSINHTYHLDVVERSPHRPILQAGLPANASTVVGGDVEFVCKVYSDAQPHIQWIKHVEKNGSKYGPDGLPYLKVLKAAGVNTTDKEIEVLYIRNVTFEDAGEYTCLAGNSIGISFHSAWLTVLPAPGREKEITASPDYLEIAIYCIGVFLIACMVVTVILCRMKNTTKKPDFSSQPAVHKLTKRIPLRRQVTVSAESSSSMNSNTPLVRITTRLSSTADTPMLAGVSEYELPEDPKWEFPRDKLTLGKPLGEGCFGQVVMAEAVGIDKDKPKEAVTVAVKMLKDDATEKDLSDLVSEMEMMKMIGKHKNIINLLGACTQDGPLYVIVEYASKGNLREYLRARRPPGMEYSYDINRVPEEQMTFKDLVSCTYQLARGMEYLASQKCIHRDLAARNVLVTENNVMKIADFGLARDINNIDYYKKTTNGRLPVKWMAPEALFDRVYTHQSDVWSFGVLMWEIFTLGGSPYPGIPVEELFKLLKEGHRMDKPANCTNELYMMMRDCWHAVPSQRPTFKQLVEDLDRILTLTTNEGSSMSLSRSNSREHLGGGSESDNWRDRNGIGPGSHSEFAASIGSPKRKQNKSTEHYLSSSNYMDCISSLTGSNGCNLNSSFKGSDLPELFSKLGLGKYTDVFQQQEIDLQTFLTLTDQDLKELGITTFGARRKMLLAISELNKNRRKLFESPNARTSFLEGGASGRLPRQYHSDIASVSGRW

SEQ ID NO: 121 - DNA, 2421 bp, Artificial Sequence
  source: /note="Description of Artificial Sequence: Synthetic polynucleotide"
  CDS (1)..(2418)
atgcacaggaggagaagcaggagctgtcgggaagatcagaagccagtcatggatgaccagcgcgaccttatctccaacaatgagcaactgcccatgctgggccggcgccctggggccccggagagcaagtgcagccgcggagccctgtacacaggcttttccatcctggtgactctgctcctcgctggccaggccaccaccgcctacttcctgtaccagcagcagggccggctggacaaactgacagtcacctcccagaacctgcagctggagaacctgcgcatgaagcttcccaagcctcccaagcctgtgagcaagatgcgcatggccaccccgctgctgatgcaggcgctgcccatgggagccctgccccaggggcccatgcagaatgccaccaagtatggcaacatgacagaggaccatgtgatgcacctgctccagaatgctgaccccctgaaggtgtacccgccactgaaggggagcttcccggagaacctgagacaccttaagaacaccatggagaccatagactggaaggtctttgagagctggatgcaccattggctcctgtttgaaatgagcaggcactccttggagcaaaagcccactgacgctccaccgaaagctggagtcccaaataaaccaggcattcccaaattactagaagggagtaaaaattcaatacagtgggagaaagctgaagataatggatgtagaattacatactatatccttgagataagaaagagcacttcaaataatttacagaaccagaatttaaggtggaagatgacatttaatggatcctgcagtagtgtttgcacatggaagtccaaaaacctgaaaggaatatttcagttcagagtagtagctgcaaataatctagggtttggtgaatatagtggaatcagtgagaatattatattagttggagatgatttttggataccagaaacaagtttcatacttactattatagttggaatatttctggttgttacaatcccactgacctttgtctggcatagaagattaaagaatcaaaaaagtgccaaggaaggggtgacagtgcttataaacgaagacaaagagttggctgagctgcgaggtctggcagccggagtaggcctggctaatgcctgctatgcaatacatactcttccaacccaagaggagattgaaaatcttcctgccttccctcgggaaaaactgactctgcgtctcttgctgggaagtggagcctttggagaagtgtatgaaggaacagcagtggacatcttaggagttggaagtggagaaatcaaagtagcagtgaagactttgaagaagggttccacagaccaggagaagattgaattcctgaaggaggcacatctgatgagcaaatttaatcatcccaacattctgaagcagcttggagtttgtctgctgaatgaaccccaatacattatcctggaactgatggagggaggagaccttcttacttatttgcgtaaagcccggatggcaacgttttatggtcctttactcaccttggttgaccttgtagacctgtgtgtagatatttcaaaaggctgtgtctacttggaacggatgcatttcattcacagggatctggcagctagaaattgccttgtttccgtgaaagactataccagtccacggatagtgaagattggagactttggactcgccagagacatctataaaaatgattactatagaaagagaggggaaggcctgctcccagttcggtggatggctccagaaagtttgatggatggaatcttcactactcaatctgatgtatggtcttttggaattctgatttgggagattttaactcttggtcatcagccttatccagctcattccaaccttgatgtgttaaactatgtgcaaacaggagggagactggagccaccaagaaattgtcctgatgatctgtggaatttaatgacccagtgctgggctcaagaacccgaccaaagacctacttttcatagaattcaggaccaacttcagttattcagaaattttttcttaaatagcatttataagtccagagatgaagcaaacaacagtggagtcataaatgaaagctttgaaggtgaagatggcgatgtgatttgtttgaattcagatgacattatgccagttgctttaatggaaacgaagaaccgagaagggttaaactatatggtacttgctacagaatgtggccaaggtgaagaaaagtctgagggtcctctaggctcccaggaatctgaatcttgtggtctgaggaaagaagagaaggaaccacatgcagacaaagatttctgccaagaaaaacaagtggcttactgcccttctggcaagcctgaaggcctgaactatgcctgtctcactcacagtggatatggagatgggtctgattaa

SEQ ID NO: 122 - protein, 806 aa, Artificial Sequence
  source: /note="Description of Artificial Sequence: Synthetic polypeptide"
MHRRRSRSCREDQKPVMDDQRDLISNNEQLPMLGRRPGAPESKCSRGALYTGFSILVTLLLAGQATTAYFLYQQQGRLDKLTVTSQNLQLENLRMKLPKPPKPVSKMRMATPLLMQALPMGALPQGPMQNATKYGNMTEDHVMHLLQNADPLKVYPPLKGSFPENLRHLKNTMETIDWKVFESWMHHWLLFEMSRHSLEQKPTDAPPKAGVPNKPGIPKLLEGSKNSIQWEKAEDNGCRITYYILEIRKSTSNNLQNQNLRWKMTFNGSCSSVCTWKSKNLKGIFQFRVVAANNLGFGEYSGISENIILVGDDFWIPETSFILTIIVGIFLVVTIPLTFVWHRRLKNQKSAKEGVTVLINEDKELAELRGLAAGVGLANACYAIHTLPTQEEIENLPAFPREKLTLRLLLGSGAFGEVYEGTAVDILGVGSGEIKVAVKTLKKGSTDQEKIEFLKEAHLMSKFNHPNILKQLGVCLLNEPQYIILELMEGGDLLTYLRKARMATFYGPLLTLVDLVDLCVDISKGCVYLERMHFIHRDLAARNCLVSVKDYTSPRIVKIGDFGLARDIYKNDYYRKRGEGLLPVRWMAPESLMDGIFTTQSDVWSFGILIWEILTLGHQPYPAHSNLDVLNYVQTGGRLEPPRNCPDDLWNLMTQCWAQEPDQRPTFHRIQDQLQLFRNFFLNSIYKSRDEANNSGVINESFEGEDGDVICLNSDDIMPVALMETKNREGLNYMVLATECGQGEEKSEGPLGSQESESCGLRKEEKEPHADKDFCQEKQVAYCPSGKPEGLNYACLTHSGYGDGSD

SEQ ID NO: 123 - DNA, 1506 bp, Homo sapiens
ctgcctggggagcccccccgccccacatcctgccccgcaaaaggcagcttcaccaaagtggggtatttccagcctttgtagctttcacttccacatctaccaagtgggcggagtggccttctgtggacgaatcagattcctctccagcaccgactttaagaggcgagccggggggtcagggtcccagatgcacaggaggagaagcaggagctgtcgggaagatcagaagccagtcatggatgaccagcgcgaccttatctccaacaatgagcaactgcccatgctgggccggcgccctggggccccggagagcaagtgcagccgcggagccctgtacacaggcttttccatcctggtgactctgctcctcgctggccaggccaccaccgcctacttcctgtaccagcagcagggccggctggacaaactgacagtcacctcccagaacctgcagctggagaacctgcgcatgaagcttcccaagcctcccaagcctgtgagcaagatgcgcatggccaccccgctgctgatgcaggcgctgcccatgggagccctgccccaggggcccatgcagaatgccaccaagtatggcaacatgacagaggaccatgtgatgcacctgctccagaatgctgaccccctgaaggtgtacccgccactgaaggggagcttcccggagaacctgagacaccttaagaacaccatggagaccatagactggaaggtctttgagagctggatgcaccattggctcctgtttgaaatgagcaggcactccttggagcaaaagcccactgacgctccaccgaaagagtcactggaactggaggacccgtcttctgggctgggtgtgaccaagcaggatctgggcccagtccccatgtgagagcagcagaggcggtcttcaacatcctgccagccccacacagctacagctttcttgctcccttcagcccccagcccctcccccatctcccaccctgtacctcatcccatgagaccctggtgcctggctctttcgtcacccttggacaagacaaaccaagtcggaacagcagataacaatgcagcaaggccctgctgcccaatctccatctgtcaacaggggcgtgaggtcccaggaagtggccaaaagctagacagatccccgttcctgacatcacagcagcctccaacacaaggctccaagacctaggctcatggacgagatgggaaggcacagggagaagggataaccctacacccagaccccaggctggacatgctgactgtcctctcccctccagcctttggccttggcttttctagcctatttacctgcaggctgagccactctcttccctttccccagcatcactccccaaggaagagccaatgttttccacccataatcctttctgccgacccctagttccctctgctcagccaagcttgttatcagctttcagggccatggttcacattagaataaaaggtagtaattagaacaaaaaaaaaaaaaaaaaa

SEQ ID NO: 124 - protein, 232 aa, Homo sapiens
MHRRRSRSCREDQKPVMDDQRDLISNNEQLPMLGRRPGAPESKCSRGALYTGFSILVTLLLAGQATTAYFLYQQQGRLDKLTVTSQNLQLENLRMKLPKPPKPVSKMRMATPLLMQALPMGALPQGPMQNATKYGNMTEDHVMHLLQNADPLKVYPPLKGSFPENLRHLKNTMETIDWKVFESWMHHWLLFEMSRHSLEQKPTDAPPKESLELEDPSSGLGVTKQDLGPVPM

SEQ ID NO: 125 - DNA, 7368 bp, Homo sapiens
caagctttcaagcattcaaaggtctaaatgaaaaaggctaagtattatttcaaaaggcaagtatatcctaatatagcaaaacaaacaaagcaaaatccatcagctactcctccaattgaagtgatgaagcccaaataattcatatagcaaaatggagaaaattagaccggccatctaaaaatctgccattggtgaagtgatgaagaacatttactgtcttattccgaagcttgtcaattttgcaactcttggctgcctatggatttctgtggtgcagtgtacagttttaaatagctgcctaaagtcgtgtgtaactaatctgggccagcagcttgaccttggcacaccacataatctgagtgaaccgtgtatccaaggatgtcacttttggaactctgtagatcagaaaaactgtgctttaaagtgtcgggagtcgtgtgaggttggctgtagcagcgcggaaggtgcatatgaagaggaagtactggaaaatgcagacctaccaactgctccctttgcttcttccattggaagccacaatatgacattacgatggaaatctgcaaacttctctggagtaaaatacatcattcagtggaaatatgcacaacttctgggaagctggacttatactaagactgtgtccagaccgtcctatgtggtcaagcccctgcaccccttcactgagtacattttccgagtggtttggatcttcacagcgcagctgcagctctactcccctccaagtcccagttacaggactcatcctcatggagttcctgaaactgcacctttgattaggaatattgagagctcaagtcccgacactgtggaagtcagctgggatccacctcaattcccaggtggacctattttgggttataacttaaggctgatcagcaaaaatcaaaaattagatgcagggacacagagaaccagtttccagttttactccactttaccaaatactatctacaggttttctattgcagcagtaaatgaagttggtgagggtccagaagcagaatctagtattaccacttcatcttcagcagttcaacaagaggaacagtggctctttttatccagaaaaacttctctaagaaagagatctttaaaacatttagtagatgaagcacattgccttcggttggatgctatataccataatattacaggaatatctgttgatgtccaccagcaaattgtttatttctctgaaggaactctcatatgggcgaagaaggctgccaacatgtctgatgtatctgacctgagaattttttacagaggttcaggattaatttcttctatctccatagattggctttatcaaagaatgtatttcatcatggatgaactggtatgtgtctgtgatttagagaactgctcaaacatcgaggaaattactccaccctctattagtgcacctcaaaaaattgtggctgattcatacaatgggtatgtcttttacctcctgagagatggcatttatagagcagaccttcctgtaccatctggccggtgtgcagaagctgtgcgtattgtggagagttgcacgttaaaggactttgcaatcaagccacaagccaagcgaatcatttacttcaatgacactgcccaagtcttcatgtcaacatttctggatggctctgcttcccatctcatcctacctcgcatcccctttgctgatgtgaaaagttttgcttgtgaaaacaatgactttcttgtcacagatggcaaggtcattttccaacaggatgctttgtcttttaatgaattcatcgtgggatgtgacctgagtcacatagaagaatttgggtttggtaacttggtcatctttggctcatcctcccagctgcaccctctgccaggccgcccgcaggagctttcggtgctgtttggctctcaccaggctcttgttcaatggaagcctcctgcccttgccataggagccaatgtcatcctgatcagtgatattattgaactctttgaattaggcccttctgcctggcagaactggacctatgaggtgaaagtatccacccaagaccctcctgaagtcactcatattttcttgaacataagtggaaccatgctgaatgtacctgagctgcagagtgctatgaaatacaaggtttctgtgagagcaagttctccaaagaggccaggcccctggtcagagccctcagtgggtactaccctggtgccagctagtgaaccaccatttatcatggctgtgaaagaagatgggctttggagtaaaccattaaatagctttggcccaggagagttcttatcctctgatataggaaatgtgtcagacatggattggtataacaacagcctctactacagtgacacgaaaggcgacgtttttgtgtggctgctgaatgggacggatatctcagagaattatcacctacccagcattgcaggagcaggggctttagcttttgagtggctgggtcactttctctactgggctggaaagacatatgtgatacaaaggcagtctgtgttgacgggacacacagacattgttacccacgtgaagctattggtgaatgacatggtggtggattcagttggtggatatctctactggaccacactctattcagtggaaagcaccagactaaatggggaaagttcccttgtactacagacacagccttggttttctgggaaaaaggtaattgctctaactttagacctcagtgatgggctcctgtattggttggttcaagacagtcaatgtattcacctgtacacagctgttcttcggggacagagcactggggataccaccatcacagaatttgcagcctggagtacttctgaaatttcccagaatgcactgatgtactatagtggtcggctgttctggatcaatggctttaggattatcacaactcaagaaataggtcagaaaaccagtgtctctgttttggaaccagccagatttaatcagttcacaattattcagacatcccttaagcccctgccagggaacttttcctttacccctaaggttattccagattctgttcaagagtcttcatttaggattgaaggaaatgcttcaagttttcaaatcctgtggaatggtccccctgcggtagactggggtgtagttttctacagtgtagaatttagtgctcattctaagttcttggctagtgaacaacactctttacctgtatttactgtggaaggactggaaccttatgccttatttaatctttctgtcactccttatacctactggggaaagggccccaaaacatctctgtcacttcgagcacctgaaacagttccatcagcaccagagaaccccagaatatttatattaccaagtggaaaatgctgcaacaagaatgaagttgtggtggaatttaggtggaacaaacctaagcatgaaaatggggtgttaacaaaatttgaaattttctacaatatatccaatcaaagtattacaaacaaaacatgtgaagactggattgctgtcaatgtcactccctcagtgatgtcttttcaacttgaaggcatgagtcccagatgctttattgccttccaggttagggcctttacatctaaggggccaggaccatatgctgacgttgtaaagtctacaacatcagaaatcaacccatttcctcacctcataactcttcttggtaacaagatagtttttttagatatggatcaaaatcaagttgtgtggacgttttcagcagaaagagttatcagtgccgtttgctacacagctgataatgagatgggatattatgctgaaggggactcactctttcttctgcacttgcacaatcgctctagctctgagcttttccaagattcactggtttttgatatcacagttattacaattgactggatttcaaggcacctctactttgcactgaaagaatcacaaaatggaatgcaagtatttgatgttgatcttgaacacaaggtgaaatatcccagagaggtgaagattcacaataggaattcaacaataatttctttttctgtatatcctcttttaagtcgcttgtattggacagaagtttccaattttggctaccagatgttctactacagtattatcagtcacaccttgcaccgaattctgcaacccacagctacaaaccaacaaaacaaaaggaatcaatgttcttgtaatgtgactgaatttgagttaagtggagcaatggctattgatacctctaacctagagaaaccattgatatactttgccaaagcacaagagatctgggcaatggatctggaaggctgtcagtgttggagagttatcacagtacctgctatgctcgcaggaaaaacccttgttagcttaactgtggatggagatcttatatactggatcatcacagcaaaggacagcacacagatttatcaggcaaagaaaggaaatggggccatcgtttcccaggtgaaggccctaaggagtaggcatatcttggcttacagttcagttatgcagccttttccagataaagcgtttctgtctctagcttcagacactgtggaaccaactatacttaatgccactaacactagcctcacaatcagattacctctggccaagacaaacctcacatggtatggcatcaccagccctactccaacatacctggtttattatgcagaagttaatgacaggaaaaacagctctgacttgaaatatagaattctggaatttcaggacagtatagctcttattgaagatttacaaccattttcaacatacatgatacagatagctgtaaaaaattattattcagatcctttggaacatttaccaccaggaaaagagatttggggaaaaactaaaaatggagtaccagaggcagtgcagctcattaatacaactgtgcggtcagacaccagcctcattatatcttggagagaatctcacaagccaaatggacctaaagaatcagtccgttatcagttggcaatctcacacctggccctaattcctgaaactcctctaagacaaagtgaatttccaaatggaaggctcactctccttgttactagactgtctggtggaaatatttatgtgttaaaggttcttgcctgccactctgaggaaatgtggtgtacagagagtcatcctgtcactgtggaaatgtttaacacaccagagaaaccttattccttggttccagagaacactagtttgcaatttaattggaaggctccattgaatgttaacctcatcagattttgggttgagctacagaagtggaaatacaatgagttttaccatgttaaaacttcatgcagccaaggtcctgcttatgtctgtaatatcacaaatctacaaccttatacttcatataatgtcagagtagtggtggtttataagacgggagaaaatagcacctcacttccagaaagctttaagacaaaagctggagtcccaaataaaccaggcattcccaaattactagaagggagtaaaaattcaatacagtgggagaaagctgaagataatggatgtagaattacatactatatccttgagataagaaagagcacttcaaataatttacagaaccagaatttaaggtggaagatgacatttaatggatcctgcagtagtgtttgcacatggaagtccaaaaacctgaaaggaatatttcagttcagagtagtagctgcaaataatctagggtttggtgaatatagtggaatcagtgagaatattatattagttggagatgatttttggataccagaaacaagtttcatacttactattatagttggaatatttctggttgttacaatcccactgacctttgtctggcatagaagattaaagaatcaaaaaagtgccaaggaaggggtgacagtgcttataaacgaagacaaagagttggctgagctgcgaggtctggcagccggagtaggcctggctaatgcctgctatgcaatacatactcttccaacccaagaggagattgaaaatcttcctgccttccctcgggaaaaactgactctgcgtctcttgctgggaagtggagcctttggagaagtgtatgaaggaacagcagtggacatcttaggagttggaagtggagaaatcaaagtagcagtgaagactttgaagaagggttccacagaccaggagaagattgaattcctgaaggaggcacatctgatgagcaaatttaatcatcccaacattctgaagcagcttggagtttgtctgctgaatgaaccccaatacattatcctggaactgatggagggaggagaccttcttacttatttgcgtaaagcccggatggcaacgttttatggtcctttactcaccttggttgaccttgtagacctgtgtgtagatatttcaaaaggctgtgtctacttggaacggatgcatttcattcacagggatctggcagctagaaattgccttgtttccgtgaaagactataccagtccacggatagtgaagattggagactttggactcgccagagacatctataaaaatgattactatagaaagagaggggaaggcctgctcccagttcggtggatggctccagaaagtttgatggatggaatcttcactactcaatctgatgtatggtcttttggaattctgatttgggagattttaactcttggtcatcagccttatccagctcattccaaccttgatgtgttaaactatgtgcaaacaggagggagactggagccaccaagaaattgtcctgatgatctgtggaatttaatgacccagtgctgggctcaagaacccgaccaaagacctacttttcatagaattcaggaccaacttcagttattcagaaattttttcttaaatagcatttataagtccagagatgaagcaaacaacagtggagtcataaatgaaagctttgaaggtgaagatggcgatgtgatttgtttgaattcagatgacattatgccagttgctttaatggaaacgaagaaccgagaagggttaaactatatggtacttgctacagaatgtggccaaggtgaagaaaagtctgagggtcctctaggctcccaggaatctgaatcttgtggtctgaggaaagaagagaaggaaccacatgcagacaaagatttctgccaagaaaaacaagtggcttactgcccttctggcaagcctgaaggcctgaactatgcctgtctcactcacagtggatatggagatgggtctgattaatagcgttgtttgggaaatagagagttgagataaacactctcattcagtagttactgaaagaaaactctgctagaatgataaatgtcatggtggtctataactccaaataaacaatgcaacgttcc

SEQ ID NO: 126 - protein, 2347 aa, Homo sapiens
MKNIYCLIPKLVNFATLGCLWISVVQCTVLNSCLKSCVTNLGQQLDLGTPHNLSEPCIQGCHFWNSVDQKNCALKCRESCEVGCSSAEGAYEEEVLENADLPTAPFASSIGSHNMTLRWKSANFSGVKYIIQWKYAQLLGSWTYTKTVSRPSYVVKPLHPFTEYIFRVVWIFTAQLQLYSPPSPSYRTHPHGVPETAPLIRNIESSSPDTVEVSWDPPQFPGGPILGYNLRLISKNQKLDAGTQRTSFQFYSTLPNTIYRFSIAAVNEVGEGPEAESSITTSSSAVQQEEQWLFLSRKTSLRKRSLKHLVDEAHCLRLDAIYHNITGISVDVHQQIVYFSEGTLIWAKKAANMSDVSDLRIFYRGSGLISSISIDWLYQRMYFIMDELVCVCDLENCSNIEEITPPSISAPQKIVADSYNGYVFYLLRDGIYRADLPVPSGRCAEAVRIVESCTLKDFAIKPQAKRIIYFNDTAQVFMSTFLDGSASHLILPRIPFADVKSFACENNDFLVTDGKVIFQQDALSFNEFIVGCDLSHIEEFGFGNLVIFGSSSQLHPLPGRPQELSVLFGSHQALVQWKPPALAIGANVILISDIIELFELGPSAWQNWTYEVKVSTQDPPEVTHIFLNISGTMLNVPELQSAMKYKVSVRASSPKRPGPWSEPSVGTTLVPASEPPFIMAVKEDGLWSKPLNSFGPGEFLSSDIGNVSDMDWYNNSLYYSDTKGDVFVWLLNGTDISENYHLPSIAGAGALAFEWLGHFLYWAGKTYVIQRQSVLTGHTDIVTHVKLLVNDMVVDSVGGYLYWTTLYSVESTRLNGESSLVLQTQPWFSGKKVIALTLDLSDGLLYWLVQDSQCIHLYTAVLRGQSTGDTTITEFAAWSTSEISQNALMYYSGRLFWINGFRIITTQEIGQKTSVSVLEPARFNQFTIIQTSLKPLPGNFSFTPKVIPDSVQESSFRIEGNASSFQILWNGPPAVDWGVVFYSVEFSAHSKFLASEQHSLPVFTVEGLEPYALFNLSVTPYTYWGKGPKTSLSLRAPETVPSAPENPRIFILPSGKCCNKNEVVVEFRWNKPKHENGVLTKFEIFYNISNQSITNKTCEDWIAVNVTPSVMSFQLEGMSPRCFIAFQVRAFTSKGPGPYADVVKSTTSEINPFPHLITLLGNKIVFLDMDQNQVVWTFSAERVISAVCYTADNEMGYYAEGDSLFLLHLHNRSSSELFQDSLVFDITVITIDWISRHLYFALKESQNGMQVFDVDLEHKVKYPREVKIHNRNSTIISFSVYPLLSRLYWTEVSNFGYQMFYYSIISHTLHRILQPTATNQQNKRNQCSCNVTEFELSGAMAIDTSNLEKPLIYFAKAQEIWAMDLEGCQCWRVITVPAMLAGKTLVSLTVDGDLIYWIITAKDSTQIYQAKKGNGAIVSQVKALRSRHILAYSSVMQPFPDKAFLSLASDTVEPTILNATNTSLTIRLPLAKTNLTWYGITSPTPTYLVYYAEVNDRKNSSDLKYRILEFQDSIALIEDLQPFSTYMIQIAVKNYYSDPLEHLPPGKEIWGKTKNGVPEAVQLINTTVRSDTSLIISWRESHKPNGPKESVRYQLAISHLALIPETPLRQSEFPNGRLTLLVTRLSGGNIYVLKVLACHSEEMWCTESHPVTVEMFNTPEKPYSLVPENTSLQFNWKAPLNVNLIRFWVELQKWKYNEFYHVKTSCSQGPAYVCNITNLQPYTSYNVRVVVVYKTGENSTSLPESFKTKAGVPNKPGIPKLLEGSKNSIQWEKAEDNGCRITYYILEIRKSTSNNLQNQNLRWKMTFNGSCSSVCTWKSKNLKGIFQFRVVAANNLGFGEYSGISENIILVGDDFWIPETSFILTIIVGIFLVVTIPLTFVWHRRLKNQKSAKEGVTVLINEDKELAELRGLAAGVGLANACYAIHTLPTQEEIENLPAFPREKLTLRLLLGSGAFGEVYEGTAVDILGVGSGEIKVAVKTLKKGSTDQEKIEFLKEAHLMSKFNHPNILKQLGVCLLNEPQYIILELMEGGDLLTYLRKARMATFYGPLLTLVDLVDLCVDISKGCVYLERMHFIHRDLAARNCLVSVKDYTSPRIVKIGDFGLARDIYKNDYYRKRGEGLLPVRWMAPESLMDGIFTTQSDVWSFGILIWEILTLGHQPYPAHSNLDVLNYVQTGGRLEPPRNCPDDLWNLMTQCWAQEPDQRPTFHRIQDQLQLFRNFFLNSIYKSRDEANNSGVINESFEGEDGDVICLNSDDIMPVALMETKNREGLNYMVLATECGQGEEKSEGPLGSQESESCGLRKEEKEPHADKDFCQEKQVAYCPSGKPEGLNYACLTHSGYGDGSD

SEQ ID NO: 127 - DNA, 2610 bp, Artificial Sequence
  source: /note="Description of Artificial Sequence: Synthetic polynucleotide"
  CDS (1)..(2607)
atgggcgggaaccactcccacaagccccccgtgtttgacgagaatgaggaagtcaactttgaccattttcagattctgcgggccattggtaaagggagttttggaaaggtatgcatcgtgcagaagcgagacactaagaaaatgtatgcaatgaagtacatgaacaagcagaagtgcatcgagagggatgaggttcggaatgttttccgggagctgcagatcatgcaagggctggagcaccccttcctggtcaatctgtggtactccttccaggatgaggaggacatgttcatggtggtggacctgctcctgggaggcgacctgcgctaccatctgcagcagaatgtgcatttcacagaggggactgtgaaactctacatctgtgagctggcactggccctggagtatcttcagaggtaccacatcatccacagagacatcaagccagacaatatcctgctggatgaacacggacatgttcacattacagacttcaacatagcgacggtagtgaaaggagcagaaagggcttcctccatggctggcaccaagccctacatggctccagaagtattccaggtgtacatggacagaggccccggatactcgtaccctgtcgactggtggtccctgggcatcacagcctatgagctgctgcggggctggaggccgtacgaaatccactcggtcacgcccatcgatgaaatcctcaacatgttcaaggtggagcgtgtccactactcctccacgtggtgcaaggggatggtggccctgctgaggaagctcctgaccaaggatcctgagagccgcgtgtccagccttcatgacatacagagcgtgccctacttggccgacatgaactgggacgcggtgttcaagaaggcactgatgcccggctttgtgcccaataaagggaggttgaactgcgatcccacatttgagcttgaagagatgattctagaatccaagccacttcacaaaaagaagaagcgattggcaaagaacagatccagggatggcacaaaggacagctgcccgctgaatggacacctgcagcactgtttggagactgtccgggaggaattcatcatattcaacagagagaagggtctgggccatggcgcctttggggaggtgtatgaaggccaggtgtccggaatgcccaacgacccaagccccctgcaagtggctgtgaagacgctgcctgaagtgtgctctgaacaggacgaactggatttcctcatggaagccctgatcatcagcaaattcaaccaccagaacattgttcgctgcattggggtgagcctgcaatccctgccccggttcatcctgctggagctcatggcggggggagacctcaagtccttcctccgagagacccgccctcgcccgagccagccctcctccctggccatgctggaccttctgcacgtggctcgggacattgcctgtggctgtcagtatttggaggaaaaccacttcatccaccgagacattgctgccagaaactgcctcttgacctgtccaggccctggaagagtggccaagattggagacttcgggatggcccgagacatctacagggcgagctactatagaaagggaggctgtgccatgctgccagttaagtggatgcccccagaggccttcatggaaggaatattcacttctaaaacagacacatggtcctttggagtgctgctatgggaaatcttttctcttggatatatgccataccccagcaaaagcaaccaggaagttctggagtttgtcaccagtggaggccggatggacccacccaagaactgccctgggcctgtataccggataatgactcagtgctggcaacatcagcctgaagacaggcccaactttgccatcattttggagaggattgaatactgcacccaggacccggatgtaatcaacaccgctttgccgatagaatatggtccacttgtggaagaggaagagaaagtgcctgtgaggcccaaggaccctgagggggttcctcctctcctggtctctcaacaggcaaaacgggaggaggagcgcagcccagctgccccaccacctctgcctaccacctcctctggcaaggctgcaaagaaacccacagctgcagagatctctgttcgagtccctagagggccggccgtggaagggggacacgtgaatatggcattctctcagtccaaccctccttcggagttgcacaaggtccacggatccagaaacaagcccaccagcttgtggaacccaacgtacggctcctggtttacagagaaacccaccaaaaagaataatcctatagcaaagaaggagccacacgacaggggtaacctggggctggagggaagctgtactgtcccacctaacgttgcaactgggagacttccgggggcctcactgctcctagagccctcttcgctgactgccaatatgaaggaggtacctctgttcaggctacgtcacttcccttgtgggaatgtcaattacggctaccagcaacagggcttgcccttagaagccgctactgcccctggagctggtcattacgaggataccattctgaaaagcaagaatagcatgaaccagcctgggccctga

SEQ ID NO: 128 - protein, 869 aa, Artificial Sequence
  source: /note="Description of Artificial Sequence: Synthetic polypeptide"
MGGNHSHKPPVFDENEEVNFDHFQILRAIGKGSFGKVCIVQKRDTKKMYAMKYMNKQKCIERDEVRNVFRELQIMQGLEHPFLVNLWYSFQDEEDMFMVVDLLLGGDLRYHLQQNVHFTEGTVKLYICELALALEYLQRYHIIHRDIKPDNILLDEHGHVHITDFNIATVVKGAERASSMAGTKPYMAPEVFQVYMDRGPGYSYPVDWWSLGITAYELLRGWRPYEIHSVTPIDEILNMFKVERVHYSSTWCKGMVALLRKLLTKDPESRVSSLHDIQSVPYLADMNWDAVFKKALMPGFVPNKGRLNCDPTFELEEMILESKPLHKKKKRLAKNRSRDGTKDSCPLNGHLQHCLETVREEFIIFNREKGLGHGAFGEVYEGQVSGMPNDPSPLQVAVKTLPEVCSEQDELDFLMEALIISKFNHQNIVRCIGVSLQSLPRFILLELMAGGDLKSFLRETRPRPSQPSSLAMLDLLHVARDIACGCQYLEENHFIHRDIAARNCLLTCPGPGRVAKIGDFGMARDIYRASYYRKGGCAMLPVKWMPPEAFMEGIFTSKTDTWSFGVLLWEIFSLGYMPYPSKSNQEVLEFVTSGGRMDPPKNCPGPVYRIMTQCWQHQPEDRPNFAIILERIEYCTQDPDVINTALPIEYGPLVEEEEKVPVRPKDPEGVPPLLVSQQAKREEERSPAAPPPLPTTSSGKAAKKPTAAEISVRVPRGPAVEGGHVNMAFSQSNPPSELHKVHGSRNKPTSLWNPTYGSWFTEKPTKKNNPIAKKEPHDRGNLGLEGSCTVPPNVATGRLPGASLLLEPSSLTANMKEVPLFRLRHFPCGNVNYGYQQQGLPLEAATAPGAGHYEDTILKSKNSMNQPGP

SEQ ID NO: 129 - protein, 4 aa, Homo sapiens
TSTD

SEQ ID NO: 130 - protein, 4 aa, Homo sapiens
MDEI

SEQ ID NO: 131 - protein, 29 aa, Artificial Sequence
  source: /note="Description of Artificial Sequence: Synthetic peptide"
VQAEQAPHLDHHDRLQPQLLLCWQDLLHQ

SEQ ID NO: 132 - protein, 24 aa, Artificial Sequence
  source: /note="Description of Artificial Sequence: Synthetic peptide"
PEGGAAEKHHPHSGSGPWRLWGGV

SEQ ID NO: 133 - protein, 21 aa, Artificial Sequence
  source: /note="Description of Artificial Sequence: Synthetic peptide"
RPGVRNAQRPKPPASGCEDAA

SEQ ID NO: 134 - protein, 125 aa, Artificial Sequence
  source: /note="Description of Artificial Sequence: Synthetic polypeptide"
TGRTGFPHGSPDHQQIQPPEHCSLHWGEPAIPAPVHPAGAHGGGRPQVLPPRDPPSPEPALLPGHAGPSARGSGHCLWLSVFGGKPLHPPRHCCQKLPLDLSRPWKSGQDWRLRDGPRHLQGELL

SEQ ID NO: 135 - protein, 9 aa, Artificial Sequence
  source: /note="Description of Artificial Sequence: Synthetic peptide"
KGRLCHAAS

SEQ ID NO: 136 - protein, 14 aa, Artificial Sequence
  source: /note="Description of Artificial Sequence: Synthetic peptide"
VDAPRGLHGRNIHF

SEQ ID NO: 137 - protein, 61 aa, Artificial Sequence
  source: /note="Description of Artificial Sequence: Synthetic polypeptide"
NRHMVLWSAAMGNLFSWIYAIPQQKQPGSSGVCHQWRPDGPTQELPWACIPDNDSVLATSA

SEQ ID NO: 138 - protein, 12 aa, Artificial Sequence
  source: /note="Description of Artificial Sequence: Synthetic peptide"
RQAQLCHHFGED

SEQ ID NO: 139 - protein, 34 aa, Artificial Sequence
  source: /note="Description of Artificial Sequence: Synthetic polypeptide"
ILHPGPGCNQHRFADRIWSTCGRGRESACEAQGP

SEQ ID NO: 140 - protein, 47 aa, Artificial Sequence
  source: /note="Description of Artificial Sequence: Synthetic polypeptide"
GGSSSPGLSTGKTGGGAQPSCPTTSAYHLLWQGCKETHSCRDLCSSP

SEQ ID NO: 141 - protein, 52 aa, Artificial Sequence
  source: /note="Description of Artificial Sequence: Synthetic polypeptide"
RAGRGRGTREYGILSVQPSFGVAQGPRIQKQAHQLVEPNVRLLVYRETHQKE

SEQ ID NO: 142 - protein, 11 aa, Artificial Sequence
  source: /note="Description of Artificial Sequence: Synthetic peptide"
SYSKEGATRQG

SEQ ID NO: 143 - protein, 11 aa, Artificial Sequence
  source: /note="Description of Artificial Sequence: Synthetic peptide"
PGAGGKLYCPT

SEQ ID NO: 144 - protein, 69 aa, Artificial Sequence
  source: /note="Description of Artificial Sequence: Synthetic polypeptide"
RCNWETSGGLTAPRALFADCQYEGGTSVQATSLPLWECQLRLPATGLALRSRYCPWSWSLRGYHSEKQE

SEQ ID NO: 145 - protein, 7 aa, Artificial Sequence
  source: /note="Description of Artificial Sequence: Synthetic peptide"
HEPAWAL

We claim:

1. A method of treating a subject having an FGFR3-TACC3 fusion polypeptide associated cancer, comprising:
    determining the presence of an FGFR3-TACC3 fusion polypeptide or an mRNA molecule encoding the FGFR3-TACC3 fusion polypeptide in said subject by performing an assay on a sample from the subject, wherein:
    (i) the FGFR3-TACC3 fusion polypeptide comprises encoded exons 1-17 of SEQ ID NO: 4 directly fused to encoded exons 8-16 of SEQ ID NO: 6, and a fusion junction between encoded exon 17 of SEQ ID NO: 4 and encoded exon 8 of SEQ ID NO: 6, wherein the cancer is a lung adenocarcinoma or a cervical adenocarcinoma, or
    (ii) the FGFR3-TACC3 fusion polypeptide comprises encoded exons 1-18 of SEQ ID NO: 4 directly fused to encoded exons 10-16 of SEQ ID NO: 6, and a fusion junction between encoded exon 18 of SEQ ID NO: 4 and encoded exon 10 of SEQ ID NO: 6, wherein the cancer is a uterus endometrial adenocarcinoma; and
    administering to the subject having the FGFR3-TACC3 fusion polypeptide or the mRNA molecule encoding the FGFR3-TACC3 fusion polypeptide an effective amount of an anti-cancer agent,
    thereby treating the cancer in the subject.

2. The method of claim 1, wherein said anti-cancer agent is a kinase inhibitor.

3. The method of claim 1, wherein the determining step comprises determining the presence of the mRNA molecule encoding the FGFR3-TACC3 fusion polypeptide by sequencing.

4. The method of claim 1, wherein the anti-cancer agent is a multi-kinase inhibitor, a kinase-specific inhibitor, TAE-684, PF02341066 (crizotinib), AF-802, LDK-378, ASP-3026, CEP-37440, CEP-28122, CEP-108050, or AP26113.

5. The method of claim 1, wherein the FGFR3-TACC3 fusion polypeptide comprises encoded exons 1-17 of SEQ ID NO: 4 directly fused to encoded exons 8-16 of SEQ ID NO: 6, wherein the fusion junction is between encoded exon 17 of SEQ ID NO: 4 and encoded exon 8 of SEQ ID NO: 6.

6. The method of claim 1, wherein the FGFR3-TACC3 fusion polypeptide comprises SEQ ID NO: 2.

7. The method of claim 1, wherein the mRNA molecule encoding the FGFR3-TACC3 fusion polypeptide comprises exons 1-17 of SEQ ID NO: 3 directly fused to exons 8-16 of SEQ ID NO: 5, wherein the fusion junction of the mRNA molecule encoding the FGFR3-TACC3 fusion polypeptide is between exon 17 of SEQ ID NO: 3 and exon 8 of SEQ ID NO: 5.

8. The method of claim 1, wherein the mRNA molecule encoding the FGFR3-TACC3 fusion polypeptide comprises SEQ ID NO: 1.

9. The method of claim 1, wherein the FGFR3-TACC3 fusion polypeptide comprises encoded exons 1-18 of SEQ ID NO: 4 directly fused to encoded exons 10-16 of SEQ NO: 6, wherein the fusion junction is between encoded exon 18 of SEQ ID NO: 4 and encoded exon 10 of SEQ ID NO: 6.

10. The method of claim 1, wherein the mRNA molecule encoding the FGFR3-TACC3 fusion polypeptide comprises exons 1-18 of SEQ ID NO: 3 directly fused to exons 10-16 of SEQ ID NO: 5, wherein the fusion junction of the mRNA molecule encoding the FGFR3-TACC3 fusion polypeptide is between exon 18 of SEQ ID NO: 3 and exon 10 of SEQ ID NO: 5.

11. The method of claim 1, further comprising obtaining the sample from the subject.

12. The method of claim 1, wherein the sample is a nucleic acid sample.

13. The method of claim 1, wherein the sample is a blood, serum, or plasma sample.

14. The method of claim 1, wherein the sample comprises a tumor biopsy or a circulating tumor cell or nucleic acid.

15. The method of claim 1, wherein the cancer is a lung adenocarcinoma.

16. The method of claim 1, wherein the cancer is a cervical adenocarcinoma.

17. The method of claim 1, wherein the cancer is a uterus endometrial adenocarcinoma.

18. The method of claim 6, wherein said anti-cancer agent is a kinase inhibitor.

19. The method of claim 18, further comprising obtaining the sample from the subject.

20. The method of claim 18, wherein the cancer is a lung adenocarcinoma.

21. The method of claim 18, wherein the cancer is a cervical adenocarcinoma.

22. The method of claim 9, wherein the cancer is a uterus endometrial adenocarcinoma.

23. The method of claim 18, wherein the sample is a nucleic acid sample.

24. The method of claim 18, wherein the sample is a blood, serum, or plasma sample.

25. The method of claim 18, wherein the sample comprises a tumor biopsy or a circulating tumor cell or nucleic acid.

26. The method of claim 1, wherein the anti-cancer agent inhibits kinase activity of the FGFR3-TACC3 fusion polypeptide.

* * * * *